United States Patent 11,446,398 (REGULATED BIOCIRCUIT SYSTEMS) - sequence listing, part 27

SEQ ID NO: 108868 - DNA, 1846 bp, Homo sapiens
  Payload ID: 1385
  Gene Symbol: ARMCX6
  Gene Name: armadillo repeat containing, X-linked 6
  Uniprot ID: Q7L4S7
  ENST ID: ENST00000361910
  CDS Start-End: 346-1248
cacgtgaccaagagccgcctagagcacaagtcctgctagtcgcctccgtctgggtaccagccccctattactctgcaggcgtgtgaagaaagaaggaaactagctcggaccgtgcaggtttgtaggtctgttggcctgtaggtttcggcacaagtttcagcgagagaaggagaaaactgccttggttggaaccttgcagattcatcacaagagagctacaagagcctggaagaagctgaagactgctaccctccatccttactcaccctggacctgagagacctcttcaatcaggtggagcaaggccctctcctgtcctgccccaaggctggcacagacttgagcatgggccgggctcgggaagtgggttggatggcggcaggactgatgattggggctggtgcctgctactgcgtttacaaactgaccataggaagagatgacagtgagaagctggaggaggagggggaagaggagtgggacgatgaccaggagctggatgaggaggagcctgatatttggtttgattttgaaactatggctcggccctggactgaggatggggattggactgaacctggggccccaggtggcactgaggacaggccctcagggggaggcaaggccaaccgagcacacccaataaaacagcggccattcccctatgaacataaaaatacttggagtgctcaaaattgtaaaaatggcagttgtgttctggacctctccaagtgtcttttcattcagggaaaactgttgtttgccgagcccaaggatgcgggctttccatttagccaggatatcaatagccatttggccagcctctcaatggctagaaacacgagccccactccagaccccactgttagagaggctttgtgtgccccggataacttaaatgcgagtattgaaagtcagggccagattaagatgtacatcaatgaagtgtgtcgggagactgtgtcacgttgctgcaactcatttctgcagcaggccggattaaatttgttaataagcatgacagttattaataacatgcttgccaagtccgcttcagacttgaagtttcctttgatatcagagggaagtggatgtgctaaggttcaggttttgaaaccgctgatgggtttgtctgaaaagccagtcttggcgggggagttagtcggtgcccagatgctcttctcattcatgtccctctttatcagaaatggaaacagagagattctcctggaaacccctgccccataaacggccctctcgaacacaatgggacggaatccacccacaacgcgcttggtttgcagatgtcaaagaatctgcagagggtgctactgaagatccagccttagccaatcaccacctcattgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgtttgctctttcttctacacgcgcctgatggatagtgaacctattcatcaaaaaagtgcactgctcttctgtctattgtaccgacttaacctcttccacccaagtccgcatctgtgtgtatcatcaataaagttgtgtgctttgattggcagaaaa

SEQ ID NO: 108869 - DNA, 1758 bp, Homo sapiens
  Payload ID: 1385
  Gene Symbol: ARMCX6
  Gene Name: armadillo repeat containing, X-linked 6
  Uniprot ID: Q7L4S7
  ENST ID: ENST00000538627
  CDS Start-End: 264-1166
cacgtgaccaagagccgcctagagcacaagtcctgctagtcgcctccgtctgggtaccagccccctattactctgcaggcgtgtgaagaaagaaggaaactagctcggaccgtgcagattcatcacaagagagctacaagagcctggaagaagctgaagactgctaccctccatccttactcaccctggacctgagagacctcttcaatcaggtggagcaaggccctctcctgtcctgccccaaggctggcacagacttgagcatgggccgggctcgggaagtgggttggatggcggcaggactgatgattggggctggtgcctgctactgcgtttacaaactgaccataggaagagatgacagtgagaagctggaggaggagggggaagaggagtgggacgatgaccaggagctggatgaggaggagcctgatatttggtttgattttgaaactatggctcggccctggactgaggatggggattggactgaacctggggccccaggtggcactgaggacaggccctcagggggaggcaaggccaaccgagcacacccaataaaacagcggccattcccctatgaacataaaaatacttggagtgctcaaaattgtaaaaatggcagttgtgttctggacctctccaagtgtcttttcattcagggaaaactgttgtttgccgagcccaaggatgcgggctttccatttagccaggatatcaatagccatttggccagcctctcaatggctagaaacacgagccccactccagaccccactgttagagaggctttgtgtgccccggataacttaaatgcgagtattgaaagtcagggccagattaagatgtacatcaatgaagtgtgtcgggagactgtgtcacgttgctgcaactcatttctgcagcaggccggattaaatttgttaataagcatgacagttattaataacatgcttgccaagtccgcttcagacttgaagtttcctttgatatcagagggaagtggatgtgctaaggttcaggttttgaaaccgctgatgggtttgtctgaaaagccagtcttggcgggggagttagtcggtgcccagatgctcttctcattcatgtccctctttatcagaaatggaaacagagagattctcctggaaacccctgccccataaacggccctctcgaacacaatgggacggaatccacccacaacgcgcttggtttgcagatgtcaaagaatctgcagagggtgctactgaagatccagccttagccaatcaccacctcattgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgtttgctctttcttctacacgcgcctgatggatagtgaacctattcatcaaaaaagtgcactgctcttctgtctattgtaccgacttaacctcttccacccaagtccgcatctgtgtgtatcatcaataaagttgtgtgctttgattggc

SEQ ID NO: 108870 - DNA, 1928 bp, Homo sapiens
  Payload ID: 1385
  Gene Symbol: ARMCX6
  Gene Name: armadillo repeat containing, X-linked 6
  Uniprot ID: Q7L4S7
  ENST ID: ENST00000539247
  CDS Start-End: 434-1336
cacgtgaccaagagccgcctagagcacaagtcctgctagtcgcctccgtctgggtaccagccccctattactctgcaggcgtgtgaagaaagaaggaaactagctcggaccgtgcaggtttgtaggtctgttggcctgtaggtttcggcacaagtttcagcgagagaaggagaaaactgccttggttggaaccttgcagtgcagggaaaggggtgtggcggcctttgctggggaaatggcggacgacaagtggggcggaggaggcctgcgtccggaaagtcagtagaattcatcacaagagagctacaagagcctggaagaagctgaagactgctaccctccatccttactcaccctggacctgagagacctcttcaatcaggtggagcaaggccctctcctgtcctgccccaaggctggcacagacttgagcatgggccgggctcgggaagtgggttggatggcggcaggactgatgattggggctggtgcctgctactgcgtttacaaactgaccataggaagagatgacagtgagaagctggaggaggagggggaagaggagtgggacgatgaccaggagctggatgaggaggagcctgatatttggtttgattttgaaactatggctcggccctggactgaggatggggattggactgaacctggggccccaggtggcactgaggacaggccctcagggggaggcaaggccaaccgagcacacccaataaaacagcggccattcccctatgaacataaaaatacttggagtgctcaaaattgtaaaaatggcagttgtgttctggacctctccaagtgtcttttcattcagggaaaactgttgtttgccgagcccaaggatgcgggctttccatttagccaggatatcaatagccatttggccagcctctcaatggctagaaacacgagccccactccagaccccactgttagagaggctttgtgtgccccggataacttaaatgcgagtattgaaagtcagggccagattaagatgtacatcaatgaagtgtgtcgggagactgtgtcacgttgctgcaactcatttctgcagcaggccggattaaatttgttaataagcatgacagttattaataacatgcttgccaagtccgcttcagacttgaagtttcctttgatatcagagggaagtggatgtgctaaggttcaggttttgaaaccgctgatgggtttgtctgaaaagccagtcttggcgggggagttagtcggtgcccagatgctcttctcattcatgtccctctttatcagaaatggaaacagagagattctcctggaaacccctgccccataaacggccctctcgaacacaatgggacggaatccacccacaacgcgcttggtttgcagatgtcaaagaatctgcagagggtgctactgaagatccagccttagccaatcaccacctcattgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgtttgctctttcttctacacgcgcctgatggatagtgaacctattcatcaaaaaagtgcactgctcttctgtctattgtaccgacttaacctcttccacccaagtccgcatctgtgtgtatcatcaataaagttgtgtgctttgattggc

SEQ ID NO: 108871 - DNA, 4041 bp, Homo sapiens
  Payload ID: 1386
  Gene Symbol: ARVCF
  Gene Name: armadillo repeat gene deleted in velocardiofacial syndrome
  Uniprot ID: O00192
  ENST ID: ENST00000263207
  CDS Start-End: 293-3181
gagggcgggagggctggcccggggtctcgggttgcgcgctgggcctggagggagggggcggcccccgcaccggtccgagttgcggccgcgtggactgcgacccgcgccgcgccgcaccgcgccgcgccctgggaacgccgctccccgcgcgccaacggacccggggaagcccttctggggtccgaggccgcgctgcggggccgcccacgctgcgctccaggagccagagcctgcagggtgggtgtcgggacatgctgatcttccctcaagacagctggcgggcgctctggtcatggaggactgcaatgtgcactcggccgccagcatcctggcctcggtgaaggagcaggaggcccgcttcgagaggctgacacgggcactggagcaggagcggcgccatgttgccctacagctggagcgtgcccagcagcctggcatggtcagtggtggcatgggcagtgggcagcccctgccaatggcctggcaacagctggtcctccaggagcagagcccaggcagccaggcctcactggccacgatgccggaggcacctgatgtgctggaggagaccgtgacggtggaggaggaccccggcacacccacttcccatgtgtctattgtcacatccgaagatggcacaacccggcgcaccgagaccaaggtcaccaagactgtcaagacggtgaccactcggacagtacgccaggtgcccgtgggcccagatggactccccctgctggatggcggccccccactaggcccttttgcagatggtgccctggaccggcatttcctgctgcgtggtggtggcccagtggccacactctctcgagcctacctcagcagtgggggtggctttcccgaaggccccgagccccgggacagccccagctatggcagcctgtcccgagggctgggcatgcggcccccacgtgctggcccccttggcccaggccctggtgatggctgcttcacactgcctggccaccgggaagccttcccggtgggtcctgagcctgggccaccaggtggccgctccctgcccgagcgcttccaggcagagccgtatggcttggaggatgacacgcgcagcctggccgctgatgacgagggtggccctgagctggagcctgactatggcacggccacaaggaggaggcctgagtgtgggcggggccttcataccagggcctacgaggacacagcagatgatggcggcgagctggcggacgagcggcctgcgttcccaatggtgacggcgcccctggcccagcctgaacggggcagcatgggcagcctggaccggctggtgcggcgctcgccctcagtggatagcgcccgcaaggagccgcgctggcgggaccctgagctgcctgaggtgctggccatgctgcggcaccccgtggaccccgtgaaggccaatgcggccgcctacctgcagcatctgtgctttgagaacgagggtgtcaagcggcgtgtacggcagttgcgggggctgccgctgcttgtggcactgctggaccacccgcgggctgaggtgcggcgccgggcctgtggggcactgcgcaacctctcctatggccgcgacactgacaacaaggccgccatccgggactgcggtggtgtgcctgccctggtgcgcctgctgagggctgcccgggacaacgaggtccgtgagcttgtcactggcaccctgtggaacctgtcatcctatgagcccctgaagatggtcatcattgaccatggcctgcagacgctgacccacgaggtgatcgtgccccactcaggatgggagcgtgagcccaacgaggactccaagccacgggacgccgagtggacaactgtcttcaagaacacgtcgggctgcctgaggaatgtgagctccgatggtgctgaggcccggcggcgactccgggagtgtgaagggctggtggacgcgctcctgcatgccctgcagtcggctgtgggccggaaggacactgacaacaagtcggtggagaactgcgtgtgcatcatgcggaacctgtcctaccacgtgcacaaggaggtgcccggggccgacaggtaccaggaggccgagcccgggcccctgggcagtgctgtaggctcccagcgccggaggcgggatgatgccagctgctttggaggcaagaaggccaaagaggagtggttccaccaaggaaagaaggatggtgagatggaccggaactttgacacgctagacctgcccaagcgaactgaggccgccaaaggctttgagctgctgtaccagcccgaggtggtacgtctctacctctccctcctcacggagagccggaacttcaacaccctggaggctgccgccggcgctctgcagaacctcagtgccggcaactggatgtgggccacgtacatccgcgccacagtgcgcaaagagcgcgggctgccggtgcttgtggaactgctgcagtctgagaccgacaaggtggtgcgcgccgtcgccatcgctctgcgcaacctctcgctggaccggcgcaacaaagacctcatcgggagctacgccatggctgagcttgtgcggaatgtgcgcaatgcacaggctccgccgcgaccgggggcctgcctggaggaagacaccgtggtggcggtgctcaacaccatccacgaaatcgtgtccgacagcctggataacgcgcgctcgctcctgcaggcacgcggggtgccagcgttggtggctctcgtggcctccagccaatcggtacgcgaagcgaaggcggcgtcacacgtgctgcagacagtgtggagctacaaggagctgcgtggtaccttgcagaaagatggttggaccaaggcgcgcttccagtcagctgctgctactgccaaggggcctaagggagcactgagtcctgggggcttcgatgacagcacgctgccactggtggacaagagccttgagggcgagaaaactggcagccgggatgtgatccccatggatgcgctgggcccagacggatactccacggtggaccggagggagcggaggccacggggcgccagctctgcaggagaggcctctgagaaggaacccttgaaactcgaccccagcaggaaggcccctccccccgggcccagcaggcccgcggtcaggctggtggacgccgtaggggacgctaagcctcagcccgttgattcctgggtctagcttgcatgcctgggcccaggcccagcctcttgttcttagggcttggatcgtggaagaagggccaccctgagcagatcgtgccgtggagcttggagccccctggcggcaggggttggcagcgcctcgccccagccaagcctgactttggggacaccctcctgcccccccaccccactccccccatcctacctaactccctaggcctgagttagctgtttactgacatggtgctgtgtgtgagcgagtgacagaaggcccgaggaggccgactgggctgctggggcagggcccagggaggtggcagggaagggtgcctggctgggctttggggctggtgggataggagggtgcccctgggaacacagtgccccagtggtgcgggccaggtctggcgccaggggcaggcagctaggcagggagggggctgggaaagaacttggacttctaaaggcggagggtctccctgggcaccctgcaggcaggcagaccacggtgtggggggtgccccacaaggcccagccctgggcaaggaagctttggaagcagcaaggtgggggtcaggctacaggtgccccacctccccagagccctgcagtcacgtgaggcccctgtgcagtagagagcctttctccagcccatgctggctggggccggggctgccgcatctgcctggagcctgggcagcacctccgggactgaccttcggcagtggctgggggactgctttcagtgcctgctgttcgtgactcagaaacagaagaaaaacactgagaaaaagcattaaaaataagccaaaataagactattggtaaacacctaaatttttgtaagaaaatttaaaaattaaagcagcaaaggaa

SEQ ID NO: 108872 - DNA, 2700 bp, Homo sapiens
  Payload ID: 1386
  Gene Symbol: ARVCF
  Gene Name: armadillo repeat gene deleted in velocardiofacial syndrome
  Uniprot ID: O00192
  ENST ID: ENST00000401994
  CDS Start-End: 1-2700
atgccggccgaactcagacaggagcagagcccaggcagccaggcctcactggccacgatgccggaggcacctgatgtgctggaggagaccgtgacggtggaggaggaccccggcacacccacttcccatgtgtctattgtcacatccgaagatggcacaacccggcgcaccgagaccaaggtcaccaagactgtcaagacggtgaccactcggacagtacgccaggtgcccgtgggcccagatggactccccctgctggatggcggccccccactaggcccttttgcagatggtgccctggaccggcatttcctgctgcgtggtggtggcccagtggccacactctctcgagcctacctcagcagtgggggtggctttcccgaaggccccgagccccgggacagccccagctatggcagcctgtcccgagggctgggcatgcggcccccacgtgctggcccccttggcccaggccctggtgatggctgcttcacactgcctggccaccgggaagccttcccggtgggtcctgagcctgggccaccaggtggccgctccctgcccgagcgcttccaggcagagccgtatggcttggaggatgacacgcgcagcctggccgctgatgacgagggtggccctgagctggagcctgactatggcacggccacaaggaggaggcctgagtgtgggcggggccttcataccagggcctacgaggacacagcagatgatggcggcgagctggcggacgagcggcctgcgttcccaatggtgacggcgcccctggcccagcctgaacggggcagcatgggcagcctggaccggctggtgcggcgctcgccctcagtggatagcgcccgcaaggagccgcgctggcgggaccctgagctgcctgaggtgctggccatgctgcggcaccccgtggaccccgtgaaggccaatgcggccgcctacctgcagcatctgtgctttgagaacgagggtgtcaagcggcgtgtacggcagttgcgggggctgccgctgcttgtggcactgctggaccacccgcgggctgaggtgcggcgccgggcctgtggggcactgcgcaacctctcctatggccgcgacactgacaacaaggccgccatccgggactgcggtggtgtgcctgccctggtgcgcctgctgagggctgcccgggacaacgaggtccgtgagcttgtcactggcaccctgtggaacctgtcatcctatgagcccctgaagatggtcatcattgaccatggcctgcagacgctgacccacgaggtgatcgtgccccactcaggatgggagcgtgagcccaacgaggactccaagccacgggacgccgagtggacaactgtcttcaagaacacgtcgggctgcctgaggaatgtgagctccgatggtgctgaggcccggcggcgactccgggagtgtgaagggctggtggacgcgctcctgcatgccctgcagtcggctgtgggccggaaggacactgacaacaagtcggtggagaactgcgtgtgcatcatgcggaacctgtcctaccacgtgcacaaggaggtgcccggggccgacaggtaccaggaggccgagcccgggcccctgggcagtgctgtaggctcccagcgccggaggcgggatgatgccagctgctttggaggcaagaaggccaaagaggagtggttccaccaaggaaagaaggatggtgagatggaccggaactttgacacgctagacctgcccaagcgaactgaggccgccaaaggctttgagctgctgtaccagcccgaggtggtacgtctctacctctccctcctcacggagagccggaacttcaacaccctggaggctgccgccggcgctctgcagaacctcagtgccggcaactggatgtgggccacgtacatccgcgccacagtgcgcaaagagcgcgggctgccggtgcttgtggaactgctgcagtctgagaccgacaaggtggtgcgcgccgtcgccatcgctctgcgcaacctctcgctggaccggcgcaacaaagacctcatcgggagctacgccatggctgagcttgtgcggaatgtgcgcaatgcacaggctccgccgcgaccgggggcctgcctggaggaagacaccgtggtggcggtgctcaacaccatccacgaaatcgtgtccgacagcctggataacgcgcgctcgctcctgcaggcacgcggggtgccagcgttggtggctctcgtggcctccagccaatcggtacgcgaagcgaaggcggcgtcacacgtgctgcagacagtgtggagctacaaggagctgcgtggtaccttgcagaaagatggttggaccaaggcgcgcttccagtcagctgctgctactgccaaggggcctaagggagcactgagtcctgggggcttcgatgacagcacgctgccactggtggacaagagccttgagggcgagaaaactggcagccgggatgtgatccccatggatgcgctgggcccagacggatactccacggtggaccggagggagcggaggccacggggcgccagctctgcaggagaggcctctgagaaggaacccttgaaactcgaccccagcaggaaggcccctccccccgggcccagcaggcccgcggtcaggctggtggacgccgtaggggacgctaagcctcagcccgttgattcctgggtctag

SEQ ID NO: 108873 - DNA, 2682 bp, Homo sapiens
  Payload ID: 1386
  Gene Symbol: ARVCF
  Gene Name: armadillo repeat gene deleted in velocardiofacial syndrome
  ENST ID: ENST00000406522
  CDS Start-End: 1-2682
atgccggccgaactcagacaggagcagagcccaggcagccaggcctcactggccacgatgccggaggcacctgatgtgctggaggagaccgtgacggtggaggaggaccccggcacacccacttcccatgtgtctattgtcacatccgaagatggcacaacccggcgcaccgagaccaaggtcaccaagactgtcaagacggtgaccactcggacagtacgccaggtgcccgtgggcccagatggactccccctgctggatggcggccccccactaggcccttttgcagatggtgccctggaccggcatttcctgctgcgtggtggtggcccagtggccacactctctcgagcctacctcagcagtgggggtggctttcccgaaggccccgagccccgggacagccccagctatggcagcctgtcccgagggctgggcatgcggcccccacgtgctggcccccttggcccaggccctggtgatggctgcttcacactgcctggccaccgggaagccttcccggtgggtcctgagcctgggccaccaggtggccgctccctgcccgagcgcttccaggcagagccgtatggcttggaggatgacacgcgcagcctggccgctgatgacgagggtggccctgagctggagcctgactatggcacggccacaaggaggaggcctgagtgtgggcggggccttcataccagggcctacgaggacacagcagatgatggcggcgagctggcggacgagcggcctgcgttcccaatggtgacggcgcccctggcccagcctgaacggggcagcatgggcagcctggaccggctggtgcggcgctcgccctcagtggatagcgcccgcaaggagccgcgctggcgggaccctgagctgcctgaggtgctggccatgctgcggcaccccgtggaccccgtgaaggccaatgcggccgcctacctgcagcatctgtgctttgagaacgagggtgtcaagcggcgtgtacggcagttgcgggggctgccgctgcttgtggcactgctggaccacccgcgggctgaggtgcggcgccgggcctgtggggcactgcgcaacctctcctatggccgcgacactgacaacaaggccgccatccgggactgcggtggtgtgcctgccctggtgcgcctgctgagggctgcccgggacaacgaggtccgtgagcttgtcactggcaccctgtggaacctgtcatcctatgagcccctgaagatggtcatcattgaccatggcctgcagacgctgacccacgaggtgatcgtgccccactcaggatgggagcgtgagcccaacgaggactccaagccacgggacgccgagtggacaactgtcttcaagaacacgtcgggctgcctgaggaatgtgagctccgatggtgctgaggcccggcggcgactccgggagtgtgaagggctggtggacgcgctcctgcatgccctgcagtcggctgtgggccggaaggacactgacaacaagtcggtggagaactgcgtgtgcatcatgcggaacctgtcctaccacgtgcacaaggaggtgcccggggccgacaggtaccaggaggccgagcccgggcccctgggcagtgctgtaggctcccagcgccggaggcgggatgatgccagctgctttggaggcaagaaggccaaaggaaagaaggatggtgagatggaccggaactttgacacgctagacctgcccaagcgaactgaggccgccaaaggctttgagctgctgtaccagcccgaggtggtacgtctctacctctccctcctcacggagagccggaacttcaacaccctggaggctgccgccggcgctctgcagaacctcagtgccggcaactggatgtgggccacgtacatccgcgccacagtgcgcaaagagcgcgggctgccggtgcttgtggaactgctgcagtctgagaccgacaaggtggtgcgcgccgtcgccatcgctctgcgcaacctctcgctggaccggcgcaacaaagacctcatcgggagctacgccatggctgagcttgtgcggaatgtgcgcaatgcacaggctccgccgcgaccgggggcctgcctggaggaagacaccgtggtggcggtgctcaacaccatccacgaaatcgtgtccgacagcctggataacgcgcgctcgctcctgcaggcacgcggggtgccagcgttggtggctctcgtggcctccagccaatcggtacgcgaagcgaaggcggcgtcacacgtgctgcagacagtgtggagctacaaggagctgcgtggtaccttgcagaaagatggttggaccaaggcgcgcttccagtcagctgctgctactgccaaggggcctaagggagcactgagtcctgggggcttcgatgacagcacgctgccactggtggacaagagccttgagggcgagaaaactggcagccgggatgtgatccccatggatgcgctgggcccagacggatactccacggtggaccggagggagcggaggccacggggcgccagctctgcaggagaggcctctgagaaggaacccttgaaactcgaccccagcaggaaggcccctccccccgggcccagcaggcccgcggtcaggctggtggacgccgtaggggacgctaagcctcagcccgttgattcctgggtctag

SEQ ID NO: 108874 - DNA, 2871 bp, Homo sapiens
  Payload ID: 1386
  Gene Symbol: ARVCF
  Gene Name: armadillo repeat gene deleted in velocardiofacial syndrome
  ENST ID: ENST00000406259
  CDS Start-End: 1-2871
atggaggactgcaatgtgcactcggccgccagcatcctggcctcggtgaaggagcaggaggcccgcttcgagaggctgacacgggcactggagcaggagcggcgccatgttgccctacagctggagcgtgcccagcagcctggcatggtcagtggtggcatgggcagtgggcagcccctgccaatggcctggcaacagctggtcctccaggagcagagcccaggcagccaggcctcactggccacgatgccggaggcacctgatgtgctggaggagaccgtgacggtggaggaggaccccggcacacccacttcccatgtgtctattgtcacatccgaagatggcacaacccggcgcaccgagaccaaggtcaccaagactgtcaagacggtgaccactcggacagtacgccaggtgcccgtgggcccagatggactccccctgctggatggcggccccccactaggcccttttgcagatggtgccctggaccggcatttcctgctgcgtggtggtggcccagtggccacactctctcgagcctacctcagcagtgggggtggctttcccgaaggccccgagccccgggacagccccagctatggcagcctgtcccgagggctgggcatgcggcccccacgtgctggcccccttggcccaggccctggtgatggctgcttcacactgcctggccaccgggaagccttcccggtgggtcctgagcctgggccaccaggtggccgctccctgcccgagcgcttccaggcagagccgtatggcttggaggatgacacgcgcagcctggccgctgatgacgagggtggccctgagctggagcctgactatggcacggccacaaggaggaggcctgagtgtgggcggggccttcataccagggcctacgaggacacagcagatgatggcggcgagctggcggacgagcggcctgcgttcccaatggtgacggcgcccctggcccagcctgaacggggcagcatgggcagcctggaccggctggtgcggcgctcgccctcagtggatagcgcccgcaaggagccgcgctggcgggaccctgagctgcctgaggtgctggccatgctgcggcaccccgtggaccccgtgaaggccaatgcggccgcctacctgcagcatctgtgctttgagaacgagggtgtcaagcggcgtgtacggcagttgcgggggctgccgctgcttgtggcactgctggaccacccgcgggctgaggtgcggcgccgggcctgtggggcactgcgcaacctctcctatggccgcgacactgacaacaaggccgccatccgggactgcggtggtgtgcctgccctggtgcgcctgctgagggctgcccgggacaacgaggtccgtgagcttgtcactggcaccctgtggaacctgtcatcctatgagcccctgaagatggtcatcattgaccatggcctgcagacgctgacccacgaggtgatcgtgccccactcaggatgggagcgtgagcccaacgaggactccaagccacgggacgccgagtggacaactgtcttcaagaacacgtcgggctgcctgaggaatgtgagctccgatggtgctgaggcccggcggcgactccgggagtgtgaagggctggtggacgcgctcctgcatgccctgcagtcggctgtgggccggaaggacactgacaacaagtcggtggagaactgcgtgtgcatcatgcggaacctgtcctaccacgtgcacaaggaggtgcccggggccgacaggtaccaggaggccgagcccgggcccctgggcagtgctgtaggctcccagcgccggaggcgggatgatgccagctgctttggaggcaagaaggccaaaggaaagaaggatggtgagatggaccggaactttgacacgctagacctgcccaagcgaactgaggccgccaaaggctttgagctgctgtaccagcccgaggtggtacgtctctacctctccctcctcacggagagccggaacttcaacaccctggaggctgccgccggcgctctgcagaacctcagtgccggcaactggatgtgggccacgtacatccgcgccacagtgcgcaaagagcgcgggctgccggtgcttgtggaactgctgcagtctgagaccgacaaggtggtgcgcgccgtcgccatcgctctgcgcaacctctcgctggaccggcgcaacaaagacctcatcgggagctacgccatggctgagcttgtgcggaatgtgcgcaatgcacaggctccgccgcgaccgggggcctgcctggaggaagacaccgtggtggcggtgctcaacaccatccacgaaatcgtgtccgacagcctggataacgcgcgctcgctcctgcaggcacgcggggtgccagcgttggtggctctcgtggcctccagccaatcggtacgcgaagcgaaggcggcgtcacacgtgctgcagacagtgtggagctacaaggagctgcgtggtaccttgcagaaagatggttggaccaaggcgcgcttccagtcagctgctgctactgccaaggggcctaagggagcactgagtcctgggggcttcgatgacagcacgctgccactggtggacaagagccttgagggcgagaaaactggcagccgggatgtgatccccatggatgcgctgggcccagacggatactccacggtggaccggagggagcggaggccacggggcgccagctctgcaggagaggcctctgagaaggaacccttgaaactcgaccccagcaggaaggcccctccccccgggcccagcaggcccgcggtcaggctggtggacgccgtaggggacgctaagcctcagcccgttgattcctgggtctag

SEQ ID NO: 108875 - DNA, 2829 bp, Homo sapiens
  Payload ID: 1387
  Gene Symbol: ACTR1A
  Gene Name: ARP1 actin-related protein 1 homolog A, centractin alpha (yeast)
  Uniprot ID: P61163
  ENST ID: ENST00000369905
  CDS Start-End: 65-1195
tcagtggcgctagcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggttttggtgacaggctcctgagtgaagtgaagaaactagctccaaaagatgtgaagatcaggatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgtgcacatgcgagtgccgtgtggccctgggaccctgggcccagaaaggacgatgaactacctgcagtggtgatggcctgaggcctggggttgaccactaactggctcctgacagggaagagcgctggcagaggctgtgctccctcctcaggtggcctctggctggctgtgggggactccgtttactaccacagggagacagagggaggtaagccatcccccgggagaccttgctgctgaccatcctaggctgggctggccccaccctcacccccacccccagggtgccctgaggccccaggcagctgctgcctccactatcgatgcctcctgactgcacactgaggactgggactggggttgagttctgtctggttttgttgccattttggtttgggaggctggaaaagcaccccaagagctattacagagactggagtcaggagagagcaggaggccctcatgttcaccagggaacaggaccacaccggccactggaggagggcaggagcagtcctcactctgaatggctgcagagttaatgttcccagcccagtcccctttcgggggccttgggagagtttaaggcacctgctggttccaggacctcgctttccatctgttcttgttgcaatgccatcttcaaaccgttttatttattgaagtgtttgttcagttaggggctggagagagggagcttgctgcctcctgccttgctacactaatgtttacagcacctaagcttagcctccagggccccacctctcccagctgatggtgagctgacagtgtccacaggttccaggaccatttgagattggaagctacactcaaagacactcccaccaggctctttctcccttttcctcttgctcactgccctggaatcaacaggctggttgctggttagattttctgaaacaggaggtaaaatttttctttggcagaggcccctaagcaagggaggggtgttggagagccagtgcccttaagactggagaaagctgcaatttaccaagttgccttttgccactgtagctgaccaggggactaggttgtagaggtgggaaggccccctctgggctgatcttgtgccattcttgaccttggacctgcttggttaaggagggagtgggccagaccagagtgccaggagctaatggagccaggcctgactcctaggagtggtccaaaggccttcagcctagatggtgcaaagctggggccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatagacacgtca

SEQ ID NO: 108876 - DNA, 2726 bp, Homo sapiens
  Payload ID: 1387
  Gene Symbol: ACTR1A
  Gene Name: ARP1 actin-related protein 1 homolog A, centractin alpha (yeast)
  ENST ID: ENST00000487599
  CDS Start-End: 32-1030
ttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaagatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgtgcacatgcgagtgccgtgtggccctgggaccctgggcccagaaaggacgatgaactacctgcagtggtgatggcctgaggcctggggttgaccactaactggctcctgacagggaagagcgctggcagaggctgtgctccctcctcaggtggcctctggctggctgtgggggactccgtttactaccacagggagacagagggaggtaagccatcccccgggagaccttgctgctgaccatcctaggctgggctggccccaccctcacccccacccccagggtgccctgaggccccaggcagctgctgcctccactatcgatgcctcctgactgcacactgaggactgggactggggttgagttctgtctggttttgttgccattttggtttgggaggctggaaaagcaccccaagagctattacagagactggagtcaggagagagcaggaggccctcatgttcaccagggaacaggaccacaccggccactggaggagggcaggagcagtcctcactctgaatggctgcagagttaatgttcccagcccagtcccctttcgggggccttgggagagtttaaggcacctgctggttccaggacctcgctttccatctgttcttgttgcaatgccatcttcaaaccgttttatttattgaagtgtttgttcagttaggggctggagagagggagcttgctgcctcctgccttgctacactaatgtttacagcacctaagcttagcctccagggccccacctctcccagctgatggtgagctgacagtgtccacaggttccaggaccatttgagattggaagctacactcaaagacactcccaccaggctctttctcccttttcctcttgctcactgccctggaatcaacaggctggttgctggttagattttctgaaacaggaggtaaaatttttctttggcagaggcccctaagcaagggaggggtgttggagagccagtgcccttaagactggagaaagctgcaatttaccaagttgccttttgccactgtagctgaccaggggactaggttgtagaggtgggaaggccccctctgggctgatcttgtgccattcttgaccttggacctgcttggttaaggagggagtgggccagaccagagtgccaggagctaatggagccaggcctgactcctaggagtggtccaaaggccttcagcctagatggtgcaaagctggggccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatag

SEQ ID NO: 108877 - DNA, 2243 bp, Homo sapiens
  Payload ID: 1388
  Gene Symbol: ACTR1B
  Gene Name: ARP1 actin-related protein 1 homolog B, centractin beta (yeast)
  Uniprot ID: P42025
  ENST ID: ENST00000289228
  CDS Start-End: 218-1348
cccgggcacctgctgtcaatcgggccaggtgggagcgatgattggccgccgggcccgccctccagaaagccccgcggggctcgcgtaggctgcaggctcggggagggagggcagcggcgccgcgtcgggagccgccgccgtcccggtcctcccgcccgcccgcccatccggtgcctcctgcagcccgcctgctgggcagggccggcgcggcccggccatggagtcctacgacatcatcgccaaccagcctgtggtcatcgacaacggttcgggggtgattaaagctggctttgcaggagaccagattcccaaatactgtttcccaaactatgtcgggcggccgaagcacatgcgggtgatggctggagccctggagggggacctcttcatcggaccaaaagcagaggagcaccgggggctgctgaccatccgctaccccatggagcacggcgtggtgcgagactggaacgacatggaacgcatctggcagtacgtctactccaaggatcagctgcagaccttctcggaggagcatcctgtgctcctcacggaggccccgctcaacccgagtaagaaccgggagaaggcggcagaggtgttctttgagaccttcaacgtgccggccctgttcatctccatgcaggctgtgctcagtctgtacgcaacaggacgcacgacaggagtggttctagactcaggggacggggtcactcatgctgtgcccatctatgagggctttgccatgcctcactccatcatgcgggtggacattgccggccgcgacgtctcccgctacctccgactcctgctgcgcaaggaaggggttgacttccatacctcggctgagtttgaggttgtccggacaatcaaagagcgagcgtgctacctgtccatcaacccacagaaggatgaggctctggagacggagaaggtgcagtacacgttgccagacggcagcacgcttgatgtggggcctgcacgattccgggcccccgagctgctgttccagccggaccttgtcggggatgagagtgaggggctccatgaggtggtggccttcgccatacacaagtccgacatggacctgcgccggacgctgttcgccaacatcgtgctctcaggtggctcaacgcttttcaaaggcttcggagaccgattactcagtgaagtgaagaagcttgccccaaaggatatcaaaatcaagatctcagccccgcaggaacggctgtactccacatggattggcggctccatcctggcctcgctggacacttttaagaagatgtgggtgtccaaaaaggagtatgaagaggatggctcccgtgctattcatcgcaaaactttctagtgcccaaggagggcggggcatgttgggagagggggagggaggggagacagagcctttaaccctttttggtcttggctcgtatactaggcttagggtcccctgcatgccctgaacccctgggtgggtggcacagcagtgcccccctgcagccttcccctctacacaggacatgcacacacaagtaacattgagctgcatggacaggagccttgagctggcgtgtgggaattgagcgccatgtcaggctgttgtgggtatccccctggcagggccagctaggcctgtggttccctgctccgactctcagggctgcctccctgagctccagggccagaatgcctggatgcctgggtagccagtttggggagtgggctgcaaggggcagccagcagctcccactggtgtgtcactgcatccattgccacctcctgttcgtgacctgacagggtgacacagcccctttcacactctgtcctcctatcttcctgggtagatgccctggtgtagggctgagtactgaatggtcttccatccccagcaagggggtgcagcccagggtcaggcccttcagagccagggcagaggatgcacggtggctagagccgctgcactatccttttcagagcacttcatccacttgctcctccctctaccctcggcaccctgggtgggaaagggttgatgctcatcatttattgaggggaagccacttaataaggagtcagacctaaaagggggtgggggacattttcttacctcacccaagaaagaggtcgtcacttttgctgtggccagggccccacctccctctctcagatatgtacaataatttaacacggttgcctgaaaaaaacttttgtaaatcattatagtaataattatggacaaggcccag

SEQ ID NO: 108878 - DNA, 3861 bp, Homo sapiens
  Payload ID: 1389
  Gene Symbol: ACTR2
  Gene Name: ARP2 actin-related protein 2 homolog (yeast)
  Uniprot ID: P61160
  ENST ID: ENST00000260641
  CDS Start-End: 158-1342
agctaaatgacgggcggagcccggcggcggcttccggtcgggggaaaaaagttgggccgaaggaggggccgggaagacgcaagaggaagaagagaaaacggccgggcggcggtggctgtaggttgtgcggctgcagcggctcttccctgggcggacgatggacagccagggcaggaaggtggtggtgtgcgacaacggcaccgggtttgtgaagtgtggatatgcaggctctaactttccagaacacatcttcccagctttggttggaagacctattatcagatcaaccaccaaagtgggaaacattgaaatcaaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtaatgtttgaaacttaccagttttccggtgtatatgtagccatccaggcagttctgactttgtacgctcaaggtttattgactggtgtagtggtagactctggagatggtgtgactcacatttgcccagtatatgaaggcttttctctccctcatcttaccaggagactggatattgctgggagggatataactagatatcttatcaagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacactcccagatggacgtatcatcaaagttgggggagagagatttgaagcaccagaagctttatttcagcctcacttgatcaatgttgaaggagttggtgttgctgaattgctttttaacacaattcaggcagctgacattgataccagatctgaattctacaaacacattgtgctttctggagggtctactatgtatcctggcctgccatcacggttggaacgagaacttaaacagctttacttagaacgagttttgaagggtgatgtggaaaaactttctaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccgtcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctataggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcgaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgtttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatcacactaattacaaaatacaagttctggaaaaaatatttttcttcattttaaaacttttttttaactaataatagctttgaaagaagaggcttaatttgggggtggtaactaaaatcaaaagaaatgattgacttgagggtctctgtttggtaagaatacatcattagcttaaataagcagcagaaggttagttttaattatgtagcttctgttaatattaagtgttttttgtctgttttacctcaatttgaacagataagtttgcctgcatgctggacatgcctcagaaccctgaatagcccgtactagatcttgggaacatggatcttagagtcactttggaataagttcttatataaatacccccagccttttgagaacggggcttgttaaaggacgcgtatgtagggcccgtacctactggcagttgggttcagggaaatgggattgacttggccttcaggctcctttggtcataattttaaaatatgggagtagaaaacaacaaagaatggaatggactcttaaaacaatgaaagagcatttatcgtttgtcccttgaatgtagaatttgtttttgatttcataattctgctggtaaatgtgacagttaaaatggtgcattatgtatatatattataatttagaaataccattttataattttactattccagggtgacataatgcatttaaatttgggatttgggtggagtattatgtttaactggagttgtcaagtatgagtccctcaggaaaaaaaaaaaattctgttttaaaaagcaatctgattcttagctcttgaaactattgctacttaaatttccaataattaaaaatttaaaatttttaaattagaattgccaatacttctacatttgagaagggtttttttagaaatacatttagtaaagtccccaagacattagtcttacatttaaacttttttctttaaaacatggttttggtggttaacttttacacagttctgagtactgttaatatctggaaagtatcttgagatatcagtggaaagctaaacagtctaaattaacatgaaatacttcattttgattgagaaaataaaatcagattttttcaaagtcaa

SEQ ID NO: 108879 - DNA, 2685 bp, Homo sapiens
  Payload ID: 1389
  Gene Symbol: ACTR2
  Gene Name: ARP2 actin-related protein 2 homolog (yeast)
  Uniprot ID: P61160
  ENST ID: ENST00000377982
  CDS Start-End: 74-1273
ggaagaagagaaaacggccgggcggcggtggctgtaggttgtgcggctgcagcggctcttccctgggcggacgatggacagccagggcaggaaggtggtggtgtgcgacaacggcaccgggtttgtgaagtgtggatatgcaggctctaactttccagaacacatcttcccagctttggttggaagacctattatcagatcaaccaccaaagtgggaaacattgaaatcaagaataacaaaaagatggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtaatgtttgaaacttaccagttttccggtgtatatgtagccatccaggcagttctgactttgtacgctcaaggtttattgactggtgtagtggtagactctggagatggtgtgactcacatttgcccagtatatgaaggcttttctctccctcatcttaccaggagactggatattgctgggagggatataactagatatcttatcaagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacactcccagatggacgtatcatcaaagttgggggagagagatttgaagcaccagaagctttatttcagcctcacttgatcaatgttgaaggagttggtgttgctgaattgctttttaacacaattcaggcagctgacattgataccagatctgaattctacaaacacattgtgctttctggagggtctactatgtatcctggcctgccatcacggttggaacgagaacttaaacagctttacttagaacgagttttgaagggtgatgtggaaaaactttctaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccgtcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctataggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcgaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgtttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatca

SEQ ID NO: 108880 - DNA, 1429 bp, Homo sapiens
  Payload ID: 1389
  Gene Symbol: ACTR2
  Gene Name: ARP2 actin-related protein 2 homolog (yeast)
  ENST ID: ENST00000542850
  CDS Start-End: 389-1408
gggtgggggcggcgggcgagaccggcactggacatggagcctactgaccgcccggcagggacctgctccgcgctaatgcgggggcaattgggctaaagcggacggaagcgtaaaaggctcggtttgtgtgttccgagaagggctcttttccccagggccaccggtttgtaaaaaggagaaagacctagaggccttcctcttcctgtatagttgaagatacaccaaacgagaagcaggaagcgggtttacttaaaaaaaaaaaaaaaaaaagtttgtgaagtgtggatatgcaggctctaactttccagaacacatcttcccagctttggttggaagacctattatcagatcaaccaccaaagtgggaaacattgaaatcaaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtaatgtttgaaacttaccagttttccggtgtatatgtagccatccaggcagttctgactttgtacgctcaaggtttattgactggtgtagtggtagactctggagatggtgtgactcacatttgcccagtatatgaaggcttttctctccctcatcttaccaggagactggatattgctgggagggatataactagatatcttatcaagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacactcccagatggacgtatcatcaaagttgggggagagagatttgaagcaccagaagctttatttcagcctcacttgatcaatgttgaaggagttggtgttgctgaattgctttttaacacaattcaggcagctgacattgataccagatctgaattctacaaacacattgtgctttctggagggtctactatgtatcctggcctgccatcacggttggaacgagaacttaaacagctttacttagaacgagttttgaagggtgatgtggaaaaactttctaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccgtc

SEQ ID NO: 108881 - DNA, 6718 bp, Homo sapiens
  Payload ID: 1390
  Gene Symbol: ACTR3
  Gene Name: ARP3 actin-related protein 3 homolog (yeast)
  Uniprot ID: P61158
  ENST ID: ENST00000263238
  CDS Start-End: 321-1577
atcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaagccaaaacctattgatgtacaagtcattacacaccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaagtgatgaaaataaattaaaactgaattaccttttctaatgttttttttttttaagtaatgtaattctattttgtttttatgtatgtgatatctgtttctgttgagatttgggagttattgaaatctctgtaatgtgtatggtagaaaatttcttgtgaccttaaaattttaccagttatttatagaaagagaaaatgggaaatgttttataggctttttactagcagtatcagtgaacacttgaactccattattcatgaaaataacacgttaggattggaatacgtctattcaaaagtgaaagaatataaagtgtttagttttttgtttttactctaaagatagaattggggagtaaacttcagtttttgtttagagtggatctgaatatttaaaatcctataataatttttgtgaatcttcattctttgagtatgggattgtaaaagacaaactatatcctacagtagtatcatcatcagtatcaaaggtctcctttttttacttggaaaagtaattcacaaacattataaaaatactattcaaacagtaccaaagagtagattagcaaaagtaagtttttttccctagcctgtctcatttttccatcattacacagactacttggaatgtcttagatgtccttgtattgtaattttctgtgtaggtagaaataaatgtagctttcttattttacacaaataggaacttactgtatatactgttctgcactttgcttttattaaagatcttttgataaagaactatattgataagcagtaaagatgtcatgctcctggcccaataaaatattgttagcattgtcataaatatgtcttttccaccggcgatggttgggtagttaagtgaataagctagaaagacatgtttataaagctatttgatgacaatctcaggcatatttatacagagatgttcttaactgtttgctacaaaaacatgaagatcaaaaactttcttgaagcttacgcttaacttatttggggaaacaaaactccagcccttcttgtgtatgttctgatatccctttgctctacttttagaggagtgaaccctaataggatggtagcagcattcttgtttctttatatctctcctctgtgattgtataccgttttttcaacttaaagcaacttcagctggaaatatgtagaggttggccaaggtgaactaaatagtctgtaacattgattagatatcaagcaacgtgagcatggtagcaaaagcactaactgaagccagtgatttaatttttaattctgattctgataattgatgatatagctcctcgaactttgttttttgttaaaacttggaaaatatatttgtattattttggacaaattatttgaactctctggaccttgattcaatttatatataaggtaaaggcattatactggattatcctgcaatttctttgagttgttagaatataatgtagcttattaatagcaatattagcagtgtagtagattctgactgcaaaacctagccttttctattgattcattagtggtagtaaaggtattatctgatttatcctttttaataggcagtgctttgatcaagtgggaaatagtaatggacaaataaaatcaatgatcattatctaacttgatgcctgcttttcaaaaagtgagcaaatttcacatcttcacccttagacattaattcatggcacctactataagtactcatcctcttcttacctatcttcttttctataggagataaagtggttattcagaccccccaatacaattttttggtttgttttcacagctacttaaaagattaaaataactattcttgcagatatttctaggaatatttttagaaataatatgaaatacagggataataggccaattatgatctttatttttaatttctacagaaaagtactagagaatatatctatagaaacttctttcagataaccctaaagatgatactagaatgtttataaaattattgagaagattatttgtgttataaagcttatttgtaccatagtaaaggatgtttttgttcctcttcattctgggctaatctgtcaatactgaagtccagtcttttcccccttttcttaccagctcaaccttgattcctgtgacccattctttctgatctttcgtagttcatagtcaccaggcatgagtaccttggatagccctctgaagtctgttaccacccagatttccaactcgggttaattggtactaattctattagctggtataaataatccaaaatctgtgcagactctgggagcaaaatgttctactcagtttggaatactgtgccttaaaatatatttcattgtaacagcaccttgtatatatagttggccaaggacagagttgttacaagttacgtggaactttcatagcaaatcttgacagtaaataccttgttcttgtattaggtctatatcctgaattgacctttagcaagaatctttagatctgctggagggctgggatggcttttggacttcagtgaaaaagaatttctgctactcattgttgataacgcttcagtactgtataaatgtttatccttttccacgtaatttgttttctatgatatgagaacttttattataatttgcctcagtcttgatagaatcttaacaaaaataaaatctgtggtcgtctgaggtattctccatgctataacccagtttagctgatgcatttggagcttgggtgctgaaattaaatataacctatttgagttaaggatttattactagtgctccagtggtcacaggaacaataaaaaaggaacaacgatagaaatacgtgatctaggaaagaaggcaactgaaaaacctgaaagaaaaaaaatgaaagattaaaagtatacgatattctattttgatttagcaattacttgttttctagtgttctgtcaatttttggtgacttttataattacattaaaactaagatgctgaattaaaataaagtttctcttttattcaagcaccaacattcacttatattacctatatattgcatcaagttttgagccttcaatcccagaagcattgattgactgtctactgtggttcaagtactgtgcataaagatgaataaatattctgtccttggcttagtctaatagtaaaggcactcttagaggagggacaaatattttgcctagataagatttgagagatagtaagtgcggaatttctcttcataaaaatggtagtgttagttgtttagagggagaagtccagctatgtaaggtgaaagtggggcttataaaagtggatctattgtttaaaaattagtactttgctcctaaaatttttacctaagtgttacatccaacaacagatgaaagtaattcgacagtagcatctgctttattcatttcatatttccagtgcctgacatattgcttggcatatagtagtttagtggatgtgtttgatgaatgaatgagtaaaaattatttttcatgttaaaataaaactttgaattacatgagtatacaacttttgttccttcaaaatacccatatttgtcaaatatgaccgaattacgactttttttctgttccactagtttctaccttagaagtgacattctgcgtaaggtagtgggggattactaagtgatcatgacttttctgaagcaggtcttaaataattatctaagccttcagtcatttcaaaatctctgtagtgtaaatgatcacaggctctaaatcagattgttgtacaaggtaattgacatgtcctgaaatgtaacattcaacattaacagtagaaacaggcctcatttctccctctggcttttattgatcaattttgatattgtccagatcccatgttaaaccacttgatttagagatgacttaattctaaacttcctccatttttaattaataagattcaaggttgcagtaaattgttaatcttatttggaattatattagaaagtcgatatcggaattggaaccacacatctttttcttattgtgggtacatgggat

SEQ ID NO: 108882 - DNA, 818 bp, Homo sapiens
  Payload ID: 1390
  Gene Symbol: ACTR3
  Gene Name: ARP3 actin-related protein 3 homolog (yeast)
  ENST ID: ENST00000446821
  CDS Start-End: 183-308
gtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttccttggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaa

SEQ ID NO: 108883 - DNA, 566 bp, Homo sapiens
  Payload ID: 1390
  Gene Symbol: ACTR3
  Gene Name: ARP3 actin-related protein 3 homolog (yeast)
  ENST ID: ENST00000443297
  CDS Start-End: 315-566
agggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaat

SEQ ID NO: 108884 - DNA, 676 bp, Homo sapiens
  Payload ID: 1390
  Gene Symbol: ACTR3
  Gene Name: ARP3 actin-related protein 3 homolog (yeast)
  ENST ID: ENST00000415792
  CDS Start-End: 188-292
cggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttcctactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggtaaaaagtgtgataggagtgtaatttagttaaaaattaaa

SEQ ID NO: 108885 - DNA, 1530 bp, Homo sapiens
  Payload ID: 1390
  Gene Symbol: ACTR3
  Gene Name: ARP3 actin-related protein 3 homolog (yeast)
  ENST ID: ENST00000535589
  CDS Start-End: 291-1394
actacggtgggcagcgccgcccaaagggcgctggggacggtcgtcttgggggtggtccccgggcccgacccatccggctttcctttccctccgcgcccgtttttgccagtcggtttggggacccaggggccgagctcggggactggcctggcaggggagctagaaaagagaagcgctcctggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaagccaaaacctattgatgtacaagtcattacacaccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaa

SEQ ID NO: 108886 - DNA, 2216 bp, Homo sapiens
  Payload ID: 1391
  Gene Symbol: ACTR3B
  Gene Name: ARP3 actin-related protein 3 homolog B (yeast)
  Uniprot ID: Q9P1U1
  ENST ID: ENST00000256001
  CDS Start-End: 135-1391
agcatccgggctcccggcagcggcgctgcggcggctcgcgggagacgctgcgcgcggggctagcgggcggcggagcggacggcgacggggcgctctcgggctgccggcggggccgagcgccgcgcgtcccgagcatggcaggctccctgcctccctgcgtggtggactgtggcaccgggtataccaagcttggctacgcaggcaacactgagccccagttcattattccttcatgtattgccatcagagagtcagcaaaggtagttgaccaagctcaaaggagagtgttgaggggagttgatgaccttgactttttcataggagatgaagccatcgataaacctacatatgctacaaagtggccgatacgacatggaatcattgaagactgggatcttatggaaaggttcatggagcaagtggtttttaaatatcttcgagctgaacctgaggaccattattttttaatgacagaacctccactcaatacaccagaaaacagagagtatcttgcagaaattatgtttgaatcatttaacgtaccaggactctacattgcagttcaggcagtgctggccttggcggcatcttggacatctcgacaagtgggtgaacgtacgttaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaagtatgatgtggatccccggaagtggatcaaacagtacacgggtatcaatgcgatcaaccagaagaagtttgttatagacgttggttacgaaagattcctgggacctgaaatattctttcacccggagtttgccaacccagactttatggagtccatctcagatgttgttgatgaagtaatacagaactgccccatcgatgtgcggcgcccgctgtataagaatgtcgtactctcaggaggctccaccatgttcagggatttcggacgccgactgcagagggatttgaagagagtggtggatgctaggctgaggctcagcgaggagctcagcggcgggaggatcaagccgaagcctgtggaggtccaggtggtcacgcatcacatgcagcgctacgccgtgtggttcggaggctccatgctggcctcgactcccgagttctttcaggtctgccacaccaagaaggactatgaagagtacgggcccagcatctgccgccacaaccccgtctttggagtcatgtcctagtgtctgcctgaacgcgtcgttcgatggtgtcacgttggggaacaagtgtccttcagaacccagagaaggccgccgttctgtaaatagcgacgtcggtgttgctgcccagcagcgtgcttgcattgccggtgcatgaggcgcggcgcgggcccttcagtaaaagccatttatccgtgtgccgaccgctgtctgccagcctcctccttctcccgccctcctcaccctcgctctccctcctcctcctcctccgagctgctagctgacaaatacaattctgaaggaatccaaatgtgactttgaaaattgttagagaaaacaacattagaaaatggcgcaaaatcgttaggtcccaggagagaatgtgggggcgcaaacccttttcctcccagcctatttttgtaaataaaatgtttaaacttgaaatacaaatcgatgtttatatttcctatcattttgtattttatggtatttggtacaactggctgatactaagcacgaatagatattgatgttatggagtgctgtaatccaaagtttttaattgtgaggcatgttctgatatgtttataggcaaacaaataaaacagcaaacttttttgccacatgtttgctagaaaatgattatactttattggagtgacatgaagtttgaacactaaacagtaatgtatgagaattactacagatacatgtatcttttagttttttttgtttgaactttctggagctgttttatagaagatgatggtttgttgtcggtgagtgttggatgaaatacttccttgcaccattgtaataaaagctgttagaatatttgtaaatatc

SEQ ID NO: 108887 - DNA, 1566 bp, Homo sapiens
  Payload ID: 1391
  Gene Symbol: ACTR3B
  Gene Name: ARP3 actin-related protein 3 homolog B (yeast)
  Uniprot ID: Q9P1U1
  ENST ID: ENST00000377776
  CDS Start-End: 135-1181
agcatccgggctcccggcagcggcgctgcggcggctcgcgggagacgctgcgcgcggggctagcgggcggcggagcggacggcgacggggcgctctcgggctgccggcggggccgagcgccgcgcgtcccgagcatggcaggctccctgcctccctgcgtggtggactgtggcaccgggtataccaagcttggctacgcaggcaacactgagccccagttcattattccttcatgtattgccatcagagagtcagcaaaggtagttgaccaagctcaaaggagagtgttgaggggagttgatgaccttgactttttcataggagatgaagccatcgataaacctacatatgctacaaagtggccgatacgacatggaatcattgaagactgggatcttatggaaaggttcatggagcaagtggtttttaaatatcttcgagctgaacctgaggaccattattttttaatgacagaacctccactcaatacaccagaaaacagagagtatcttgcagaaattatgtttgaatcatttaacgtaccaggactctacattgcagttcaggcagtgctggccttggcggcatcttggacatctcgacaagtgggtgaacgtacgttaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaagtatgatgtggatccccggaagtggatcaaacagtacacgggtatcaatgcgatcaaccagaagaagtttgttatagacgttggttacgaaagattcctgggacctgaaatattctttcacccggagtttgccaacccagactttatggagtccatctcagatgttgttgatgaagtaatacagaactgccccatcgatgtgcggcgcccgctgtataagcccgagttctttcaggtctgccacaccaagaaggactatgaagagtacgggcccagcatctgccgccacaaccccgtctttggagtcatgtcctagtgtctgcctgaacgcgtcgttcgatggtgtcacgttggggaacaagtgtccttcagaacccagagaaggccgccgttctgtaaatagcgacgtcggtgttgctgcccagcagcgtgcttgcattgccggtgcatgaggcgcggcgcgggcccttcagtaaaagccatttatccgtgtgccgaccgctgtctgccagcctcctccttctcccgccctcctcaccctcgctctccctcctcctcctcctccgagctgctagctgacaaatacaattctgaaggaatccaaatgtgactttgaaaattgttagagaaaacaacattagaaaatggcgcaaaatcgttaggtcccaggagagaatgtgggggcgcaaacccttttcctc

SEQ ID NO: 108888 - DNA, 1692 bp, Homo sapiens
  Payload ID: 1391
  Gene Symbol: ACTR3B
  Gene Name: ARP3 actin-related protein 3 homolog B (yeast)
  Uniprot ID: Q9P1U1
  ENST ID: ENST00000397282
  CDS Start-End: 304-1296
gggagacgctgcgcgcggggctagcgggcggcggagcggacggcgacggggcgctctcgggctgccggcggggccgagcgccgcgcgtcccgagcatggcaggctccctgcctccctgcgtggtggactgtggcaccgggtattgccatcagagagtcagcaaaggtagttgaccaagctcaaaggagagtgttgaggggagttgatgaccttgactttttcataggagatgaagccatcgataaacctacatatgctacaaagtggccgatacgacatggaatcattgaagactgggatcttatggaaaggttcatggagcaagtggtttttaaatatcttcgagctgaacctgaggaccattattttttaatgacagaacctccactcaatacaccagaaaacagagagtatcttgcagaaattatgtttgaatcatttaacgtaccaggactctacattgcagttcaggcagtgctggccttggcggcatcttggacatctcgacaagtgggtgaacgtacgttaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaagtatgatgtggatccccggaagtggatcaaacagtacacgggtatcaatgcgatcaaccagaagaagtttgttatagacgttggttacgaaagattcctgggacctgaaatattctttcacccggagtttgccaacccagactttatggagtccatctcagatgttgttgatgaagtaatacagaactgccccatcgatgtgcggcgcccgctgtataagaatgtcgtactctcaggaggctccaccatgttcagggatttcggacgccgactgcagagggatttgaagagagtggtggatgctaggctgaggctcagcgaggagctcagcggcgggaggatcaagccgaagcctgtggaggtccaggtggtcacgcatcacatgcagcgctacgccgtgtggttcggaggctccatgctggcctcgactcccgagttctttcaggtctgccacaccaagaaggactatgaagagtacgggcccagcatctgccgccacaaccccgtctttggagtcatgtcctagtgtctgcctgaacgcgtcgttcgatggtgtcacgttggggaacaagtgtccttcagaacccagagaaggccgccgttctgtaaatagcgacgtcggtgttgctgcccagcagcgtgcttgcattgccggtgcatgaggcgcggcgcgggcccttcagtaaaagccatttatccgtgtgccgaccgctgtctgccagcctcctccttctcccgccctcctcaccctcgctctccctcctcctcctcctccgagctgctagctgacaaatacaattctgaaggaatccaaatgtgactttgaaaattgttagagaaaacaacattagaaaatggcgcaaaatcgttaggtcccaggagagaatgtgggggcgcaaacccttttcctcccagcctattt

SEQ ID NO: 108889 - DNA, 1218 bp, Homo sapiens
  Payload ID: 1392
  Gene Symbol: ACTR3C
  Gene Name: ARP3 actin-related protein 3 homolog C (yeast)
  Uniprot ID: Q9C0K3
  ENST ID: ENST00000252071
  CDS Start-End: 191-823
gagagattcagctgctttcacaactctggctggattttacctatgtggagagtgtcacccatgttagggagcctctggccaggaggaagctgtggcaagatgtgctgcgtctcctgcttggcattgccatcttgctgccacagaacctccactcaatacaccagaaaacagagagtatcttgcagaaattatgttcgaatcatttaacgttccaggactctacattgcagttcaggcagtgctggccttggcggcatcttggacatctcgacaagtgggtgaacgtacattaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaagtatgatgtggatccccagaagtggatcaaacagtacacgggtatcaatgcgatcaaccagaagaagtttgttatagacgttggttacgaaagattcctgggacctgaaatattctttcacccggagtttgccaacccagactctatggagtccatctcagatgttgttgatgaagtaatacagaactgccccatcgatgtgcggcgtccgctgtataagatggaacaaattccactgagctatcctcaaggtcacggattccatcctctgtcacctccatttcattgagatgatatattgagcccatgcgtagccttttatttgagatttccaaggccagcaatgttctcttcctctcccttttctttgtataaaaattcattctcaagaaaaactctcatatcaattgtttacatgtcactatggctaagacactaaaagccctctccctgcaaaactggtggcaaagctctctagagaaccacaaactgttgcatccttactacgtggggcagcagcaagcccaggtgaagatgtgcatgttcttggagaaagtattaataacataccgacacttacatctgggtgaataatttcatcaaatctcttaactcacgcttgcacaaacttcacctggagagagagagggaaagctgtgccagaaataaatggttattgaggtc

SEQ ID NO: 108890 - DNA, 5697 bp, Homo sapiens
  Payload ID: 1392
  Gene Symbol: ACTR3C
  Gene Name: ARP3 actin-related protein 3 homolog C (yeast)
  ENST ID: ENST00000478393
  CDS Start-End: 1-627
agtccccgcttacctgaggggtggagccggcagcctgcggagccactggccaagctgggaagtccggcgcaactccgcaccgcagagccggcgcctcctcggcagacagaacctccactcaatacaccagaaaacagagagtatcttgcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaagtatgatgtggatccccagaagtggatcaaacagtacacgggtatcaatgcgatcaaccagaagaagtttgttatagacgttggttacgaaagattcctgggacctgaaatattctttcacccggagtttgccaacccagactctatggagtccatctcagatgttgttgatgaagtaatacagaactgccccatcgatgtgcggcgtccgctgtataagatggaacaaattccactgagctatcctcaaggtcacggattccatcctctgtcacctccatttcattgagatgatatattgagcccatgcgtagccttttatttgaggtattctcatgattttcatttttaattctaggctctacttttgctgaaattttctatttttttcatttgtttcaagagaacccataattgcttattgaagcatttttatgacaattattctaaaattctttgcaggtaatcccagcacctgagtcatctttatgttggagtctcaatcgactcttcattcatttgtgatttttctggttcttgctatgataagtggttttttattgtattctggacattttgataagattgtgaatcctatttactttttttttttttgagacggagtctagctctatctccaggctggagtgcagtggtgcgatctcagctcactgcaacctctgcctcctgggttcaatcgattctcctgccacagcctcctgagtagctgggattgcaaacatgcgccaccacacccagctcatttttgtatttttagtagagatggggtttcaccatgttggccaggatgttctcgatctcctgatctcgtgatctgcccacctcggcctcccaaagtgttgggattacaggtgcgagccaccgcacccggcctactcttttttttttttaatagccagcttctctgttgagatgtagcaccagggctgtgtatctgttcagtctcctttgggcccagggccagtacgggagggaagggagagcagaacgcggaccactctaccttgagttgcctcattctgtatcatcgatgcctggtggaagtgggcttactctgcatcctgctgacaccgcagagaaactggagcccatggcctgcttccctgggacaggagctagggtggaaaatcagcttccagcttggccctgctgaaaccctggcaggggcaggttccattgtagtttggctggaatcgagcaggtattgccaacagcatcgtctattgttggagtacctttgccccagatcctgagatggggtaatttttaaagaaaagaggttcaattggctcacaagcctgaaggctgtaccagcatggtgcccagcttctggggagggctcagggagctttgactcacagaggaaggtgaagtgggagcaggcacttcacatggcaaaagcaagaacaaaagagtgggaggcagttgccacacacttctacatgaccagatctcttgtgaactcagagctcactcatcacccaagagatggcccacgccatccatgaggaatgcactcccatgatataaacacccccaccaggccccgcctccaagagtggagattacagttcaacacgagatttggtgggggcatatcaaaactacattaaccttaaattatgaagacggtaaactaaataatctgctttctttcctttcctgttttgtgtctgtttttcagatttccaaggccagcaatgttctcttcctctcccttttctttgtataaaaattcattctcaagaaaaactctcatatcaattgtttacatgtcactatggctaagacactaaaagccctctccctgcaaaactggtggcaaagctctctagagaaccacaaactgttgcatccttactacgtggggcagcagcaagcccaggtgaagatgtgcatgttcttggagaaagtattaataacataccgacacttacatctgggtgaataatttcatcaaatctcttaactcacgcttgcacaaacttcacctggagagagagagggaaagctgtgccagaaataaatggttattgaggtcactgtttgtttgtttttctcaggagtggaaggagattaaccagggtggcaataaacaaaattacttgctgttttaaaacttaatgacaaccctataggttattagcaatgccaaagttgcagggtgcggtggctcacgcctgtaatcccagcactttgggaggccgaggcgggcagatcatctgaggtcgggagttcgagaccagcctgaccaacatggagaaaccccgtctttactaaaaatacaaaaaaaattaaccgggtgtggtggtgcatacctgtaaccccagctactcaagaagtggaggcgggagaattgcttgaacacaggaggcggaggttgcgatgagccgagatcacgccattgtactccagcctgggcagcaagagtgaaactcagtctcaaaaaatacaaaacaaaacaaaacaaaaagccaaagtggaaaagcaaaaattttgtggtatttgcattcaattattatgctttaattcaaccattcacaatttctagggaacattaactttattgcaatcccaggtaaatttaggataatttaacaataatcgttggtgttctactcatctacttgtctttaaaatccacatatattttttaaaagatgacatcctttaaaaatattatattcagtgaattttcaatattattttaaatattatcatggacagttgttattggaaatgacagttcaccattgcaaatcaatgcagtggctacaagtcccccgtgtcacacaaaaatagacggggtagctctgacagcatgcatccttatgccctgttctattaatgatgcactgcaccccatcagggtctgcagctgtatcattactcacagagacggttctgcctttggctttccctggtcctccatggctaggaacatcatttaacagggttttgtagaattcactgggtggttagtcttagaaaacccaaggcagaaacacacagccaactatcccccaagtgcttgtgcttgaactttcagaacataagaaaattgtgttaagctggatctgcaagtacaaatggagagtgaaatgggttctatagaatccaaatgacacaatctttcctcctgctaagaattactggctattgaaccaattcctgcctattaactgtgaggtgaagtccaagatccacagtcaagcattcaaagatccaacctgatttttctctgcataactgttttactaggagtaagactgacttgcctggtttaccaagacaggctgtgagaattcttcccacttacctttactgagtcaatgtggacagtttgaaataacttgaaccattcttcttacatttttaaatcctacacaagcctcaaaacaaaatccaagtcacttttcctctgtgggatcttcactgagccccccagcaggcattcctcttgctatctcctgtgcgaatagctctgaaggtctgtattgcaaatatgacagtcaacacaccggctaaggtagaacaaaaagtggcattattaagctgaaaaaagcccggaccaaaatgaaagattcttattgtgggagcaattgctcacactcaccaatagctgcttgtttccttcttgggcacacagaaattacaattcccaactttcctgcagttggatagagccatgtgagtaattccagcctggggactctgactagagatgaaaatcccctccatggtggagcaaaatcccctgagtggccctccggccttctgttctccagctgtgctaacctggaagccacacattgagatgacagagcagcaaagtggagacaggccatgtctctgagtcaccatgtgacccacaggagattttgagtaaattaaaatacaaatctttgtcataataaaccacagatatttcagcaatgatttgcaaccatagcgtaagataacctatcatggctaatgctcctaggttctcaacctgtatccaccagtaactaggtagcttgggcaaattatcttctatgcaacctctggttgataatgaattccttttataagtaagagaatgagctggaacccaaatgtgtacagaggaaatctgaatgaagtgggaagggtaagatgcagagtgagtggagacttcactcattgttgaaagagggcagttgctactcggttattactgatgcttacatgaagaaatccagttttaatataaccacatcttgccatttctcaagggaagtcatgtactatctgtgtgtctgtccttcatatagctccatcaatattctcctcttaaatcttggagactgtgctggatgttttccaaatgtctctcctgatccagcctgcagtcttctctaccctggtttgggtatctggagccagacctgtatgtactgcatcagcaggttctcttcccttcgctttctgcatggtttccaccaccatgaggtcctggtgggagatcagaggctgggaagagcagaggctgggaagagcagaggcaggagaggcactgcataactcctctcaggccgtcctctctctctggctctctgtaggtttgggcaactgctccttccatccatatattcaggctgaggtgtggaaaaggctcccaaatggcattagctccagagtgatgcaccttccatatccttttattttcattatttctcctcctttgaagaagttgagtatttttgcaagaacattgactaacaggaactaatcaattattcttaaatttaaaaaattgaatgaatcaaatgttcaacaaaggatacacacacagactgaatgacaactaagttattttacagttccacaaacctagagagatctatcaatgaatggggtattacattctaatatttctaagactatattgaatattgaatattcaatattctaagactatattgaatattcaatattctaagactatattgaatattcaatattctaagactatattgaatattcaatattctaagactatattgaatattcaatattctaagactatattgaatattcaatattctaagactatattgaatattcaatattctaagactatattgaatattcaatattctaagactatattgaatattcaatattctaagactatattgaatattcaatattctaagactatactgaatactgaatgactacatcacctacaagaatacaatgagagtactaaactaacactcagtactaaacatttgtcctacactcagaggtaggcaccaggttctggtgtcaatgtatgatatgcctgtctctaaataaacattttatcaga

SEQ ID NO: 108891 - DNA, 502 bp, Homo sapiens
  Payload ID: 1392
  Gene Symbol: ACTR3C
  Gene Name: ARP3 actin-related protein 3 homolog C (yeast)
  ENST ID: ENST00000477367
  CDS Start-End: 350-502
agcgaaggggccgtgaggtcaacagtcggtaatcgtttatcggtgcggccttagagaaaggacctccaagcccttgttcaatacatgttgggtggtggtcacaggtgccagtctccggacggatggcggcctagatttcctcccggactcggtggcacccaaggccccctgcacgccggcgctgtgcgtgccaggctgaccgcccgagtgcgacccggacctcgtccgcacgtgcagatggaaggggccacaaagacgataaggatccaggtctcccgcgtggaaggctcatctatcgacagaacctccactcaatacaccagaaaacagagagtatcttgcagaaattatgttcgaatcatttaacgttccaggactctacattgcagttcaggcagtgctggccttggcggcatcttggacatctcgacaagtgggtgaacgtacattaacggggatagtcattgacagcggagatggagtcacccatgttatcccagtg

SEQ ID NO: 108892 - DNA, 678 bp, Homo sapiens
  Payload ID: 1392
  Gene Symbol: ACTR3C
  Gene Name: ARP3 actin-related protein 3 homolog C (yeast)
  ENST ID: ENST00000477871
  CDS Start-End: 12-678
cagagggagagatgggtaagggctggctgttccggaagattctggcctctcccagtgtgtttcggcgcgagggcaccgctggcccagcaggtggccccccggggccggcacgggccccgacagccgcccccttccctgaacctcggcggcccagtccccgcttacctgaggggtggagccggcagcctgcggagccactggccaagctgggaagtccggcgcaactccgcaccgcagagccggcgcctcctcggcagacagaacctccactcaatacaccagaaaacagagagtatcttgcagaaattatgttcgaatcatttaacgttccaggactctacattgcagttcaggcagtgctggccttggcggcatcttggacatctcgacaagtgggtgaacgtacattaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaagtatgatgtggatccccagaagtgga

SEQ ID NO: 108893 - DNA, 570 bp, Homo sapiens
  Payload ID: 1392
  Gene Symbol: ACTR3C
  Gene Name: ARP3 actin-related protein 3 homolog C (yeast)
  ENST ID: ENST00000539352
  CDS Start-End: 1-570
atgttcgaatcatttaacgttccaggactctacattgcagttcaggcagtgctggccttggcggcatcttggacatctcgacaagtgggtgaacgtacattaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaagtatgatgtggatccccagaagtggatcaaacagtacacgggtatcaatgcgatcaaccagaagaagtttgttatagacgttggttacgaaagattcctgggacctgaaatattctttcacccggagtttgccaacccagactctatggagtccatctcagatgttgttgatgaagtaatacagaactgccccatcgatgtgcggcgtccgctgtataaggtatga

SEQ ID NO: 108894 - DNA, 5142 bp, Homo sapiens
  Payload ID: 1392
  Gene Symbol: ACTR3C
  Gene Name: ARP3 actin-related protein 3 homolog C (yeast)
  ENST ID: ENST00000613959
  CDS Start-End: 1-75
tttcagatggaacaaattccactgagctatcctcaaggtcacggattccatcctctgtcacctccatttcattgagatgatatattgagcccatgcgtagccttttatttgaggtattctcatgattttcatttttaattctaggctctacttttgctgaaattttctatttttttcatttgtttcaagagaacccataattgcttattgaagcatttttatgacaattattctaaaattctttgcaggtaatcccagcacctgagtcatctttatgttggagtctcaatcgactcttcattcatttgtgatttttctggttcttgctatgataagtggttttttattgtattctggacattttgataagattgtgaatcctatttactttttttttttttgagacggagtctagctctatctccaggctggagtgcagtggtgcgatctcagctcactgcaacctctgcctcctgggttcaatcgattctcctgccacagcctcctgagtagctgggattgcaaacatgcgccaccacacccagctcatttttgtatttttagtagagatggggtttcaccatgttggccaggatgttctcgatctcctgatctcgtgatctgcccacctcggcctcccaaagtgttgggattacaggtgcgagccaccgcacccggcctactcttttttttttttaatagccagcttctctgttgagatgtagcaccagggctgtgtatctgttcagtctcctttgggcccagggccagtacgggagggaagggagagcagaacgcggaccactctaccttgagttgcctcattctgtatcatcgatgcctggtggaagtgggcttactctgcatcctgctgacaccgcagagaaactggagcccatggcctgcttccctgggacaggagctagggtggaaaatcagcttccagcttggccctgctgaaaccctggcaggggcaggttccattgtagtttggctggaatcgagcaggtattgccaacagcatcgtctattgttggagtacctttgccccagatcctgagatggggtaatttttaaagaaaagaggttcaattggctcacaagcctgaaggctgtaccagcatggtgcccagcttctggggagggctcagggagctttgactcacagaggaaggtgaagtgggagcaggcacttcacatggcaaaagcaagaacaaaagagtgggaggcagttgccacacacttctacatgaccagatctcttgtgaactcagagctcactcatcacccaagagatggcccacgccatccatgaggaatgcactcccatgatataaacacccccaccaggccccgcctccaagagtggagattacagttcaacacgagatttggtgggggcatatcaaaactacattaaccttaaattatgaagacggtaaactaaataatctgctttctttcctttcctgttttgtgtctgtttttcagatttccaaggccagcaatgttctcttcctctcccttttctttgtataaaaattcattctcaagaaaaactctcatatcaattgtttacatgtcactatggctaagacactaaaagccctctccctgcaaaactggtggcaaagctctctagagaaccacaaactgttgcatccttactacgtggggcagcagcaagcccaggtgaagatgtgcatgttcttggagaaagtattaataacataccgacacttacatctgggtgaataatttcatcaaatctcttaactcacgcttgcacaaacttcacctggagagagagagggaaagctgtgccagaaataaatggttattgaggtcactgtttgtttgtttttctcaggagtggaaggagattaaccagggtggcaataaacaaaattacttgctgttttaaaacttaatgacaaccctataggttattagcaatgccaaagttgcagggtgcggtggctcacgcctgtaatcccagcactttgggaggccgaggcgggcagatcatctgaggtcgggagttcgagaccagcctgaccaacatggagaaaccccgtctttactaaaaatacaaaaaaaattaaccgggtgtggtggtgcatacctgtaaccccagctactcaagaagtggaggcgggagaattgcttgaacacaggaggcggaggttgcgatgagccgagatcacgccattgtactccagcctgggcagcaagagtgaaactcagtctcaaaaaatacaaaacaaaacaaaacaaaaagccaaagtggaaaagcaaaaattttgtggtatttgcattcaattattatgctttaattcaaccattcacaatttctagggaacattaactttattgcaatcccaggtaaatttaggataatttaacaataatcgttggtgttctactcatctacttgtctttaaaatccacatatattttttaaaagatgacatcctttaaaaatattatattcagtgaattttcaatattattttaaatattatcatggacagttgttattggaaatgacagttcaccattgcaaatcaatgcagtggctacaagtcccccgtgtcacacaaaaatagacggggtagctctgacagcatgcatccttatgccctgttctattaatgatgcactgcaccccatcagggtctgcagctgtatcattactcacagagacggttctgcctttggctttccctggtcctccatggctaggaacatcatttaacagggttttgtagaattcactgggtggttagtcttagaaaacccaaggcagaaacacacagccaactatcccccaagtgcttgtgcttgaactttcagaacataagaaaattgtgttaagctggatctgcaagtacaaatggagagtgaaatgggttctatagaatccaaatgacacaatctttcctcctgctaagaattactggctattgaaccaattcctgcctattaactgtgaggtgaagtccaagatccacagtcaagcattcaaagatccaacctgatttttctctgcataactgttttactaggagtaagactgacttgcctggtttaccaagacaggctgtgagaattcttcccacttacctttactgagtcaatgtggacagtttgaaataacttgaaccattcttcttacatttttaaatcctacacaagcctcaaaacaaaatccaagtcacttttcctctgtgggatcttcactgagccccccagcaggcattcctcttgctatctcctgtgcgaatagctctgaaggtctgtattgcaaatatgacagtcaacacaccggctaaggtagaacaaaaagtggcattattaagctgaaaaaagcccggaccaaaatgaaagattcttattgtgggagcaattgctcacactcaccaatagctgcttgtttccttcttgggcacacagaaattacaattcccaactttcctgcagttggatagagccatgtgagtaattccagcctggggactctgactagagatgaaaatcccctccatggtggagcaaaatcccctgagtggccctccggccttctgttctccagctgtgctaacctggaagccacacattgagatgacagagcagcaaagtggagacaggccatgtctctgagtcaccatgtgacccacaggagattttgagtaaattaaaatacaaatctttgtcataataaaccacagatatttcagcaatgatttgcaaccatagcgtaagataacctatcatggctaatgctcctaggttctcaacctgtatccaccagtaactaggtagcttgggcaaattatcttctatgcaacctctggttgataatgaattccttttataagtaagagaatgagctggaacccaaatgtgtacagaggaaatctgaatgaagtgggaagggtaagatgcagagtgagtggagacttcactcattgttgaaagagggcagttgctactcggttattactgatgcttacatgaagaaatccagttttaatataaccacatcttgccatttctcaagggaagtcatgtactatctgtgtgtctgtccttcatatagctccatcaatattctcctcttaaatcttggagactgtgctggatgttttccaaatgtctctcctgatccagcctgcagtcttctctaccctggtttgggtatctggagccagacctgtatgtactgcatcagcaggttctcttcccttcgctttctgcatggtttccaccaccatgaggtcctggtgggagatcagaggctgggaagagcagaggctgggaagagcagaggcaggagaggcactgcataactcctctcaggccgtcctctctctctggctctctgtaggtttgggcaactgctccttccatccatatattcaggctgaggtgtggaaaaggctcccaaatggcattagctccagagtgatgcaccttccatatccttttattttcattatttctcctcctttgaagaagttgagtatttttgcaagaacattgactaacaggaactaatcaattattcttaaatttaaaaaattgaatgaatcaaatgttcaacaaaggatacacacacagactgaatgacaactaagttattttacagttccacaaacctagagagatctatcaatgaatggggtattacattctaatatttctaagactatattgaatattgaatattcaatattctaagactatattgaatattcaatattctaagactatattgaatattcaatattctaagactatattgaatattcaatattctaagactatattgaatattcaatattctaagactatattgaatattcaatattctaagactatattgaatattcaatattctaagactatattgaatattcaatattctaagactatattgaatattcaatattctaagactatattgaatattcaatattctaagactatactgaatactgaatgactacatcacctacaagaatacaatgagagtactaaactaacactcagtactaaacatttgtcctacactcagaggtaggcaccaggttctggtgtcaatgtatgatatgcctgtctctaaataaacattttatc

SEQ ID NO: 108895 - DNA, 2565 bp, Homo sapiens
  Payload ID: 1393
  Gene Symbol: ACTR5
  Gene Name: ARP5 actin-related protein 5 homolog (yeast)
  Uniprot ID: Q9H9F9
  ENST ID: ENST00000243903
  CDS Start-End: 38-1861
actgcgccgaggggcggggctggacgcgcgctccaagatggcggcgaacgtgttcccgttccgcgacgcccgtgccgcaccggacccagtgctggaggccggcccggtggcacacgggccactgccggtaccgctggtgctggacaacgggtcgttccaagtccgcgctggctgggcgtgtcccgggcaggacccaggtcccgagccgcgcctgcagttccgcgcggtgtgcgcccgcggtcgtggcggggcacggggcgcgtcgggcccgcaggtggggaacgctctgggcagcctggagccactgcgctggatgctgcgctcgcccttcgaccgcaacgtgccggtcaacctggagcttcaggagttgctgctggactacagcttccagcacctgggtgtctcctcacagggctgtgttgatcatcccatagttttgacagaagctgtgtgcaacccactgtattcacggcaaatgatgtctgagcttctttttgagtgctacgggattcccaaggttgcctatggaatagacagcctcttcagcttctaccacaataagccaaagaactcgatgtgcagtgggctaatcatttcatctggataccagtgtacgcatgttttacccatcttagaagggagattagatgctaaaaactgcaagcgcatcaatcttggaggaagccaagcagctggttacctccagcgtctcctccagctgaagtaccctgggcacctggcagccatcaccctcagccgcatggaggagattctgcatgagcacagctacatcgctgaggattatgtggaagaattacacaaatggcggtgtcctgattattatgagaataatgtccacaagatgcagctcccattttccagcaagctcctgggcagcactctgacctctgaggagaaacaagaaaggcggcagcagcaattgcggcggctgcaggagctcaatgcccggcggcgggaggagaagctgcagctggatcaggagcgtctggaccgactgctatatgtgcaggaacttctagaggatggccagatggatcagtttcacaaagctctgatagagctgaatatggactccccagaagagctgcagtcctacatccagaagctcagtatagcagtggagcaggctaagcagaaaatcctccaagcggaagtcaacctcgaggtggatgtggtagacagcaagccagagacccctgacctggagcagctggagccgtctttggaagatgtggaaagcatgaatgattttgatcccttgttttcagaggaaacacctggagtggagaagccggtcaccactgttcagcccgtgtttaacttggcagcatatcatcagctatttgttgggacagaaagaattcgagctccagagattattttccagccatctctcataggagaagaacaggctgggattgcagagactcttcagtacattctggacaggtacccaaaggacattcaggaaatgctggttcagaacgttttcctcactggcggcaacacgatgtatcctggcatgaaagccagaatggagaaggaactgttggagatgagacccttccggtcttcttttcaggttcaacttgcctcgaaccctgtgctggatgcctggtacggtgctcgtgactgggccttgaaccacctagatgataatgaagtttggatcaccaggaaagagtatgaagaaaagggaggagagtacctcaaggagcactgtgcttccaacatctatgtccccatccgcctgccgaagcaggcctcccgctcctcagatgcccaggcatccagcaagggctccgctgctggtggaggtggtgctggtgagcaggcatagcagaggccctccagagagactgccctgcacgccatgccttgggccacgttggcagtgtgacaggactgtgattgtgctagatgtacctgcccaagtctgctggtcacatttggcagcaaaatggatttctcctggggagaacaaagttaagggacactgagacctgcccttcagaattcggttcacttgggggcttctgtggtagagactaactggccttctgatgtctttgttcaactgtggccagctgtggcatcagcttcctggagcagtaaatgaagacagagtggaggacacaaatgtacaaaatgcacaagactgatttcttaccacattttagtctttcttgttttaaaaaaaattctttaaaatttatcttgtccgtgtagatactttattcttctggatgtattcagaaattgcatgaatgcccagtgaggggaggtctttcatgcatataaaaaggtaatgtttattgccgggcacagtggcacgtgcctgttaaggcccagctttgtgggaggctaaggcaggaggatcgctggagcttaggagttcgaggctatcgtgtgctgtgatcgcacctgtgaataaccactgcactccagcctgggcaacataggaagacattgtctctaaaaagatacatttttcataaaaggtaatgtttattcaataaaagcagttgcctcaggaaccggaaa

SEQ ID NO: 108896 - DNA, 2464 bp, Homo sapiens
  Payload ID: 1394
  Gene Symbol: ACTR6
  Gene Name: ARP6 actin-related protein 6 homolog (yeast)
  Uniprot ID: Q9GZN1
  ENST ID: ENST00000188312
  CDS Start-End: 766-1956
ctcgctctgtcgcccaggctggagtgtagtggagccatctcggctcactgcaacctccgcctccccggttcaagcaattctcccgcctcagcctcccgagtacttgggattacaggcgcccgccacctcgcccggctactttttgtatttttaatagagacggggtttcgccgtgttggtcaggctggtctcaagctcctgacctcaagtgatctgcttgccttggtctcctaaagtgctgggattacaggcgtgagccaccgcgtccggcccaaaagccttttttggatgagaaagactcactcagcttcgtcctgaagagcaagtgggctggggaagaggagagtatgaatgtgagtccaagagcaagttttgcacttttttcttcaaagaatgtcaccgtctgaagaatgcgattggaagacacacacacacacacacacacacacacacacgcagccggttctctacaggattagaaaaaacttgcgcgaattaatctgcgtagttaaaaacaaatacgaaatgagcgagaaagcacatagtagtcaaatctcgccaccacataaacaggttaagtttggaagcacagcccctaacattcggtgctgcttagcatctccgacttccggcgtcctccgttgctaaggtgaccagaggcgcgtcctaacgctccgcccaacaaaccatagagtaccggaaaaagctcgagcagaggggtcggaaagggaaaacaactacggctgcggtgtggttggtggtgagatgacgaccttagtgctggataatggagcttacaacgccaaaatcggttacagccatgaaaatgtgtcggttattcctaattgtcagttccggtcaaaaacagcacgtcttaaaacttttactgccaaccagatagatgaaataaaagacccttctggactcttttacatcctcccttttcaaaagggctacttggtgaattgggatgttcagagacaagtttgggattacctttttggaaaagaaatgtatcaggttgattttttagatactaatattattatcactgaaccatactttaacttcacttcaattcaagaatcaatgaatgaaattctatttgaagaataccagtttcaagcagtattaagagtaaatgctggggctctcagtgcacataggtatttccgagataatccttccgaattatgctgtatcattgttgatagtggatattcctttacacatatagttccttattgtagaagtaaaaagaaaaaagaagcaattattcggataaatgtgggaggaaaactcttaaccaatcatctaaaggagatcatatcttacaggcagctacatgttatggatgaaacacatgtgattaatcaagtgaaagaagatgtatgctatgtgtctcaggatttttatagagacatggatattgcaaagttgaaaggagaagaaaatacagtaatgatagactatgtcttgcctgacttcagtacaattaaaaagggcttttgtaagccaagggaagagatggtgttgagtggaaaatacaaatctggggaacaaattcttcgtttggccaatgagagatttgctgttccggaaatactctttaatccttctgatataggcattcaagaaatgggaattccagaagctattgtctattcaattcaaaatctacctgaagaaatgcagccgcatttttttaagaacattgtcttgacaggaggaaattcccttttcccaggatttagggatcgggtttactcagaagttcgatgtcttactccaacagattatgatgtttctgttgtgctgcctgaaaaccctattacttatgcctgggaaggtggaaaattgatatcagagaatgatgattttgaagatatggtggtaacaagagaagattacgaagaaaatggacatagcgtctgtgaagagaaatttgatatttaagcaacatttttgaatgaaagttgtgaccataaggtttaatttcaaagttccttttaaaagaggttaaggaactgtgttaccttttgtcctaagaaaaaggcttgaatttatgtaaatactttgatcgattgctaattttcaaaggcttcttaggtaggttactacagtaaactgtaactcagtccacattttcatttaggagctagactaccataacaatgcttatgctgtttccaagggtaggttatttttcattaaaagaagaatgaatgcattttaagtttaattcttcatagctgaaagcacaaatttaacggcttcactggacagttttccttagaaggtagttttgtgtgactgtgactaaactattttattttaaaatgtcattcttatttatacattctaaagttggaaagactgatcttatatgtgtataatgtttattttgtacctagagtacatttaaaagggtggagactaagctaataaagtttttttggccact

SEQ ID NO: 108897 - DNA, 1659 bp, Homo sapiens
  Payload ID: 1394
  Gene Symbol: ACTR6
  Gene Name: ARP6 actin-related protein 6 homolog (yeast)
  ENST ID: ENST00000552376
  CDS Start-End: 23-1153
ctgcggtgtggttggtggtgagatgacgaccttagtgctggataatggagcttacaacgccaaaatcggttacagccatgaaaatgtgtcggttattcctaattgtcagttccggtcaaaaacagcacgtcttaaaacttttactgccaaccagatagatgaaataaaagacccttctggactcttttacatcctcccttttcaaaagggctacttggtgaattgggatgttcagagacaagtttgggattacctttttggaaaagaaatgtatcaggttgattttttagatactaatattattatcactgaaccatactttaacttcacttcaattcaagaatcaatgaatgaaattctatttgaagaataccagtttcaagcagtattaagagtaaatgctggggctctcagtgcacataggtatttccgagataatccttccgaattatgctgtatcattgttgatagtggatattcctttacacatatagttccttattgtagaagtaaaaagaaaaaagaagcaattattcggataaatgtgggaggaaaactcttaaccaatcatctaaaggagatcatatcttacaggcagctacatgttatggatgaaacacatgtgattaatcaagtgaaagaagatgtatgctatgtgtctcaggatttttatagagacatggatattgcaaagttgaaaggagaagaaaatacagtaatgatagactatgtcttgcctgacttcagtacaattaaaaagggcttttgtaagccaagggaagagatggtgttgagtggaaaatacaaatctggggaacaaattcttcgtttggccaatgagagatttgctgttccggaaatactctttaatccttctgatataggcattcaagaaatgggaattccagaagctattgtctattcaattcaaaatctacctgaaggatttagggatcgggtttactcagaagttcgatgtcttactccaacagattatgatgtttctgttgtgctgcctgaaaaccctattacttatgcctgggaaggtggaaaattgatatcagagaatgatgattttgaagatatggtggtaacaagagaagattacgaagaaaatggacatagcgtctgtgaagagaaatttgatatttaagcaacatttttgaatgaaagttgtgaccataaggtttaatttcaaagttccttttaaaagaggttaaggaactgtgttaccttttgtcctaagaaaaaggcttgaatttatgtaaatactttgatcgattgctaattttcaaaggcttcttaggtaggttactacagtaaactgtaactcagtccacattttcatttaggagctagactaccataacaatgcttatgctgtttccaagggtaggttatttttcattaaaagaagaatgaatgcattttaagtttaattcttcatagctgaaagcacaaatttaacggcttcactggacagttttccttagaaggtagttttgtgtgactgtgactaaactattttattttaaaatgtcattcttatttatacattctaaagttggaaagactgatcttatatgtgtataatgtttattttgtacctagagtacatttaaaagggtggagactaagctaataaagtttttttggcca

SEQ ID NO: 108898 - DNA, 595 bp, Homo sapiens
  Payload ID: 1394
  Gene Symbol: ACTR6
  Gene Name: ARP6 actin-related protein 6 homolog (yeast)
  ENST ID: ENST00000547458
  CDS Start-End: 36-470
aaaacaactacggctgcggtgtggttggtggtgagatgacgaccttagtgctggataatggagcttacaacgccaaaatcggttacagccatgaaaatgtgtcggttattcctaattgtcagttccggtcaaaaacagcacgtcttaaaacttttactgccaaccagatagatgaaataaaagacccttctggactcttttacatcctcccttttcaaaagggctacttggtgaattgggatgttcagagacaagtttgggattacctttttggaaaagaaatgtatcaggttgattttttagatactaatattattatcactgaaccatactttaacttcacttcaattcaagaatcaatgaatgaaattctatttgaagaataccagtttcaagcagtattaagagtaaatgggtcttgctctgttgcccaggctagagtgtggtggcacaaacatggctcactgtagcctccacctcctgggctcaagggatcctcccgcctcagcctcccaagtagctgggaccacagctggggctctcagtgcacataggtatttccgagataatccttccgaattatgctgtatcattg

SEQ ID NO: 108899 - DNA, 2045 bp, Homo sapiens
  Payload ID: 1394
  Gene Symbol: ACTR6
  Gene Name: ARP6 actin-related protein 6 homolog (yeast)
  ENST ID: ENST00000553038
  CDS Start-End: 988-1371
ggctgctgcgctccctgcccccgcggtgcccccttcccgccgccccgctcctctctcaggcgctcaaagtggcctggaatttgtagaacgcccccctccaagcccgttggcagttgtcctagcccgctggcccttgcccccgcccgctggccgttgcccccgcgacgccccggaagccaggtcctgcctcccgcacctgccaagtccccgccctgccggagtctcgctctgtcgcccaggctggagtgtagtggagccatctcggctcactgcaacctccgcctccccggttcaagcaattctcccgcctcagcctcccgagtacttgggattacaggcgcccgccacctcgcccggctactttttgtatttttaatagagacggggtttcgccgtgttggtcaggctggtctcaagctcctgacctcaagtgatctgcttgccttggtctcctaaagtgctgggattacaggcgtgagccaccgcgtccggcccaaaagccttttttggatgagaaagactcactcagcttcgtcctgaagagcaagtgggctggggaagaggagagtatgaatgtgagtccaagagcaagttttgcacttttttcttcaaagaatgtcaccgtctgaagaatgcgattggaagacacacacacacacacacacacacacacacacgcagccggttctctacaggattagaaaaaacttgcgcgaattaatctgcgtagttaaaaacaaatacgaaatgagcgagaaagcacatagtagtcaaatctcgccaccacataaacaggttaagtttggaagcacagcccctaacattcggtgctgcttagcatctccgacttccggcgtcctccgttgctaaggtgaccagaggcgcgtcctaacgctccgcccaacaaaccatagagtaccggaaaaagctcgagcagaggggtcggaaagggaaaacaactacggctgcggtgtggttggtggtgagatgacgaccttagtgctggataatggagcttacaacgccaaaatcggttacagccatgaaaatgtgtcggttattcctaattgtcagttccggtcaaaaacagcacgtcttaaaacttttactgccaaccagatagatgaaataaaagacccttctggactcttttacatcctcccttttcaaaagggctacttggtgaattgggatgttcagagacaagtttgggattacctttttggaaaagaaatgtatcaggttgattttttagatactaatattattatcactgaaccatactttaacttcacttcaattcaagaatcaatgaatgaaattctatttgaagaataccagtttcaagcagtattaagagtaaatggataaatgtgggaggaaaactcttaaccaatcatctaaaggagatcatatcttacaggcagctacatgttatggatgaaacacatgtgattaatcaagtgaaagaagatgtatgctatgtgtctcaggatttttatagagacatggatattgcaaagttgaaaggagaagaaaatacagtaatgatagactatgtcttgcctgacttcagtacaattaaaaagggcttttgtaagccaagggaagagatggtgttgagtggaaaatacaaatctggggaacaaattcttcgtttggccaatgagagatttgctgttccggaaatactctttaatccttctgatataggcattcaagaaatgggaattccagaagctattgtctattcaattcaaaatctacctgaagaaatgcagccgcatttttttaagaacattgtcttgacaggaggaaattcccttttcccaggatttagggatcgggtttactcagaagttcgatgtcttactccaacagattatgatgtttctgttgtgctgcctgaaaaagagatgctggggttactattaatctcaagagccaactggtgtagatactgaattgtccttcccttctgcttttcaaactccttgtatgtcaagggttggcaaaacgtaaagcctggaaaaaaaaaaaaaaaa

SEQ ID NO: 108900 - DNA, 1715 bp, Homo sapiens
  Payload ID: 1394
  Gene Symbol: ACTR6
  Gene Name: ARP6 actin-related protein 6 homolog (yeast)
  ENST ID: ENST00000551617
  CDS Start-End: 389-1273
gatgacgaccttagtgctggataatggagcttacaacgccaaaatcggttacagccatgaaaatgtgtcgtaagtactttctttctccgagggacaagatatatacgcctagtggtttcatgtgctacgtttcatctccggacatcaatgaactgcagacacccccgcgcggccctgacttagccagagggattccctggttggagctggggttattcctaattgtcagttccggtcaaaaacagcacgtcttaaaacttttactgccaaccagatagatgaaataaaagacccttctggactcttttacatcctcccttttcaaaagggctacttggtgaattgggatgttcagagacaagtttgggattacctttttggaaaagaaatgtatcaggttgattttttagatactaatattattatcactgaaccatactttaacttcacttcaattcaagaatcaatgaatgaaattctatttgaagaataccagtttcaagcagtattaagagtaaatgctggggctctcagtgcacataggtatttccgagataatccttccgaattatgctgtatcattgttgatagtggatattcctttacacatatagttccttattgtagaagtaaaaagaaaaaagaagcaattattcggataaatgtgggaggaaaactcttaaccaatcatctaaaggagatcatatcttacaggcagctacatgttatggatgaaacacatgtgattaatcaagtgaaagaagatgtatgctatgtgtctcaggatttttatagagacatggatattgcaaagttgaaaggagaagaaaatacagtaatgatagactatgtcttgcctgacttcagtacaattaaaaagggcttttgtaagccaagggaagagatggtgttgagtggaaaatacaaatctggggaacaaattcttcgtttggccaatgagagatttgctgttccggaaatactctttaatccttctgatataggcattcaagaaatgggaattccagaagctattgtctattcaattcaaaatctacctgaaggatttagggatcgggtttactcagaagttcgatgtcttactccaacagattatgatgtttctgttgtgctgcctgaaaaccctattacttatgcctgggaaggtggaaaattgatatcagagaatgatgattttgaagatatggtggtaacaagagaagattacgaagaaaatggacatagcgtctgtgaagagaaatttgatatttaagcaacatttttgaatgaaagttgtgaccataaggtttaatttcaaagttccttttaaaagaggttaaggaactgtgttaccttttgtcctaagaaaaaggcttgaatttatgtaaatactttgatcgattgctaattttcaaaggcttcttaggtaggttactacagtaaactgtaactcagtccacattttcatttaggagctagactaccataacaatgcttatgctgtttccaagggtaggttatttttcattaaaagaagaatgaatgcattttaagtttaattcttcatagctgaaagcacaaatttaacggcttcactggacagttttccttagaaggtagttttgtgtgactgtgactaaactattttattttaaaatgtcattcttatttatacattctaaagttggaaagactgatcttatatgtgtataatg

SEQ ID NO: 108901 - DNA, 780 bp, Homo sapiens
  Payload ID: 1394
  Gene Symbol: ACTR6
  Gene Name: ARP6 actin-related protein 6 homolog (yeast)
  ENST ID: ENST00000552064
  CDS Start-End: 23-289
ctgcggtgtggttggtggtgagatgacgaccttagtgctggataatggagcttacaacgccaaaatcggttacagccatgaaaatgtgtcggttattcctaattgtcagttccggtcaaaaacagcacgtcttaaaacttttactgccaaccagatagatgaaataaaagacccttctggactcttttacatcctcccttttcaaaagggctacttggtgaattgggatgttcagagacaagtttgggattacctttttggaaaagaaatgtatcaggtaacaaattagagttgattttttagatactaatattattatcactgaaccatactttaacttcacttcaattcaagaatcaatgaatgaaattctatttgaagaataccagtttcaagcagtattaagagtaaatggataaatgtgggaggaaaactcttaaccaatcatctaaaggagatcatatcttacaggcagctacatgttatggatgaaacacatgtgattaatcaagtgaaagaagatgtatgctatgtgtctcaggatttttatagagacatggatattgcaaagttgaaaggagaagaaaatacagtaatgatagactatgtcttgcctgacttcagtacaattaaaaagggcttttgtaagccaagggaagagatggtgttgagtggaaaatacaaatctggggaacaaattcttcgtttggccaatgagagatttgctgttccggaaatactctttaatccttctgatataggcattcaagaaatgggaat

SEQ ID NO: 108902 - DNA, 582 bp, Homo sapiens
  Payload ID: 1394
  Gene Symbol: ACTR6
  Gene Name: ARP6 actin-related protein 6 homolog (yeast)
  ENST ID: ENST00000551652
  CDS Start-End: 6-582
aactgatgtaccaaggtcctagcagagttctaaaggaggcccctggggcagaagcctacggttatgaatgcttgggagggctgcaccggacatccacgggatgctggggggttattcctaattgtcagttccggtcaaaaacagcacgtcttaaaacttttactgccaaccagatagatgaaataaaagacccttctggactcttttacatcctcccttttcaaaagggctacttggtgaattgggatgttcagagacaagtttgggattacctttttggaaaagaaatgtatcaggttgattttttagatactaatattattatcactgaaccatactttaacttcacttcaattcaagaatcaatgaatgaaattctatttgaagaataccagtttcaagcagtattaagagtaaatgctggggctctcagtgcacataggtatttccgagataatccttccgaattatgctgtatcattgttgatagtggatattcctttacacatatagttccttattgtagaagtaaaaagaaaaaagaagcaattattcggataaatgtgggaggaaaactcttaa

SEQ ID NO: 108903 - DNA, 1877 bp, Homo sapiens
  Payload ID: 1394
  Gene Symbol: ACTR6
  Gene Name: ARP6 actin-related protein 6 homolog (yeast)
  ENST ID: ENST00000546902
  CDS Start-End: 424-1368
gaaaacaactacggctgcggtgtggttggtggtgagatgacgaccttagtgctggataatggagcttacaacgccaaaatcggttacagccatgaaaatgtgtcgtaagtactttctttctccgagggacaagatatatacgcctagtggtttcatgtgctacgtttcatctccggacatcaatgaactgcagacacccccgcgcggccctgacttagccagagggattccctggttggagctggggttattcctaattgtcagttccggtcaaaaacagcacgtcttaaaacttttactgccaaccagatagatgaaataaaagacccttctggactcttttacatcctcccttttcaaaagggctacttggtgaattgggatgttcagagacaagtttgggattacctttttggaaaagaaatgtatcaggttgattttttagatactaatattattatcactgaaccatactttaacttcacttcaattcaagaatcaatgaatgaaattctatttgaagaataccagtttcaagcagtattaagagtaaatgctggggctctcagtgcacataggtatttccgagataatccttccgaattatgctgtatcattgttgatagtggatattcctttacacatatagttccttattgtagaagtaaaaagaaaaaagaagcaattattcggataaatgtgggaggaaaactcttaaccaatcatctaaaggagatcatatcttacaggcagctacatgttatggatgaaacacatgtgattaatcaagtgaaagaagatgtatgctatgtgtctcaggatttttatagagacatggatattgcaaagttgaaaggagaagaaaatacagtaatgatagactatgtcttgcctgacttcagtacaattaaaaagggcttttgtaagccaagggaagagatggtgttgagtggaaaatacaaatctggggaacaaattcttcgtttggccaatgagagatttgctgttccggaaatactctttaatccttctgatataggcattcaagaaatgggaattccagaagctattgtctattcaattcaaaatctacctgaagaaatgcagccgcatttttttaagaacattgtcttgacaggaggaaattcccttttcccaggatttagggatcgggtttactcagaagttcgatgtcttactccaacagattatgatgtttctgttgtgctgcctgaaaaccctattacttatgcctgggaaggtggaaaattgatatcagagaatgatgattttgaagatatggtggtaacaagagaagattacgaagaaaatggacatagcgtctgtgaagagaaatttgatatttaagcaacatttttgaatgaaagttgtgaccataaggtttaatttcaaagttccttttaaaagaggttaaggaactgtgttaccttttgtcctaagaaaaaggcttgaatttatgtaaatactttgatcgattgctaattttcaaaggcttcttaggtaggttactacagtaaactgtaactcagtccacattttcatttaggagctagactaccataacaatgcttatgctgtttccaagggtaggttatttttcattaaaagaagaatgaatgcattttaagtttaattcttcatagctgaaagcacaaatttaacggcttcactggacagttttccttagaaggtagttttgtgtgactgtgactaaactattttattttaaaatgtcattcttatttatacattctaaagttggaaagactgatcttatatgtgtataatgtttattttgtacctagagtacatttaaaagggtggagactaagctaataaagtttttttggccacta

SEQ ID NO: 108904 - DNA, 1747 bp, Homo sapiens
  Payload ID: 1394
  Gene Symbol: ACTR6
  Gene Name: ARP6 actin-related protein 6 homolog (yeast)
  ENST ID: ENST00000548180
  CDS Start-End: 36-302
aaaacaactacggctgcggtgtggttggtggtgagatgacgaccttagtgctggataatggagcttacaacgccaaaatcggttacagccatgaaaatgtgtcggttattcctaattgtcagttccggtcaaaaacagcacgtcttaaaacttttactgccaaccagatagatgaaataaaagacccttctggactcttttacatcctcccttttcaaaagggctacttggtgaattgggatgttcagagacaagtttgggattacctttttggaaaagaaatgtatcaggtaacaaattagagttgattttttagatactaatattattatcactgaaccatactttaacttcacttcaattcaagaatcaatgaatgaaattctatttgaagaataccagtttcaagcagtattaagagtaaatgctggggctctcagtgcacataggtatttccgagataatccttccgaattatgctgtatcattgttgatagtggatattcctttacacatatagttccttattgtagaagtaaaaagaaaaaagaagcaattattcggataaatgtgggaggaaaactcttaaccaatcatctaaaggagatcatatcttacaggcagctacatgttatggatgaaacacatgtgattaatcaagtgaaagaagatgtatgctatgtgtctcaggatttttatagagacatggatattgcaaagttgaaaggagaagaaaatacagtaatgatagactatgtcttgcctgacttcagtacaattaaaaagggcttttgtaagccaagggaagagatggtgttgagtggaaaatacaaatctggggaacaaattcttcgtttggccaatgagagatttgctgttccggaaatactctttaatccttctgatataggcattcaagaaatgggaattccagaagctattgtctattcaattcaaaatctacctgaagaaatgcagccgcatttttttaagaacattgtcttgacaggaggaaattcccttttcccaggatttagggatcgggtttactcagaagttcgatgtcttactccaacagattatgatgtttctgttgtgctgcctgaaaaccctattacttatgcctgggaaggtggaaaattgatatcagagaatgatgattttgaagatatggtggtaacaagagaagattacgaagaaaatggacatagcgtctgtgaagagaaatttgatatttaagcaacatttttgaatgaaagttgtgaccataaggtttaatttcaaagttccttttaaaagaggttaaggaactgtgttaccttttgtcctaagaaaaaggcttgaatttatgtaaatactttgatcgattgctaattttcaaaggcttcttaggtaggttactacagtaaactgtaactcagtccacattttcatttaggagctagactaccataacaatgcttatgctgtttccaagggtaggttatttttcattaaaagaagaatgaatgcattttaagtttaattcttcatagctgaaagcacaaatttaacggcttcactggacagttttccttagaaggtagttttgtgtgactgtgactaaactattttattttaaaatgtcattcttatttatacattctaaagttggaaagactgatcttatatgtgtataatgtttattttgtacctagagtacatttaaaagggtggagactaagctaataaagtttttttggccact

SEQ ID NO: 108905 - DNA, 3629 bp, Homo sapiens
  Payload ID: 1395
  Gene Symbol: ACTR8
  Gene Name: ARP8 actin-related protein 8 homolog (yeast)
  Uniprot ID: Q9H981
  ENST ID: ENST00000335754
  CDS Start-End: 102-1976
gactgtgggcagccggccgtgcgcctgcgcggtggcccttccatcccggcagtcgtggctgcagcgctgaggcgagaggttggtgggtgtctccggccataatgacccaggctgagaagggtgatacggagaacggaaaggagaagggcggcgagaaggagaaggagcagcgcggcgtgaagcggcccatcgtgcccgcgctggtgccggagtcgctgcaagagcaaatccagagcaacttcatcattgtcatacatccaggttcaacaactttaaggattggtcgagccacagacactcttcctgccagcattcctcacgtcattgcccgaagacacaaacaacaagggcagcccctatacaaggacagttggctcctaagggagggactaaataaaccagaaagtaatgaacaaagacaaaatggccttaaaatggtggatcaagcaatatggtctaaaaagatgtccaatggtacaagacgcattcctgtgtcccctgaacaggcacgctcctacaataagcagatgcgacctgcaattttagatcactgttcgggaaataagtggacaaacacatctcatcaccctgagtatttagtaggagaagaggccttgtatgttaatccactggactgttacaatattcactggcctatcagaagaggtcagttaaatattcacccaggccctgggggctctcttacagctgttctggcagatattgaagtaatatggtctcatgcgatacaaaaatacttggaaatcccactgaaagatttaaagtattatagatgtatcttgttaattcctgatatctataataagcagcatgtgaaagaactagtgaatatgatactaatgaagatgggtttttcagggattgtggtccatcaggagtctgtgtgtgccacctatggaagtggcttaagcagcacgtgtattgtagacgttggggaccagaagacaagtgtatgctgtgtggaggatggggtgtctcatcggaatactcggctttgtctggcatacggaggatctgatgtgtcaagatgtttttactggctaatgcagcgagctgggttcccttacagagaatgccagttaacaaataaaatggattgtcttcttctgcaacaccttaaagaaactttttgtcatttagatcaggacatctctgggcttcaggaccatgagtttcagattcgacatcctgattctcctgccctgctttaccagtttcgattaggagatgaaaaactgcaggctccaatggctttgttttaccccgcaacttttggaatcgttggacagaaaatgacgactttgcagcacagatctcagggcgatcctgaggatcctcacgatgaacattacctgctggccacacagagcaaacaagaacagtctgcaaaagctactgctgaccgaaagtctgcatccaaacctattggatttgaaggggatcttcgtggccagtcctctgatcttccagaaagactccattcccaggaggtagatttggggtctgcacagggagatggcctgatggccggcaacgattccgaggaggccctcactgcactgatgtccaggaagactgccatctcgctgtttgaaggaaaagccctgggcctggataaagccatcctccatagcatagactgctgttcatctgacgacaccaaaaagaagatgtacagctccatcctagtggtgggaggtggtttgatgtttcataaagctcaagaatttctgcagcacagaattctcaacaaaatgccaccatccttcaggcgaattattgaaaatgtggatgtgatcacaaggcctaaggacatggacccccggctgattgcatggaaaggaggggcagtgttggcttgtttggatacaacacaggaactgtggatttatcagcgagagtggcagcgctttggtgtccgcatgttacgagagcgggctgcgtttgtgtggtgaatggggaggaaatgtcactgccgaagaccaaaaacaagcttcttggtataaaagactcttacagaatatgtgtattgtaatttattgatctggatgcttaagtgtcatggacagtaaatgaatttgaactttatgttgaggacatgacattggtttgaaaatataaactgcttttgagcagtttagtcagggcatttgagaataaataggaactttctcttcagttgtaaactctcttgccctctctcagggtctcataaactccccagtgatgtaaacgttgctattgaaggttctcatgtggtgaagcccttcatttaagttggcttgaatctcatcagcaggcagcctcatgcaaccatgagggatagtatgtgacgagggagaactgtccactcatgccattttctctcttgtctagtatttcattaggatctaaagttgtctgagttaaatgcacttatgtgactcatgtgtcctcttagaatcccaaatagggggaaaaagttttggtggtttttgttttttttttcattttctgttggattacagaaaaagaatgggacccattcaggtctcgatttccaaaggtaaagatggaaggctgggcagactggcttttgttacctgacatgccgtagggtgagcttagaggaagaaagaaaacaatttttatttggccaaaacagaacaaatgctgaaaaggaaatcttgtttttttcctaaagccaaatagaaatgatttgggtataatttaagagtccttgtgttgtacagatatggtgactgatgtagttattaatactaccaacttagtcatcaagcctcaattttcctttacctgaaggattaagtgaaagcttttggagttcatgatgttcagtatgatcagttaaccttaacctctgagcatcctgaagcaaaatctaaataatgcagctattaccactggtggtccaggctctggtgaagccctctgagcccaggaggaagagaaagcattgtccagaggtaggaacacagtctgggagcccagagctctgggaggagtgggaaaatgctgcttcctgctgcttgcttctaggcacctgcttccgccatctcacttaccatggctagagatgggggtgagactggggaaggacaaaagcagggaacagataagtgatggaaatcagaagggaatatagaaagaactctggatgtggagaaatgccggtacctgagcattttgtatcaatgggagtaccctctgtaactgctcagtaggttacaaatgaagagtccaccagtattagaaacaatttaaacttgccagtaccaactgggatgtgtgccttcaatttgaaaattgtatgttttattttttaaatttgttaacagcattaatttatagagtattgatgtcatttatgtttctgaggtgtttcaacacaattttggatcagctgcctgtttgcaaaaacataatatatttctgttaaacagttcttcacctaacagcatattgctcttataactggtagagctgtttcaaaggaagttggtttctggtccaagttttgacctaaaccatgtccatcttctattaccagcacttacaagcactgtgaaaactgatcatgacaaataagtaaaatttgctacattaaa

SEQ ID NO: 108906 - DNA, 1202 bp, Homo sapiens
  Payload ID: 1395
  Gene Symbol: ACTR8
  Gene Name: ARP8 actin-related protein 8 homolog (yeast)
  ENST ID: ENST00000486794
  CDS Start-End: 1-1136
cagctgttctggcagatattgaagtaatatggtctcatgcgatacaaaaatacttggaaatcccactgaaagatttaaagtattatagatgtatcttgttaattcctgatatctataataagcagcatgtgaaagaactagtgaatatgatactaatgaagatgggtttttcagggattgtggtccatcaggagtctgtgtgtgccacctatggaagtggcttaagcagcacgtgtattgtagacgttggggaccagaagacaagtgtatgctgtgtggaggatggggtgtctcatcggaatactcgcatcttttcctggaatcaggacatctctgggcttcaggaccatgagtttcagattcgacatcctgattctcctgccctgctttaccagtttcgattaggagatgaaaaactgcaggctccaatggctttgttttaccccgcaacttttggaatcgttggacagaaaatgacgactttgcagcacagatctcagggcgatcctgaggatcctcacgatgaacattacctgctggccacacagagcaaacaagaacagtctgcaaaagctactgctgaccgaaagtctgcatccaaacctattggatttgaaggggatcttcgtggccagtcctctgatcttccagaaagactccattcccaggaggtagatttggggtctgcacagggagatggcctgatggccggcaacgattccgaggaggccctcactgcactgatgtccaggaagactgccatctcgctgtttgaaggaaaagccctgggcctggataaagccatcctccatagcatagactgctgttcatctgacgacaccaaaaagaagatgtacagctccatcctagtggtgggaggtggtttgatgtttcataaagctcaagaatttctgcagcacagaattctcaacaaaatgccaccatccttcaggcgaattattgaaaatgtggatgtgatcacaaggcctaaggacatggacccccggctgattgcatggaaaggaggggcagtgttggcttgtttggatacaacacaggaactgtggatttatcagcgagagtggcagcgctttggtgtccgcatgttacgagagcgggctgcgtttgtgtggtgaatggggaggaaatgtcactgccgaagaccaaaaacaagcttcttggtataaaagactcttacagaa

SEQ ID NO: 108907 - DNA, 708 bp, Homo sapiens
  Payload ID: 1395
  Gene Symbol: ACTR8
  Gene Name: ARP8 actin-related protein 8 homolog (yeast)
  ENST ID: ENST00000498740
  CDS Start-End: 403-708
agtgcggaagcggtcgttcttttccgggtggtggcgcgccgggacgccgagggctgggaggtgcggagcgccaggagccaggcggagcccccgcagggacaccgctccgatctcccgcacgccccaccgtctggttgtgtgcgctcctgcccgggctctggcctcagcttccccgaccataaaacgaccacgcaaatccagagcaacttcatcattgtcatacatccaggttcaacaactttaaggattggtcgagccacagacactcttcctgccagcattcctcacgtcattgcccgaagacacaaacaacaagggcagcccctatacaaggacagttggctcctaagggagggactaaataaaccagaaagtaatgaacaaagacaaaatggccttaaaatggtggatcaagcaatatggtctaaaaagatgtccaatggtacaagacgcattcctgtgtcccctgaacaggcacgctcctacaataagcagatgcgacctgcaattttagatcactgttcgggaaataagtggacaaacacatctcatcaccctgagtatttagtaggagaagaggccttgtatgttaatccactggactgttacaatattcactggcctatcagaagaggtcagttaaatattcacccaggccctgggggctctcttacagctgttctggcagatattgaagtaatatggtct

SEQ ID NO: 108908 - DNA, 2091 bp, Homo sapiens
  Payload ID: 1395
  Gene Symbol: ACTR8
  Gene Name: ARP8 actin-related protein 8 homolog (yeast)
  Uniprot ID: Q9H981
  ENST ID: ENST00000482349
  CDS Start-End: 333-1874
gcgcgccgggacgccgagggctgggaggtgcggagcgccaggagccaggcggagcccccgcagggacaccgctccgatctcccgcacgccccaccgtctggttgtgtgcgctcctgcccgggctctggcctcagcttccccgaccataaaacgaccacggttcaacaactttaaggattggtcgagccacagacactcttcctgccagcattcctcacgtcattgcccgaagacacaaacaacaagggcagcccctatacaaggacagttggctcctaagggagggactaaataaaccagaaagtaatgaacaaagacaaaatggccttaaaatggtggatcaagcaatatggtctaaaaagatgtccaatggtacaagacgcattcctgtgtcccctgaacaggcacgctcctacaataagcagatgcgacctgcaattttagatcactgttcgggaaataagtggacaaacacatctcatcaccctgagtatttagtaggagaagaggccttgtatgttaatccactggactgttacaatattcactggcctatcagaagaggtcagttaaatattcacccaggccctgggggctctcttacagctgttctggcagatattgaagtaatatggtctcatgcgatacaaaaatacttggaaatcccactgaaagatttaaagtattatagatgtatcttgttaattcctgatatctataataagcagcatgtgaaagaactagtgaatatgatactaatgaagatgggtttttcagggattgtggtccatcaggagtctgtgtgtgccacctatggaagtggcttaagcagcacgtgtattgtagacgttggggaccagaagacaagtgtatgctgtgtggaggatggggtgtctcatcggaatactcggctttgtctggcatacggaggatctgatgtgtcaagatgtttttactggctaatgcagcgagctgggttcccttacagagaatgccagttaacaaataaaatggattgtcttcttctgcaacaccttaaagaaactttttgtcatttagatcaggacatctctgggcttcaggaccatgagtttcagattcgacatcctgattctcctgccctgctttaccagtttcgattaggagatgaaaaactgcaggctccaatggctttgttttaccccgcaacttttggaatcgttggacagaaaatgacgactttgcagcacagatctcagggcgatcctgaggatcctcacgatgaacattacctgctggccacacagagcaaacaagaacagtctgcaaaagctactgctgaccgaaagtctgcatccaaacctattggatttgaaggggatcttcgtggccagtcctctgatcttccagaaagactccattcccaggaggtagatttggggtctgcacagggagatggcctgatggccggcaacgattccgaggaggccctcactgcactgatgtccaggaagactgccatctcgctgtttgaaggaaaagccctgggcctggataaagccatcctccatagcatagactgctgttcatctgacgacaccaaaaagaagatgtacagctccatcctagtggtgggaggtggtttgatgtttcataaagctcaagaatttctgcagcacagaattctcaacaaaatgccaccatccttcaggcgaattattgaaaatgtggatgtgatcacaaggcctaaggacatggacccccggctgattgcatggaaaggaggggcagtgttggcttgtttggatacaacacaggaactgtggatttatcagcgagagtggcagcgctttggtgtccgcatgttacgagagcgggctgcgtttgtgtggtgaatggggaggaaatgtcactgccgaagaccaaaaacaagcttcttggtataaaagactcttacagaatatgtgtattgtaatttattgatctggatgcttaagtgtcatggacagtaaatgaatttgaactttatgttgaggacatgacattggtttgaaaatataaactgcttttgagcagtttagtcagggcatttgagaataaataggaactttc

SEQ ID NO: 108909 - DNA, 2466 bp, Homo sapiens
  Payload ID: 1396
  Gene Symbol: ARPC4-TTLL3
  Gene Name: ARPC4-TTLL3 readthrough
  ENST ID: ENST00000397256
  CDS Start-End: 9-1886
cgcccgcgatgactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatggtgggtctatgtctcaatctccggaatttgccgtggtttgatgaggttgatgccaactccttcttcccacgctgctactgcctgggggctgaggatgacaaaaaagccttcataggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagacaacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaa

SEQ ID NO: 108910 - DNA, 499 bp, Homo sapiens
  Payload ID: 1396
  Gene Symbol: ARPC4-TTLL3
  Gene Name: ARPC4-TTLL3 readthrough
  ENST ID: ENST00000453882
  CDS Start-End: 1-499
gactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatcagaagaagatctttacaatccaaggctgctacccggtgatccggtgtctcttgcgccggaggggctgggtggagaagaagatggtccatcgctca

SEQ ID NO: 108911 - DNA, 551 bp, Homo sapiens
  Payload ID: 1396
  Gene Symbol: ARPC4-TTLL3
  Gene Name: ARPC4-TTLL3 readthrough
  ENST ID: ENST00000418163
  CDS Start-End: 41-184
acttccgtacttccgctttccggcccagccagcgcccgcgatgactgccactctccgcccctacctgagtgccgtgcgggccacattgcaggctgccctctgcctggagaacttctcctcccaggttgtggaacgacacaacaagccggaagtggaagtcaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatgtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctg

SEQ ID NO: 108912 - DNA, 903 bp, Homo sapiens
  Payload ID: 1396
  Gene Symbol: ARPC4-TTLL3
  Gene Name: ARPC4-TTLL3 readthrough
  ENST ID: ENST00000424442
  CDS Start-End: 41-586
acttccgtacttccgctttccggcccagccagcgcccgcgatgactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatgtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatggtgagg

SEQ ID NO: 108913 - DNA, 1292 bp, Homo sapiens
  Payload ID: 1397
  Gene Symbol: ARR3
  Gene Name: arrestin 3, retinal (X-arrestin)
  Uniprot ID: P36575
  ENST ID: ENST00000307959
  CDS Start-End: 52-1218
gaacttcatctctctccccagaaaaggctcaacatcaactatatagccaacatgtccaaggtgtttaagaagaccagctccaatgggaagctctccatctacctggggaaacgggacttcgtggaccatgtggacacggtggaacccattgacggtgttgtcctggttgatcctgagtacttaaaatgtcgaaagttgtttgtcatgttgacatgtgcctttcgctatggccgtgatgacttggaagtgattggtctgacgttccgaaaagatctgtatgtgcagaccctgcaagtggtcccagctgaatccagcagccctcaggggcccctcacagtcctacaggagcgactactgcacaagctaggggacaatgcctacccctttaccctgcagatggtgaccaacctgccctgttctgtgacactgcagccaggtcctgaagatgcaggaaagccctgtgggattgactttgaagtgaagagtttctgtgctgaaaacccagaggagacagtctccaagagagactatgtgcggctggttgtccggaaagtacaatttgcaccaccggaggcaggccctggcccctcagcccagaccatccgccgcttccttctgtcagctcagcccctacaactccaggcctggatggacagggaggttcactaccacggagaacccatctctgtcaatgtttctatcaacaactgcaccaacaaggtcatcaaaaaaatcaagatttcagttgaccagatcacagatgttgtcctgtattcactagacaagtacaccaagactgtgttcattcaggaattcacggagactgtagctgctaattccagcttctcccagagctttgcagtaaccccaatcctggctgccagctgccagaaacggggcctggcactggatggcaaacttaagcatgaagataccaacctggcctctagcacaattattagaccgggaatggacaaagagctgctggggatcctggtgtcctacaaagtcagagtcaacctgatggtgtcctgtggtggcatcctaggagacctgacagccagcgatgttggtgtggagctacccttggtcctgatccatccgaagccatctcatgaggccgctagctctgaggacatagtcatcgaggagtttacgcggaaaggcgaggaggagagccagaaggctgtggaggctgagggagatgaggggagctgagcacctcgctctggtgcccgtctgtgtgggagcccccactgtaacactctaataaatcagtttgttcagatgtg

SEQ ID NO: 108914 - DNA, 1298 bp, Homo sapiens
  Payload ID: 1397
  Gene Symbol: ARR3
  Gene Name: arrestin 3, retinal (X-arrestin)
  Uniprot ID: P36575
  ENST ID: ENST00000374495
  CDS Start-End: 99-1178
aagaggctggggaggcaggcatagcaaccagagctggagactgatgtgaacttcatctctctccccagaaaaggctcaacatcaactatatagccaacatgtccaaggtgtttaagaagaccagctccaatgggaagctctccatctacctggggaaacgggacttcgtggaccatgtggacacggtggaacccattgacggtgttgtcctggttgatcctgagtacttaaaatgtcgaaagttgtttgtcatgttgacatgtgcctttcgctatggccgtgatgacttggaagtgattggtctgacgttccgaaaagatctgtatgtgcagaccctgcaagtggtcccagctgaatccagcagccctcaggggcccctcacagtcctacaggagcgactactgcacaagctaggggacaatgcctacccctttaccctgcagatggtgaccaacctgccctgttctgtgacactgcagccaggtcctgaagatgcaggaaagccctgtgggattgactttgaagtgaagagtttctgtgctgaaaacccagaggagacagtctccaagagagactatgtgcggctggttgtccggaaagtacaatttgcaccaccggaggcaggccctggcccctcagcccagaccatccgccgcttccttctgtcagctcagcccctacaactccaggcctggatggacagggaggttcactaccacggagaacccatctctgtcaatgtttctatcaacaactgcaccaacaaggtcatcaaaaaaatcaagatttcagttgaccagatcacagatgttgtcctgtattcactagacaagtacaccaagactgtgttcattcaggaattcacggagactgtagctgctaattccagcttctcccagagctttgcagtaaccccaatcctggctgccagctgccagaaacggggcctggcactggatggcaaacttaagcatgaagataccaacctggcctctagcacaattattagaccgggaatggacaaagagctgctggggatcctggtgtcctacaaagtcagagtcaacctgatggtgtcctgtggtggcatcctaggagacctgacagccagcgatgttggtgtggagctacccttggtcctgatccatccgaagccatctcatgaggccgctaggtaatggaatacaagattgggaagccccattcccctcttcccatttccaccctccatgttatgacgatagaaatgtgaaaatgcttccttggggtgctttcaatacatgtgcagtggaaacata

SEQ ID NO: 108915 - DNA, 549 bp, Homo sapiens
  Payload ID: 1397
  Gene Symbol: ARR3
  Gene Name: arrestin 3, retinal (X-arrestin)
  ENST ID: ENST00000480877
  CDS Start-End: 259-549
tgatgtgaacttcatctctctccccagaaaaggctcaacatcaactatatagccaacatgtccaaggtgtttaagaagaccagctccaatgggaaggtgagagaacctggcccagctgggcaaatgagagggcaaaagggatagctctccatctacctggggaaacgggacttcgtggaccatgtggacacggtggaacccattgacggtgttgtcctggttgatcctgagtacttaaaatgtcgaaagttgtttgtcatgttgacatgtgcctttcgctatggccgtgatgacttggaagtgattggtctgacgttccgaaaagatctgtatgtgcagaccctgcaagtggtcccagctgaatccagcagccctcaggggcccctcacagtcctacaggagcgactactgcacaagctaggggacaatgcctacccctttaccctgcagatggtgaccaacctgccctgttctgtgacactgcagccaggtcctgaagatgcaggaaagccctgtgggattgactttgaagtgaagagtttctgtgct

SEQ ID NO: 108916 - DNA, 1309 bp, Homo sapiens
  Payload ID: 1397
  Gene Symbol: ARR3
  Gene Name: arrestin 3, retinal (X-arrestin)
  ENST ID: ENST00000620997
  CDS Start-End: 69-1235
gagctggagactgatgtgaacttcatctctctccccagaaaaggctcaacatcaactatatagccaacatgtccaaggtgtttaagaagaccagctccaatgggaagctctccatctacctggggaaacgggacttcgtggaccatgtggacacggtggaacccattgacggtgttgtcctggttgatcctgagtacttaaaatgtcgaaagttgtttgtcatgttgacatgtgcctttcgctatggccgtgatgacttggaagtgattggtctgacgttccgaaaagatctgtatgtgcagaccctgcaagtggtcccagctgaatccagcagccctcaggggcccctcacagtcctacaggagcgactactgcacaagctaggggacaatgcctacccctttaccctgcagatggtgaccaacctgccctgttctgtgacactgcagccaggtcctgaagatgcaggaaagccctgtgggattgactttgaagtgaagagtttctgtgctgaaaacccagaggagacagtctccaagagagactatgtgcggctggttgtccggaaagtacaatttgcaccaccggaggcaggccctggcccctcagcccagaccatccgccgcttccttctgtcagctcagcccctacaactccaggcctggatggacagggaggttcactaccacggagaacccatctctgtcaatgtttctatcaacaactgcaccaacaaggtcatcaaaaaaatcaagatttcagttgaccagatcacagatgttgtcctgtattcactagacaagtacaccaagactgtgttcattcaggaattcacggagactgtagctgctaattccagcttctcccagagctttgcagtaaccccaatcctggctgccagctgccagaaacggggcctggcactggatggcaaacttaagcatgaagataccaacctggcctctagcacaattattagaccgggaatggacaaagagctgctggggatcctggtgtcctacaaagtcagagtcaacctgatggtgtcctgtggtggcatcctaggagacctgacagccagcgatgttggtgtggagctacccttggtcctgatccatccgaagccatctcatgcttctgcaagctctgaggacatagtcatcgaggagtttacgcggaaaggcgaggaggagagccagaaggctgtggaggctgagggagatgaggggagctgagcacctcgctctggtgcccgtctgtgtgggagcccccactgtaacactctaataaatcagtttgttcagatgtg

SEQ ID NO: 108917 - DNA, 1586 bp, Homo sapiens
  Payload ID: 1398
  Gene Symbol: ARRDC1
  Gene Name: arrestin domain containing 1
  Uniprot ID: Q8N5I2
  ENST ID: ENST00000371421
  CDS Start-End: 65-1366
ggagccgggactcgcgggcggcgggcgggggcgtcgctgcgcggctggccggtgaggccgcggcatggggcgagtgcagctcttcgagatcagcctgagccacggccgcgtcgtctacagccccggggagccgttggctgggaccgtgcgcgtgcgcctgggggcaccgctgccgttccgagccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgagcaacccaacgtggcctctgccaccaagaagttctcctacaagctggtgaagacgggcagcgtggtcctcacagccagcactgatctccgcggctatgtggtggggcaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtggtgccttccgcaccaccccaggaggaggctgaggctgaggctgcggctggcggcccccacttcttggaccccgtcttcctctccaccaagagccattcgcagcggcagcccctgctggccaccttgagttctgtgcctggtgcgccggagccctgccctcaggatggcagccctgcctcacacccgctgcaccctcccttgtgcatttcaacaggtgccactgtcccctactttgcagagggctccggggggccagtgcccactaccagcaccttgattcttcctccagagtacagttcttggggctacccctatgaggccccaccgtcttatgagcagagctgcggcggcgtggaacccagcctgacccctgagagctgaccccgtgctgccttctccaggcaggcctggcctctgccctgggactggggcgcccagggcctcgtgccttctctcttggcctagcctggcccactcaggacctgcccagcctctgccagctcctctggcatccgccctcttctccctggggctggggtgggggtggcagggagctgggacctggagagacaactcctgtaaataaaacactttatttgta

SEQ ID NO: 108918 - DNA, 555 bp, Homo sapiens
  Payload ID: 1398
  Gene Symbol: ARRDC1
  Gene Name: arrestin domain containing 1
  ENST ID: ENST00000431925
  CDS Start-End: 25-555
gcggctggccggtgaggccgcggcatggggcgagtgcagctcttcgagatcagcctgagccacggccgcgtcgtctacagccccggggagccgttggctgggaccgtgcgcgtgcgcctgggggcaccgctgccgttccgagccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgagggatccagcctgcgcacacctgctaagcccctccctggccctccccccaagcaacccaacgtggcctctgccaccaagaagttctcctacaagctg

SEQ ID NO: 108919 - DNA, 829 bp, Homo sapiens
  Payload ID: 1398
  Gene Symbol: ARRDC1
  Gene Name: arrestin domain containing 1
  ENST ID: ENST00000419386
  CDS Start-End: 16-829
cggtgaggccgcggcatggggcgagtgcagctcttcgagatcagcctgagccacggccgcgtcgtctacagccccggggagccgttggctgggaccgtgcgcgtgcgcctgggggcaccgctgccgttccgagccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtgg

SEQ ID NO: 108920 - DNA, 882 bp, Homo sapiens
  Payload ID: 1398
  Gene Symbol: ARRDC1
  Gene Name: arrestin domain containing 1
  ENST ID: ENST00000461627
  CDS Start-End: 23-394
ggctggccggtgaggccgcggcatggggcgagtgcagctcttcgagatcagcctgagccacggccgcgtcgtctacagccccggggagccgttggctgggaccgtgcgcgtgcgcctgggggcaccgctgccgttccgagccatccgggtgacctgcataggttcctgcggggtctccaacaaggctaatgacacagcgtgggtagtggaggagggttacttcaacagttccctgtcgctggcagacaagggtaagtttgggagccagttcccgagtggtgacccctgggggcagcccttggagtggggcctgtctgtcctgtcctccccctttcctagatctgcctcttggatctggcactggcccatcttgtcccagggttgtgggccctgatggctttctcataggcgctgggtggctgaaggggccacctcccccttgtgctggatttgggtgggctctgacccctggcacagctgtttcacccttgccccattcccaaaccactctcctgttcaagccaagctcttatcctcagtccttcacccaagccacagccctgtgctgctgtggcgctggtgactgagacagggagacccagtgtgagctggtcagctgcagtgcccactcttatcctggccctgtggccacctcaggccacctcagggggggactgccccccacctccctcctgtctctgcagggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagcccctt

SEQ ID NO: 108921 - DNA, 2503 bp, Homo sapiens
  Payload ID: 1399
  Gene Symbol: ARRDC2
  Gene Name: arrestin domain containing 2
  Uniprot ID: Q8TBH0
  ENST ID: ENST00000222250
  CDS Start-End: 144-1367
gggattttctgctccggttggtgagcgcgcctgcgcgttgacggcgattttgcgttctgaggctgcagcgtcggcatcttgagctgccggttcgcgagttcgaggccaggttccgcctgtcgtgggttcgcaccccggacgcgatgctattcgacaaggtgaaagcgttctcggtgcagttggacggcgcgaccgcgggcgtcgagcccgtgtttagcggcggccaggccgtggcgggccgggtgctgctggagctgtcaagcgccgcgcgtgtgggtgccctgaggctgcgcgcgcggggccgcgcccacgtgcactggaccgagtcgcgcagcgcgggctcgagcacggcttacacgcagagctacagtgaacgcgtggaggtcgtgagccaccgcgccacgctcctggcgccagataccggggagaccacgacgctgcctcctgggcgccatgagttcctgttcagcttccagctgcccccgaccctggtgacatccttcgagggcaaacacggtagtgtccgctactgtatcaaggccaccctgcaccggccctgggtcccagcacgccgggcaaggaaggtgttcactgtcatcgagcctgtggacatcaacacgccagccctgctggcacctcaagcgggggctcgggaaaaggttgcccgatcctggtactgtaaccgtggcctagtctccctttcggccaagatcgaccgcaagggctacaccccaggagaggtcatccctgtctttgccgagatcgacaacggctccacacgtcctgtgctgcctcgggcagccgtggtgcagacacagacgttcatggcccgaggcgcccgaaagcagaaacgggcagtggtggccagcctcgcgggcgagccggtgggccccgggcagcgggcgctgtggcagggccgggcactgcggatccccccagtgggtccttccatcctgcactgccgcgttctacacgtggactacgcactcaaggtctgtgtggatatcccaggaacgtccaagctgctgctggagctgccactggtgatcggcaccattcccttgcacccttttggcagccgttcctccagcgtgggcagccacgccagcttcctgctggactggaggctgggggccttgccggagcggcctgaggctcctcctgagtactcggaggtggtagccgacactgaggaggcagccttggggcagagccccttcccgcttccgcaggaccccgacatgagccttgaaggcccgttcttcgcctacatccaagagttccgctaccgcccgccacccctgtactctgaggaggatccaaacccactcttgggggacatgaggccgcgctgcatgacttgctgaacggcacagggacccctcgaggaacaaggttgcacaccagctttcagccaccatgactgtggggagtggctggaccaagggctgacctccccgactgcatcaaagttggggaaccaagtctcagagtgaggcgggggcctttcggatatcacatgggacagaggaagagcccggctggaatctgacttacctggaccgctgtccttgtgaggcattgaatgcccagtgcagtatccgagagactgtttaataacctgtcttcccagccaattggtggtgctggaatcccctaggagccttcagtctgggagaaacagagccagacatagacagttccagcatcacagaaccagaagaagagacctgcaactgtgagagtccagacaggaagcagagaaggcgtccttgcggaaagggcattttagctgaggctttggagtacgaataggagctcagcaggcagacgaatgaggaataaaggtcagagaaggtcagagctgagtgacgtttggaatccaccccgtttattgtagaactgggggttcagagggcaggtgcctcagagttgaggccacacagtgaggtctggtgggtgaaaggacccaggaacgaggcgttcaggaaagcaggttgtcagagctatgtggagtctgtgggtggcaggggcagccgctccagcctttgaagactttgaaagccagagattcctggcgcaggcttggacttcctgggagctcctccaagtacccaggggcatcagagctgcctgggtgttacatggcccagggaacccaggttcagggtaggacaggcaagaccagatacccaatgtgcaaagtgaaaacactgggctccctgttaaacgatgaagaattcaagacagtgacagcattacgtcacccctggggacagaggtcagcctaaggtgacacacggggactactgtgcttccggaggctccctgtgtcctggaggagaaaagcattagagggggcagctggacaagctcccaactgcagagtcccagccctggctggggcagggccccggcctgggactcagcatttctgatatgccttaagaattcattctgttttgtacaattattttttaaaagtaaacgtgtggagaaagaa

SEQ ID NO: 108922 - DNA, 2528 bp, Homo sapiens
  Payload ID: 1399
  Gene Symbol: ARRDC2
  Gene Name: arrestin domain containing 2
  Uniprot ID: Q8TBH0
  ENST ID: ENST00000379656
  CDS Start-End: 184-1392
ccaggaagttcgccgacgacgcgcccgccctgggccaccggcgccggcccaagttcgccgggggggcccggaggaagcttgggggacgcgacgggggaacgcggaaaccccggggatctgcaggcgcgcccgggccgtgtgccttctctccgcgtgtccaaaccgtgtccccagccgcgcgccatgcgctctgggggcgtgcgcagcttcgcgctggagctggcgcggggcccgggcggcgcctaccgcggcggggagcggctgtgcggccgggtgctgctggaggcggcggcgccgctgcgggtgcgagcgctcgaggtgaaggcgcgcggcggggcggccacccactggttggagggtcgcagcgtgggcgtcaacgccgtatccagcgactacgcggccgcggagacctacctgcggcgtcggcagctgctgctccgagataccggggagaccacgacgctgcctcctgggcgccatgagttcctgttcagcttccagctgcccccgaccctggtgacatccttcgagggcaaacacggtagtgtccgctactgtatcaaggccaccctgcaccggccctgggtcccagcacgccgggcaaggaaggtgttcactgtcatcgagcctgtggacatcaacacgccagccctgctggcacctcaagcgggggctcgggaaaaggttgcccgatcctggtactgtaaccgtggcctagtctccctttcggccaagatcgaccgcaagggctacaccccaggagaggtcatccctgtctttgccgagatcgacaacggctccacacgtcctgtgctgcctcgggcagccgtggtgcagacacagacgttcatggcccgaggcgcccgaaagcagaaacgggcagtggtggccagcctcgcgggcgagccggtgggccccgggcagcgggcgctgtggcagggccgggcactgcggatccccccagtgggtccttccatcctgcactgccgcgttctacacgtggactacgcactcaaggtctgtgtggatatcccaggaacgtccaagctgctgctggagctgccactggtgatcggcaccattcccttgcacccttttggcagccgttcctccagcgtgggcagccacgccagcttcctgctggactggaggctgggggccttgccggagcggcctgaggctcctcctgagtactcggaggtggtagccgacactgaggaggcagccttggggcagagccccttcccgcttccgcaggaccccgacatgagccttgaaggcccgttcttcgcctacatccaagagttccgctaccgcccgccacccctgtactctgaggaggatccaaacccactcttgggggacatgaggccgcgctgcatgacttgctgaacggcacagggacccctcgaggaacaaggttgcacaccagctttcagccaccatgactgtggggagtggctggaccaagggctgacctccccgactgcatcaaagttggggaaccaagtctcagagtgaggcgggggcctttcggatatcacatgggacagaggaagagcccggctggaatctgacttacctggaccgctgtccttgtgaggcattgaatgcccagtgcagtatccgagagactgtttaataacctgtcttcccagccaattggtggtgctggaatcccctaggagccttcagtctgggagaaacagagccagacatagacagttccagcatcacagaaccagaagaagagacctgcaactgtgagagtccagacaggaagcagagaaggcgtccttgcggaaagggcattttagctgaggctttggagtacgaataggagctcagcaggcagacgaatgaggaataaaggtcagagaaggtcagagctgagtgacgtttggaatccaccccgtttattgtagaactgggggttcagagggcaggtgcctcagagttgaggccacacagtgaggtctggtgggtgaaaggacccaggaacgaggcgttcaggaaagcaggttgtcagagctatgtggagtctgtgggtggcaggggcagccgctccagcctttgaagactttgaaagccagagattcctggcgcaggcttggacttcctgggagctcctccaagtacccaggggcatcagagctgcctgggtgttacatggcccagggaacccaggttcagggtaggacaggcaagaccagatacccaatgtgcaaagtgaaaacactgggctccctgttaaacgatgaagaattcaagacagtgacagcattacgtcacccctggggacagaggtcagcctaaggtgacacacggggactactgtgcttccggaggctccctgtgtcctggaggagaaaagcattagagggggcagctggacaagctcccaactgcagagtcccagccctggctggggcagggccccggcctgggactcagcatttctgatatgccttaagaattcattctgttttgtacaattattttttaaaagtaaacgtgtggagaaagaa

SEQ ID NO: 108923 - DNA, 615 bp, Homo sapiens
  Payload ID: 1399
  Gene Symbol: ARRDC2
  Gene Name: arrestin domain containing 2
  ENST ID: ENST00000595712
  CDS Start-End: 598-615
gaggcaactcccgctggagaaactccatgcgacttttctttggggaaactgaagcccagagagaggtcacgccgtcccgtggccacaccgcagctgtggacctgggggtgcccgagcgtcccctgcattcagctctgtggcgggacgggggctgaggatgactggagcaggcacaagggctgcggggaagataccggggagaccacgacgctgcctcctgggcgccatgagttcctgttcagcttccagctgcccccgaccctggtgacatccttcgagggcaaacacggtagtgtccgctactgtatcaaggccaccctgcaccggccctgggtcccagcacgccgggcaaggaaggtgttcactgtcatcgagcctgtggacatcaacacgccagccctgctggcacctcaagcgggggctcgggaaaaggttgcccgatcctggtactgtaaccgtggcctagtctccctttcggccaagatcgaccgcaagggctacaccccaggagaggtcatccctgtctttgccgagatcgacaacggctccacacgtcctgtgctgcctcgggcagccgtggtgcagacacagacgttcatggcccgaggcgcccga

SEQ ID NO: 108924 - DNA, 1109 bp, Homo sapiens
  Payload ID: 1399
  Gene Symbol: ARRDC2
  Gene Name: arrestin domain containing 2
  ENST ID: ENST00000593560
  CDS Start-End: 144-1109
gggattttctgctccggttggtgagcgcgcctgcgcgttgacggcgattttgcgttctgaggctgcagcgtcggcatcttgagctgccggttcgcgagttcgaggccaggttccgcctgtcgtgggttcgcaccccggacgcgatgctattcgacaaggtgaaagcgttctcggtgcagttggacggcgcgaccgcgggcgtcgagcccgtgtttagcggcggccaggccgtggcgggccgggtgctgctggagctgtcaagcgccgcgcgtgtgggtgccctgaggctgcgcgcgcggggccgcgcccacgtgcactggaccgagtcgcgcagcgcgggctcgagcacggcttacacgcagagctacagtgaacgcgtggaggtcgtgagccaccgcgccacgctcctggcgccaggtacggatggaggacccctgctccaacaccagttgtgtgcctcccaccacctggacggcggtacctccgtcagccctgggaccccagcgcaaccgctcagtcgcctcctttttctcctacctgcagataccggggagaccacgacgctgcctcctgggcgccatgagttcctgttcagcttccagctgcccccgaccctggtgacatccttcgagggcaaacacggtagtgtccgctactgtatcaaggccaccctgcaccggccctgggtcccagcacgccgggcaaggaaggtgttcactgtcatcgagcctgtggacatcaacacgccagccctgctggcacctcaagcgggggctcgggaaaaggttgcccgatcctggtactgtaaccgtggcctagtctccctttcggccaagatcgaccgcaagggctacaccccaggagaggtcatccctgtctttgccgagatcgacaacggctccacacgtcctgtgctgcctcgggcagccgtggtgcagacacagacgttcatggcccgaggcgcccgaaagcagaaacgggcagtggtggccagcctcgcgggcgagccggtgggccccgggcagcgggcgctgtggcagggccgggcactgcggatccccccagtgggtccttccatcctgcactgccgcgttctacacgtggactac

SEQ ID NO: 108925 - DNA, 4188 bp, Homo sapiens
  Payload ID: 1400
  Gene Symbol: ARRDC3
  Gene Name: arrestin domain containing 3
  Uniprot ID: Q96B67
  ENST ID: ENST00000265138
  CDS Start-End: 268-1512
acaaagctgctcttaaagtgagctggcagcttttagccgcccgtctttgtaaggagaccactgagacgagcgggagcgcggagcagcagcctctgctgccctgactttttaagaaatctcaatgaactatttgtagagaatcactgatccggcctgcaagcattttgcacggcaaaaatatcgatcagtgttaagtgaagatcacattttatatgcgatcttgacttttttgtcttacattatatttttatagattttgttataaacatggtgctgggaaaggtgaagagtttgacaataagctttgactgtcttaatgacagcaatgtccctgtgtattctagtggggataccgtctcaggaagggtaaatttagaagttactggggaaatcagagtaaaatctcttaaaattcatgcaagaggacatgcgaaagtacgctggactgaatctagaaacgccggctccaatactgcctatacacagaattacactgaagaagtagagtatttcaaccataaagacatcttaattgggcacgaaagagatgatgataattccgaagaaggcttccacactattcattcaggaaggcatgaatatgcattcagcttcgagcttccacagacaccactcgctacctcattcgaaggccgacatggcagtgtgcgctattgggtgaaagccgaattgcacaggccttggctactaccagtaaaattaaagaaggaatttacagtctttgagcatatagatatcaacactccttcattactgtcaccccaagcaggcacaaaagaaaagacactctgttgctggttctgtacctcaggcccaatatccttaagtgccaaaattgaaaggaagggctataccccaggtgaatcaattcagatatttgctgagattgagaactgctcttcccgaatggtggtgccaaaggcagccatttaccaaacacaggccttctatgccaaagggaaaatgaaggaagtaaaacagcttgtggctaacttgcgtggggaatccttatcatctggaaagacagagacgtggaatggcaagttgctgaaaattccaccagtttctccctctatcctcgactgtagtataatccgcgtggaatattcactaatggtatatgtggatattcctggagctatggatttatttcttaatttgccacttgtcatcggtaccattcctctacatccatttggtagcagaacctcaagtgtaagcagtcagtgtagcatgaatatgaactggctcagtttatcacttcctgaaagacctgaagcaccacccagctatgcagaagtggtaacagaggaacaaaggcggaacaatcttgcaccagtgagtgcttgtgatgactttgagagagcccttcaaggaccactgtttgcatatatccaggagtttcgattcttgcctccacctctttattcagagattgatccaaatcctgatcagtcagcagatgatagaccatcctgcccctctcgttgaaggaacacttggttgaatcaagttgatgtgggttccgaactgtatctcttccggctgaggacagagaagtatcttggagacacgtttcagaggaagtggaattacttttgcccagaaaaatggcgaatacatgaaacaaccagtgatcatgctttagaagcctacagcaacattctgagactgctccaacatgcttgaagatctaagcttttctcttttaaaactggcacatactcagagcagtcttcttagcctatggtcgtacgtgtcaagacatcacgttgtaaagagggatgatttccttcttttgatttgaaaatttgcacatgctcaatgcttacattgtgcggttcgacgtcactacagcttctttttttttttttttttttttctatttttgccagactcttgatactcttaaaacttgtttgtggtcagcacaacaaggaacaaaacaaagctttgaaaaaactttaacatgaaaaaacgcactgacatttttttttatttaatatagcctggactttacctgcgtatgcacatgctcagaattgtctactaggctgactatgtatcacctcttcagcttggatccaattgtggatttatttacaaacatcaaatgccttcaagccaatcctttttgctgtatgttttgcagcctactgtagtagatacgcaacagataatgtgggaaaaaaagagataagaggaggaagctaataagagactgtcaagattgtataccttcttggtttcttttaagaatttgttgcctttctactattacagcaaagcagcattttgttactgactgcctaaaatcacttaatctcaggtgaacgcatcacttgccaaactgttggaatgctatttgtgttttgttgcactgtttttttcgtttgtttgtttgtttatttggttggctttttggagagggaaatttggaaacgggacatacacaaaagttacacacccacattccctttttatcatgacatacaagaagaaactagcagagctaagaatggagtgaagaaaggcagtatggcaggcaccagcaaagagttgagggctgttgctcttaaaaattattttttttattattattttgaaagtatggaagttttccattcactggggaaaggagggaaaagtgcatttatttttatacagagttacttaattacctccaaaacacatatgttggaaatcgcttttgctggtgcaaagtatattaatgagcaggaatacatacattgaggttatgaatagagagctcaatttgtacctttgctgtcttgctcaagcttggtatggcatgaaaactcgactttattccaaaagtaacttcaaaatttaaaatactagaacgtttgctgcgataaatcttttggatttttgtgtttttctaatgagaatactgtttttcattacctaaagaacaatttgctaaacatgagaaatcactcactttgattatgtatagattacataggaagaacaatcacatcagtaagttatagtttatattaaaggtaattttctgttggctcataacaaatataccagcattcatgatagcatttcagcattttccaaggtaccaagtgtacttattttgttgttgttgttgttgttgtattttagaaggaattcagctctgatgtttttaaagaaaaccagcatctctgatgttgcaacatacgtgtaaaatgggtgttacatctatcctgccatttaaccccacagttaataaagtggctgaaaataatagtagctctggcttggtgcttgacctggttaaatactgtcttaaagctcatacaaaacaaataggcttttccataagtggcctttaagaaaacatggaagacaattcatgtttgacaaatgctgacagggtgaagaaagcccagtgtaaaaatgaatcgcgttttaagtgattcggttaaagagtttgggctcccgtagcaaactaatactagataataaggaaatgggggtgaaatatttttttattgttgaatcattttgtgaatgtccccctcaaaaaaagctaatggaatatttggcataaagggcatttggtggttttatttttgtttgagggggattgtcagaaaatcccttttctctcttacgtctaactgactagggaacaattgttgatatgcatagcattggaatacttgtcattatatactcttacaaataacacatgaagcaagaatgaccaatattctgataattggcactggatcacaaaatgtgataaaactttaaatgtataaaactttatcaaataaagttttattttcccctttaaaatgtatttctttagaggcattacttttttaaaaatattggtcaattcctgacataagatgtgaggttcacagttgtattccagtattcaagatagattcctgatttttcaattaggaaaagtaaaatccaaaatgttagcaaaacaaagtgcaatattaaatgtttgctttatagattatattctatggctgtttgtaatttctctttttttccttttttatttggtgctgaatatgtccttgtaggctctgttttaagaaaacaatatgtgggaaatgatttaatttttcctattgctcttccttgtggaaaataaagtgttttgtttttttctgttttgtataa

SEQ ID NO: 108926 - DNA, 4072 bp, Homo sapiens
  Payload ID: 1401
  Gene Symbol: ARRDC4
  Gene Name: arrestin domain containing 4
  Uniprot ID: Q8NCT1
  ENST ID: ENST00000268042
  CDS Start-End: 165-1421
aaagcgacaggcctctcggcgagccggtgccccatcgggtaccgcacggctgccgcggcggccttaccctgccgcgagcgcctgtgacagcggcgccgctgtgctcgcgaccccggctccgggcctctgccgacctcaggggcaggaaagagtcgcccggcgggatgggcggggaggctgggtgcgcggcggccgtgggtgccgagggccgcgtgaagagcctgggtctggtgttcgaggacgagcgcaagggctgctattccagcggcgagacagtggccgggcacgtgctgctggaggcgtccgagccggtggccctgcgcgcgctgcgcctggaggcccaggggcgcgccaccgccgcctggggcccgagcacctgcccccgcgcctcggccagcaccgcggccctggctgtcttctcggaggtggagtacctgaacgtgcgcctcagcctgcgggagcccccggccggtgaaggcatcattttattacagcctggaaaacatgaatttccatttcgctttcaacttccatctgaacctttggtcacctcgtttactgggaaatatggaagcattcagtactgtgtgcgggcagtgttggaacgacccaaggtacctgatcagagtgtaaagcgggaactccaggttgttagtcatgtcgatgtcaacacaccagcattattaacccctgtattgaaaactcaagagaaaatggttggctgttggtttttcacttctggtccagtctcgctgagtgccaaaattgaaagaaagggatactgtaatggagaagctattccaatctatgcagaaatagaaaattgttcctctcgtctgattgttccaaaggctgctattttccaaacgcagacatatttggctagtggaaaaacaaagaccattcgacacatggtcgccaatgtgcgaggaaaccacatcgcttctgggagcacagacacatggaatgggaaaacgctaaaaatcccacctgttactccatccatcctggattgctgcattatcagagtggactattccttagctgtatacattcacattcctggtgctaaaaaattgatgctcgaactgccattagtgatcggtacaattccatataatggttttggcagcagaaactccagcattgccagccagttcagtatggatatgagctggttgacactgaccctgccagagcagcctgaagcaccaccaaattatgcagatgtggtatcagaggaagaattctctagacacattcctccttaccctcaaccccctaactgtgagggagaagtgtgctgtcctgtgtttgcctgtatacaagaattccggtttcaacccccacctctttattcagaggttgacccacatcctagcgacgtagaagagagccagcctgtttccttcattctctgaacgtatttcagaaatcactgtgttcatcatcaaattagaatgttggttcttttccttctgcctttttgggaaagagacaggaaagattcacttgaaaacataaatgaacgtcaagactgaaggcaatagaaattaaagaatgtgagaaagttctggtgggccggcaggattgccgcacaagtttatatgatggtcgtatatatatccctgttaaaaactgggatgaagatgtgcaaagtcacagaatgtaatggaagtcctgatggttacagagtaagtgaaagggtgcctgcgctgacgtgagagaaaggaatctgtaaacagtggaaacactgtgggagtttcccatggtgaagagtggaacgaaggcgatatgaactgaaggggtgaagacttgattttggagagggcaacaaaacaagggtgtgtgtgcataggagaatggcccactccaaatacgaagtgagatcctgagtctttgggtgcttcatgatttcctaccatattcaggcctaaagacattgaaaaagcatcttttcttgagatcatggtcatatgaggtcctaatgaagtactacagttttcattctttcaagggtagactaaaatatagtttataaatcggcagtacggtattatgaaaccaagaaagggtttcttgaaaagcttgtcggttcaaagaggaaagatgaatttcaatgtgaaaacacgttttgttgagggctgtactttttaccccctttaagtgctttaacaggatatacgtttgattttcctcatatcttatttacctaggagcatgtaagagaaagaagggagagaaaaggttgcatctgcaggatgccttgataactacacagtcccaaataaaaggcctttttctaacctacctctaatggggttatcagatatgtttttaaatctctcgccctgagtactcttcttgggagttgctgctgtttacagccacagtctcatctatcactaaatatgaaactgggccaaggggaaaattcagtaagttagcgttaaatggaagtaaatatatgtatacctaagagaatgtcaaaataaacaccaaaccaaaagaaggtaggagtgccatttttagaaaagacacaactttaattcctgtcaagagacctaggtctactgatggcagtcactgcattgtacattattccagttcttcagtaattctgtttaaactgtgattttctttattgtgttggtgcaatattttattatcatttaacctcaggatattcagaccaacaggattgtgttgctgctgaaagtctgagcagtgttttaccgtccccagcccccctcccacatggtcacatgttcacttgcttttccttccatctgttggttttgtgagctgagagcatctctggacacatggaagggagccagggattcctgtgatacagattttgaaccagcagagtactttggttttcttcatgtcctaagggtttgatccagaaaccctggtgcttcccctgcagaatactgtacttcatttaacagaatgattgatttttctttcaatcagcatgttcaccaaaaatagaaaagttcttctaaggttaaattttgtatttaaaagttagttggccatttgatcagggaattttctacacacattaggcaaatgtatgcttttcatcctctgggcttacctctctcctctgcaatcctggaagcatcgtgcatagttctttcattgtaagccgctatttaaattcccacaatgcaaaactgttagaccagtaattgtgctactgaaattgtcacaaaacgttattccttgatttggtttttaaattttgctttcgtgtgtgtgtctttaaacaggtaatgtgtatttaagtgttgtctaaacagttgatttttactttagaaaagatcatcttcaactgtttattgacttctgagttatatagttcatgccctgccaaggcattgttcgactccatgatactaaaacataatgaaagaaacaaactccagtatggagaagagaaagtttaattatttggttccatctagaaaagcaacaacttaaaggaatccttcactaggattgtcttatcacctttattagataaatcatgaagtgtccctgtgaaattgaagtgaaactatctctgtaggacttaagagaatagctaaaaggtgtgacttgccttattgaaatgatactggcatatctgactgtaagcagtaggttgaagatatcattttatgaatgtggagaattctacattgaaacagaaaatacctgggaatgaagattaaaaatgtagctgctgttatttgcttggttattcccctcttgctcttctttagtttgaaaaaacaaaaacgtggccttggaattttcattttgatgcagaaattttgaaattgaaaatgtgcatgttttggtgcacaaaatccttctgtgggcaaaactttgtttttgttttgcacagtaagaaacaataggcaagcgttatgtttttggtaagttaactatgaaagctttcttatttttattattaaaaatgtaacaatttaacccacaggaaaaaaaattactttgtatgcttgtttgaaccctatgggttcgttttattaataaaattattacactaatgcta

SEQ ID NO: 108927 - DNA, 1638 bp, Homo sapiens
  Payload ID: 1402
  Gene Symbol: ARRDC5
  Gene Name: arrestin domain containing 5
  Uniprot ID: A6NEK1
  ENST ID: ENST00000381781
  CDS Start-End: 1-1029
atgggggacagagaggaatgtctctctaccccccaaccccccatgtctgtggtgaagtcgatcgaattagtgctgcccgaggatagaatctacctggctggctccagcataaaagggcaggtgatcttaaccctgaacagcaccctggtggaccccatagtgaaggtggagctcgtgggaaggggttacgtcgaatggagtgaagaagccggggcatcctgtgattatagcagaaatgttatttgcaacaacaaggcagactacgtgcataagacaaagacattcccagtggaggataattggttaagtgcaggcagccacacctttgacttccatttcaacttacctcccaggcttccttctaccttcaccagcaaatttggccatgtcttctatttcgtacaagcttcctgcatgggcagggaacacattttagccaagaagaggatgtacttattggttcaaggaacttccaccttccacaaagaaaccccattccagaaccccttgttcgtggaggctgaggagaaagtctcctacaactgctgccgccagggcactgtctgtttgcaaatccagatggaaaggaacaccttcacgccaggagagaaggtcgtcttcacaacagagatcaacaaccagaccagcaaatgcatcaagacggtcgtattcgccctgtatgcccacatacagtacgagggcttcacgcccagtgcagagcggcggtctcggctggacagcagcgagcttctgaggcaggaggccaacacccccgtgacccgcttcaacaccaccaaggttgtcagcaccttcaacctgccgttgctgctgtccgtgagcagcagcacgcaggacggtgagatcatgcacactcgctacgagctggtcaccaccgtgcacctgccctggtccctgaccagcctcaaggccaaagttcccatcatcatcaccagcgcctcagtggactctgccatctgccagctgtcagaggacggagtgttacccgtgaacccagatcaccagaattaagtgcccgaacttttaaatattaaaagctttattagtctctaccaggaggaagccctctctcttgcacaggtgactctcagaggagtcgaggagtgggcaacaggttgtctgcaacctccccaagctctagcggtttaggtatctgtgtctcccctccctagaactatcactgaatgcctggaatggacaaaggaaaccgggaaggtctcccaggacccaaacccggcataacctgccttttccaccctgagtctgccccagcctactggggtctcacagtgccaagaccaggggtcctacttggggagaattctcccctctgctaatgtctggttgtattggctgtcacaactgcaggggatcgggggagaagagtcttattggcgtggagagggtggaggccagggacgctgttcagcaccctgcagtgtccaggacggcccccacaatcaggaattgtttatcctgaatgtcaacagtaccaagggggctgagcatggtggctcattcctgtaatcccaggactttaggaggccatggctggaggatcacttgagaccaggagtttgagacaagcctgggcaacactgtgagacccccatctctaca

SEQ ID NO: 108928 - DNA, 1895 bp, Homo sapiens
  Payload ID: 1403
  Gene Symbol: ARRB1
  Gene Name: arrestin, beta 1
  Uniprot ID: P49407
  ENST ID: ENST00000360025
  CDS Start-End: 99-1331
gggagccgggagcgggctggcccgcgctcctcctgctggctggggattttccagcctgggcgctgacgccgcggacctccctgcgaccgtcgcggaccatgggcgacaaagggacccgagtgttcaagaaggccagtccaaatggaaagctcaccgtctacctgggaaagcgggactttgtggaccacatcgacctcgtggaccctgtggatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggcttgcggtgtggactatgaagtcaaagccttctgcgcggagaatttggaggagaagatccacaagcggaattctgtgcgtctggtcatccggaaggttcagtatgccccagagaggcctggcccccagcccacagccgagaccaccaggcagttcctcatgtcggacaagcccttgcacctagaagcctctctggataaggagatctattaccatggagaacccatcagcgtcaacgtccacgtcaccaacaacaccaacaagacggtgaagaagatcaagatctcagtgcgccagtatgcagacatctgccttttcaacacagctcagtacaagtgccctgttgccatggaagaggctgatgacactgtggcacccagctcgacgttctgcaaggtctacacactgacccccttcctagccaataaccgagagaagcggggcctcgccttggacgggaagctcaagcacgaagacacgaacttggcctctagcaccctgttgagggaaggtgccaaccgtgagatcctggggatcattgtttcctacaaagtgaaagtgaagctggtggtgtctcggggcggcgacgtggccgtggaactgcccttcaccctaatgcaccccaagcccaaagaggaacccccgcatcgggaagttccagagaacgagacgccagtagataccaatctcatagaacttgacacaaatgatgacgacattgtatttgaggactttgctcgccagagactgaaaggcatgaaggatgacaaggaggaagaggaggatggtaccggctctccacagctcaacaacagatagacgggccggccctgcctccacgtggctccggctccactctcgtgcactcggatgcttactcgtcttcttcctgttctggtttcttttcccctttgttcttccagtttctaccagggggccccgtgggcttccagatcacggtgatgaacctctggcctcaggattggccccacatcaccacgccaacaggaccacagcgcactggctccaccccatctctgccatctccactcccctccttttcatgctgtctcccagaaaagctgccagggctctggccttggaattggacttgagatggggagcagacaggggaggatggggaatgtgggacacggtgtggtgggcatgagggcttggaggggtggggatgagggctcaagacacgagagaagatgtccacggtcccaggtggttaacaaagttctggcagctaaaagatgaccgcgttgaaggccacctccttctggctgggaggggcagaactgtggacagattctcaatgcctttttgaagttctgacccaccaaagaccttctgccttcaccctcctccccacctgat

SEQ ID NO: 108929 - DNA, 3336 bp, Homo sapiens
  Payload ID: 1403
  Gene Symbol: ARRB1
  Gene Name: arrestin, beta 1
  Uniprot ID: P49407
  ENST ID: ENST00000420843
  CDS Start-End: 99-1355
gggagccgggagcgggctggcccgcgctcctcctgctggctggggattttccagcctgggcgctgacgccgcggacctccctgcgaccgtcgcggaccatgggcgacaaagggacccgagtgttcaagaaggccagtccaaatggaaagctcaccgtctacctgggaaagcgggactttgtggaccacatcgacctcgtggaccctgtggatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggcttgcggtgtggactatgaagtcaaagccttctgcgcggagaatttggaggagaagatccacaagcggaattctgtgcgtctggtcatccggaaggttcagtatgccccagagaggcctggcccccagcccacagccgagaccaccaggcagttcctcatgtcggacaagcccttgcacctagaagcctctctggataaggagatctattaccatggagaacccatcagcgtcaacgtccacgtcaccaacaacaccaacaagacggtgaagaagatcaagatctcagtgcgccagtatgcagacatctgccttttcaacacagctcagtacaagtgccctgttgccatggaagaggctgatgacactgtggcacccagctcgacgttctgcaaggtctacacactgacccccttcctagccaataaccgagagaagcggggcctcgccttggacgggaagctcaagcacgaagacacgaacttggcctctagcaccctgttgagggaaggtgccaaccgtgagatcctggggatcattgtttcctacaaagtgaaagtgaagctggtggtgtctcggggcggcctgttgggagatcttgcatccagcgacgtggccgtggaactgcccttcaccctaatgcaccccaagcccaaagaggaacccccgcatcgggaagttccagagaacgagacgccagtagataccaatctcatagaacttgacacaaatgatgacgacattgtatttgaggactttgctcgccagagactgaaaggcatgaaggatgacaaggaggaagaggaggatggtaccggctctccacagctcaacaacagatagacgggccggccctgcctccacgtggctccggctccactctcgtgcactcggatgcttactcgtcttcttcctgttctggtttcttttcccctttgttcttccagtttctaccagggggccccgtgggcttccagatcacggtgatgaacctctggcctcaggattggccccacatcaccacgccaacaggaccacagcgcactggctccaccccatctctgccatctccactcccctccttttcatgctgtctcccagaaaagctgccagggctctggccttggaattggacttgagatggggagcagacaggggaggatggggaatgtgggacacggtgtggtgggcatgagggcttggaggggtggggatgagggctcaagacacgagagaagatgtccacggtcccaggtggttaacaaagttctggcagctaaaagatgaccgcgttgaaggccacctccttctggctgggaggggcagaactgtggacagattctcaatgcctttttgaagttctgacccaccaaagaccttctgccttcaccctcctccccacctgatgtccctctgtgtctgatagtgatgttggtgaaagttcgtagaccccaggagtagagaaaagcaactggactgactttcttaccagcagttacctagactgaggcaagctgtgtggactcacccaagtatatttcagtactgtcaggctgtgacatcttagctaccttgtatttcaagtgcatggccctgtctagagatatgcacagagagaaaagcagagggagggagggagggggtcttcagcaagcaccagcccccagcagagtgagctgaagctcctgaggagggttcccgaaggggggcgctcagagatgggggcagggggcggggagaggagagtctgccttatgtcccttccttgtggacttcacatggtcatgcaggaagtgaggatgggtgtccagcgggggccgaggccactagtatcctcctgcttccccctgccattctccagggctggactgaccctatggactgggagagagtgcctgaggccaccatgccacagtcaaagggggtcctatctcagaaggtggcagcatccactgagatatcctcacccgaagggaaggaggctgctgggtagcaaataagccccttcttttcttggtgagttgatgacctccaatagctcccagtgtcatgggtacccagtacgcattagctggtgttgggttgattgagacctggggcagttcctggggcaagaagccagatgggagatgagatagaaagtgttaggagttatcctctttgcctggcctttgagaataacttactgtgtgactttgggcaagttccttccccactctgggcctcagtttctcacttgggaaagcaaggagtttgaccagatgatcacaatgggccttcctagctctggccaccaagaatttgtgaacattagagctcctggtctggtgggtagagccagagctgctgactggtctctctgcctccagaggggatttattggacctcagaggtggcagggccctatggagcaccaactgccctcaaccccaccctgtgcccaagactgggaagggattgatgtcaggctgtggccataggtagcatgagttgcccaaggagggacagagcatatctttgctgaggcttggctgaggggcttatgatagggcttgcagtacctcacagccccctgtgggcacagacaccctgaggtttacccaggcaaatatattgattagcaggacaagggctctctcctcagtttctgctcccttccatctctctcccatacttgtctgaaaagggagacaaaaaatcttatacaagtggcatctcaatcctttccagtccagcacctcctggggcaggcagtgtgacttatttcctgtggtgaaatcacctgtttcacaagcctggcagcgcgacttctgagtctcatgac

SEQ ID NO: 108930 - DNA, 563 bp, Homo sapiens
  Payload ID: 1403
  Gene Symbol: ARRB1
  Gene Name: arrestin, beta 1
  ENST ID: ENST00000527385
  CDS Start-End: 1-218
gtgtctgccttccgctgccctgtaggtgctctggggaaacaacaccgacaccggggcctgtaccttctgcagagtgttcaagaaggccagtccaaatggaaagctcaccgtctacctgggaaagcgggactttgtggaccacatcgacctcgtggaccctgtggatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggcttgcggtgtggactatgaagtcaaagccttctgcgcggagaatttggaggagaagatccacaagcggaattctgtgcgtctggtcatccggaagg

SEQ ID NO: 108931 - DNA, 925 bp, Homo sapiens
  Payload ID: 1403
  Gene Symbol: ARRB1
  Gene Name: arrestin, beta 1
  ENST ID: ENST00000532525
  CDS Start-End: 153-925
gggagagctgagcctgcggggctggccctggcctggctgctgctgcctgcagcccccagctcaggctccctccacctcacagtccactgctttggcgctgcttctgggctggcctcttcactccactgaatctttgggctctcatctgtaaaatgggagtgttcaagaaggccagtccaaatggaaagctcaccgtctacctgggaaagcgggactttgtggaccacatcgacctcgtggaccctgtggatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggcttgcggtgtggactatgaagtcaaagccttctgcgcggagaatttggaggagaagatccacaagcggaattctgtgcgtctggtcatccggaaggttcagtatgccccagagaggcctggcccccagcccacagccgagaccaccaggcagttcctcatgtcggacaagcccttgcacctagaagcctctctggataaggagatctattaccatggagaacccatcagcgtcaacgtccacgtcaccaacaacaccaacaagacggtgaagaagatcaagatctcagtgcgccagtatgcagacatctgccttttcaacacagctcagtacaagtgccctgttgccatggaagaggctgatgacactgtggc

SEQ ID NO: 108932 - DNA, 593 bp, Homo sapiens
  Payload ID: 1403
  Gene Symbol: ARRB1
  Gene Name: arrestin, beta 1
  ENST ID: ENST00000524400
  CDS Start-End: 1-209
gtggaggaaggagaagggagaggccagcagcagccactgcaagagatgggagaggagaggccatggaaggagacttgcagcgggagaggctgagctcaccgtctacctgggaaagcgggactttgtggaccacatcgacctcgtggaccctgtggatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggcttgcggtgtggactatgaagtcaaagccttctgcgcggagaatttggaggagaagatccacaagcggaattctgtgcgtctggtcatccggaaggttcagtatgccccagagaggcctggcccccagcccacag

SEQ ID NO: 108933 - DNA, 559 bp, Homo sapiens
  Payload ID: 1403
  Gene Symbol: ARRB1
  Gene Name: arrestin, beta 1
  ENST ID: ENST00000533609
  CDS Start-End: 1-180
agccactgcaagagatgggagaggagaggccatggaaggagacttgcagcgggagaggctgagagtgttcaagaaggccagtccaaatggaaagctcaccgtctacctgggaaagcgggactttgtggaccacatcgacctcgtggaccctgtggatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggcttgcggtgtggactatgaagtcaaagccttctgcgcggagaatttggaggagaagatccacaagcggaattctgtgcgtctggtcatccggaaggttcag

SEQ ID NO: 108934 - DNA, 701 bp, Homo sapiens
  Payload ID: 1403
  Gene Symbol: ARRB1
  Gene Name: arrestin, beta 1
  ENST ID: ENST00000532447
  CDS Start-End: 1-586
gaggcctggcccccagcccacagccgagaccaccaggcagttcctcatgtcggacaagcccttgcacctagaagcctctctggataaggagatctattaccatggagaacccatcagcgtcaacgtccacgtcaccaacaacaccaacaagacggtgaagaagatcaagatctcagtgcgccagtatgcagacatctgccttttcaacacagctcagtacaagtgccctgttgccatggaagaggctgatgacactgtggcacccagctcgacgttctgcaaggtctacacactgacccccttcctagccaataaccgagagaagcggggcctcgccttggacgggaagctcaagcacgaagacacgaacttggcctctagcaccctgttgagggaaggtgccaaccgtgagatcctggggatcattgtttcctacaaagtgaaagtgaagctggtggtgtctcggggcggcgacgtggccgtggaactgcccttcaccctaatgcaccccaagcccaaagaggaacccccgcatcgggaagtgatgacgacattgtatttgaggactttgctcgccagagactgaaaggcatgaaggatgacaaggaggaagaggaggatggtaccggctctccacagctcaacaacagatagacgggccggccctgcctccacgtggctccggctccactctcgtgcac

SEQ ID NO: 108935 - DNA, 1895 bp, Homo sapiens
  Payload ID: 1404
  Gene Symbol: ARRB2
  Gene Name: arrestin, beta 2
  Uniprot ID: P32121
  ENST ID: ENST00000269260
  CDS Start-End: 234-1463
aatggccccgcgtgtctgctaggagagggcgggcagcgccgcggcgcgcgcgatccggctgacgcatctggccccggttccccaagaccagagcggggccgggagggagggggaagaggcgagagcgcggagggcgcgcgtgcgcattggcgcggggaggagcagggatcttggcagcgggcgaggaggctgcgagcgagccgcgaaccgagcgggcggcgggcgcgcgcaccatgggggagaaacccgggaccagggtcttcaagaagtcgagccctaactgcaagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctgtgagacagtacgccgacatctgcctcttcagcaccgcccagtacaagtgtcctgtggctcaactcgaacaagatgaccaggtatctcccagctccacattctgtaaggtgtacaccataaccccactgctcagcgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaa

SEQ ID NO: 108936 - DNA, 1769 bp, Homo sapiens
  Payload ID: 1404
  Gene Symbol: ARRB2
  Gene Name: arrestin, beta 2
  Uniprot ID: P32121
  ENST ID: ENST00000346341
  CDS Start-End: 89-1309
attggcgcggggaggagcagggatcttggcagcgggcgaggaggctgcgagcgagccgcgaaccgagcgggcggcgggcgcgcgcaccatgggggagaaacccgggaccagggtcttcaagaagtcgagccctaactgcaagctcaccgtgtacttgggcaagcgggacttcgtagatcacctggacaaagtggaccctgtagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctgtgagacagtacgccgacatctgcctcttcagcaccgcccagtacaagtgtcctgtggctcaactcgaacaagatgaccaggtatctcccagctccacattctgtaaggtgtacaccataaccccactgctcagcgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagcacccacccccacaccccctcttcccgtccccccagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagcatg

SEQ ID NO: 108937 - DNA, 1236 bp, Homo sapiens
  Payload ID: 1404
  Gene Symbol: ARRB2
  Gene Name: arrestin, beta 2
  Uniprot ID: P32121
  ENST ID: ENST00000381488
  CDS Start-End: 30-1214
gaaccgagcgggcggcgggcgcgcgcaccatgggggagaaacccgggaccagggtcttcaagaagtcgagccctaactgcaagctcaccgtgtacttgggcaagcgggacttcgtagatcacctggacaaagtggaccctgtagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctgtgagacagtacgccgacatctgcctcttcagcaccgcccagtacaagtgtcctgtggctcaactcgaacaagatgaccaggtatctcccagctccacattctgtaaggtgtacaccataaccccactgctcagcgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaaggga

SEQ ID NO: 108938 - DNA, 1779 bp, Homo sapiens
  Payload ID: 1404
  Gene Symbol: ARRB2
  Gene Name: arrestin, beta 2
  Uniprot ID: P32121
  ENST ID: ENST00000412477
  CDS Start-End: 30-1322
gaaccgagcgggcggcgggcgcgcgcaccatgggggagaaacccgggaccagggtcttcaagaagtcgagccctaactgcaagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccgtgaggatgcccctgccctctgagggccagggggctggggctgggactgtgtctggggtggggataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctgtgagacagtacgccgacatctgcctcttcagcaccgcccagtacaagtgtcctgtggctcaactcgaacaagatgaccaggtatctcccagctccacattctgtaaggtgtacaccataaccccactgctcagcgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagc

SEQ ID NO: 108939 - DNA, 709 bp, Homo sapiens
  Payload ID: 1404
  Gene Symbol: ARRB2
  Gene Name: arrestin, beta 2
  ENST ID: ENST00000574502
  CDS Start-End: 127-321
agggggaagaggcgagagcgcggagggcgcgcgtgcgcattggcgcggggaggagcagggatcttggcagcgggcgaggaggctgcgagcgagccgcgaaccgagcgggcggcgggcgcgcgcaccatgggggagaaacccgggaccagggtcttcaagaagtcgagccctaactgcaagctcaccgtgtacttgggcaagcgggacttcgtagatcacctggacaaagtggaccctgtagataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagtgagacagtacgccgacatctgcctcttcagcaccgcccagtacaagtgtcctgtggctcaactcgaacaagatgaccaggtatctcccagctccacattctgtaaggtgtacaccataaccccactgctcagcgacaaccgggagaagcggggtctcgccctggatgggaaactcaagcacgaggacaccaacctggcttcca

SEQ ID NO: 108940 - DNA, 432 bp, Homo sapiens
  Payload ID: 1404
  Gene Symbol: ARRB2
  Gene Name: arrestin, beta 2
  ENST ID: ENST00000572497
  CDS Start-End: 32-256
gcgaaccgagcgggcggcgggcgcgcgcaccatgggggagaaacccgggaccagggtcttcaagaagtcgagccctaactgcaagccccttgccgcagaggctgctcagcctgagccagccacagggctgggtggggcaggcttgggtccccaagcaagaccacagaggaggaggccaaaagcaagccatgtgcctgtagccctcctaggagccaacccaagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttc

SEQ ID NO: 108941 - DNA, 1659 bp, Homo sapiens
  Payload ID: 1404
  Gene Symbol: ARRB2
  Gene Name: arrestin, beta 2
  ENST ID: ENST00000571206
  CDS Start-End: 907-1560
acacacacaaacacacctcgctggttgggctgagtcctccctgaggacacacacagacacacatgcacatacatgttcacacacacacctgactggttggctgaggacacacacacacacacacacacacacacacaaacacacacacaccgggctggtgggcagaggtgtgcagagataaaggagcagctcaaaagcctaaaggtccactagtctgagaaacgccaccaccctcactttccaacactattgggaggaaacctggaacaactccttcctgatagcccagcctggagatccccgggcagggcagccagttttgagggctccgatgccctgtcaccatcctccccaatctcccctgtgaccccttgacatcctcagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctgtgagacagtacgccgacatctgcctcttcagcaccgcccagtacaagtgtcctgtggctcaactcgaacaagatgaccaggtatctcccagctccacattctgtaaggtgtacaccataaccccactgctcagcgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttccc

SEQ ID NO: 108942 - DNA, 991 bp, Homo sapiens
  Payload ID: 1404
  Gene Symbol: ARRB2
  Gene Name: arrestin, beta 2
  ENST ID: ENST00000576235
  CDS Start-End: 1-591
gggggagaaacccgggaccagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagtgagacagtacgccgacatctgcctcttcagcaccgcccagtacaagtgtcctgtggctcaactcgaacaagatgaccaggtatctcccagctccacattctgtaaggtgtacaccataaccccactgctcagcgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcgggtgagtgtcatgggggagcctgggtgggggtcacactggctctctctagtcccatgtcgtcgtcctcttcacgatgcctctccccttccccagggatgtctctgtgga

SEQ ID NO: 108943 - DNA, 1660 bp, Homo sapiens
  Payload ID: 1404
  Gene Symbol: ARRB2
  Gene Name: arrestin, beta 2
  ENST ID: ENST00000572457
  CDS Start-End: 564-1217
gggaggagcagggatcttggcagcgggcgaggaggctgcgagcgagccgcgaaccgagcgggcggcgggcgcgcgcaccatgggggagaaacccgggaccagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctgtgagacagtacgccgacatctgcctcttcagcaccgcccagtacaagtgtcctgtggctcaactcgaacaagatgaccaggtatctcccagctccacattctgtaaggtgtacaccataaccccactgctcagcgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataa

SEQ ID NO: 108944 - DNA, 864 bp, Homo sapiens
  Payload ID: 1404
  Gene Symbol: ARRB2
  Gene Name: arrestin, beta 2
  ENST ID: ENST00000571428
  CDS Start-End: 526-864
cgagcgggcggcgggcgcgcgcaccatgggggagaaacccgggaccagctcaccgtgtacttgggcaagcgggacttcgtagatcacctggacaaagtggaccctgtagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctgtgagacagtacgccgacatctgcctcttcagcaccgcccagtacaagtgtcctgtggctcaactcgaacaagatgaccaggtatctcccagctccacattctgtaaggtgtacaccataaccccactgctcagcgacaaccgggagaagcggggtctcgccctggatgggaaactcaagcacgaggacaccaacctggcttccagcacc

SEQ ID NO: 108945 - DNA, 1348 bp, Homo sapiens
  Payload ID: 1404
  Gene Symbol: ARRB2
  Gene Name: arrestin, beta 2
  ENST ID: ENST00000574954
  CDS Start-End: 638-1291
gcgcattggcgcggggaggagcagggatcttggcagcgggcgaggaggctgcgagcgagccgcgaaccgagcgggcggcgggcgcgcgcaccatgggggagaaacccgggaccagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctgtgagacagtacgccgacatctgcctcttcagcaccgcccagtacaagtgtcctgtggctcaactcgaacaagatgaccaggtatctcccagctccacattctgtaaggtgtacaccataaccccactgctcagcgacaaccgggagaagcggggtctcgccctggatgggaaactcaagcacgaggacaccaacctggcttccagcaccatcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaa

SEQ ID NO: 108946 - DNA, 1579 bp, Homo sapiens
  Payload ID: 1404
  Gene Symbol: ARRB2
  Gene Name: arrestin, beta 2
  ENST ID: ENST00000575877
  CDS Start-End: 24-1016
agcgggcggcgggcgcgcgcaccatgggggagaaacccgggaccagggtcttcaagaagtcgagccctaactgcaagctcaccgtgtacttgggcaagcgggacttcgtagatcacctggacaaagtggaccctgtagatggcgtggtgcttgtggaccctgactacctgaaggaccgcaaagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccataccccagaatcttccatgctccgtcacactgcagccaggcccagaggatacaggaaaggcctgcggcgtagactttgagattcgagccttctgtgctaaatcactagaagagaaaagccacaaaaggaactctgtgcggctggtgatccgaaaggtgcagttcgccccggagaaacccggcccccagccttcagccgaaaccacacgccacttcctcatgtctgaccggtccctgcacctcgaggcttccctggacaaggagctgtactaccatggggagcccctcaatgtaaatgtccacgtcaccaacaactccaccaagaccgtcaagaagatcaaagtctctgtgagacagtacgccgacatctgcctcttcagcaccgcccagtacaagtgtcctgtggctcaactcgaacaagatgaccagcgtgaaggagggtgccaacaaggaggtgctgggaatcctggtgtcctacagggtcaaggtgaagctggtggtgtctcgaggcggggatgtctctgtggagctgccttttgttcttatgcaccccaagccccacgaccacatccccctccccagaccccagtcagccgctccggagacagatgtccctgtggacaccaacctcattgaatttgataccaactatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagc

SEQ ID NO: 108947 - DNA, 1280 bp, Homo sapiens
  Payload ID: 1405
  Gene Symbol: ASNA1
  Gene Name: arsA arsenite transporter, ATP-binding, homolog 1 (bacterial)
  Uniprot ID: O43681
  ENST ID: ENST00000357332
  CDS Start-End: 15-1061
gagccagttccaaaatggcggcaggggtggccgggtggggggttgaggcagaggagttcgaagatgctcctgatgtggagccgctggagcctacacttagcaacatcatcgagcagcgcagcctgaagtggatcttcgtcgggggcaagggtggtgtgggcaagaccacctgcagctgcagcctggcagtccagctctccaaggggcgtgagagtgttctgatcatctccacagacccagcacacaacatctcagatgcttttgaccagaagttctcaaaggtgcctaccaaggtcaaaggctatgacaacctctttgctatggagattgaccccagcctgggcgtggcggagctgcctgacgagttcttcgaggaggacaacatgctgagcatgggcaagaagatgatgcaggaggccatgagcgcatttcccggcatcgatgaggccatgagctatgccgaggtcatgaggctggtgaagggcatgaacttctcggtggtggtatttgacacggcacccacgggccacaccctgaggctgctcaacttccccaccatcgtggagcggggcctgggccggcttatgcagatcaagaaccagatcagccctttcatctcacagatgtgcaacatgctgggcctgggggacatgaacgcagaccagctggcctccaagctggaggagacgctgcccgtcatccgctcagtcagcgaacagttcaaggaccctgagcagacaactttcatctgcgtatgcattgctgagttcctgtccctgtatgagacagagaggctgatccaggagctggccaagtgcaagattgacacacacaatataattgtcaaccagctcgtcttccccgaccccgagaagccctgcaagatgtgtgaggcccgtcacaagatccaggccaagtatctggaccagatggaggacctgtatgaagacttccacatcgtgaagctgccgctgttaccccatgaggtgcggggggcagacaaggtcaacaccttctcggccctcctcctggagccctacaagccccccagtgcccagtagcacagctgccagccccaaccgctgccatttcacactcaccctccaccctccccaccccctcggggcagagtttgcacaaagtcccccccataatacagggggagccacttgggcaggaggcagggaggggtccattccccctggtggggctggtggggagctgtagttgccccctacctctcccacctcttgctcttcaataaaatgatcttaaactgc

SEQ ID NO: 108948 - DNA, 1368 bp, Homo sapiens
  Payload ID: 1405
  Gene Symbol: ASNA1
  Gene Name: arsA arsenite transporter, ATP-binding, homolog 1 (bacterial)
  Uniprot ID: O43681
  ENST ID: ENST00000591090
  CDS Start-End: 103-1149
gtttggctggttgctaaggtgaggttggcgctaccggaacataagagtgattggtgttcttcgtatggtgcgctccgctggatcacgtgagccagttccaaaatggcggcaggggtggccgggtggggggttgaggcagaggagttcgaagatgctcctgatgtggagccgctggagcctacacttagcaacatcatcgagcagcgcagcctgaagtggatcttcgtcgggggcaagggtggtgtgggcaagaccacctgcagctgcagcctggcagtccagctctccaaggggcgtgagagtgttctgatcatctccacagacccagcacacaacatctcagatgcttttgaccagaagttctcaaaggtgcctaccaaggtcaaaggctatgacaacctctttgctatggagattgaccccagcctgggcgtggcggagctgcctgacgagttcttcgaggaggacaacatgctgagcatgggcaagaagatgatgcaggaggccatgagcgcatttcccggcatcgatgaggccatgagctatgccgaggtcatgaggctggtgaagggcatgaacttctcggtggtggtatttgacacggcacccacgggccacaccctgaggctgctcaacttccccaccatcgtggagcggggcctgggccggcttatgcagatcaagaaccagatcagccctttcatctcacagatgtgcaacatgctgggcctgggggacatgaacgcagaccagctggcctccaagctggaggagacgctgcccgtcatccgctcagtcagcgaacagttcaaggaccctgagcagacaactttcatctgcgtatgcattgctgagttcctgtccctgtatgagacagagaggctgatccaggagctggccaagtgcaagattgacacacacaatataattgtcaaccagctcgtcttccccgaccccgagaagccctgcaagatgtgtgaggcccgtcacaagatccaggccaagtatctggaccagatggaggacctgtatgaagacttccacatcgtgaagctgccgctgttaccccatgaggtgcggggggcagacaaggtcaacaccttctcggccctcctcctggagccctacaagccccccagtgcccagtagcacagctgccagccccaaccgctgccatttcacactcaccctccaccctccccaccccctcggggcagagtttgcacaaagtcccccccataatacagggggagccacttgggcaggaggcagggaggggtccattccccctggtggggctggtggggagctgtagttgccccctacctctcccacctcttgctcttcaataaaatgatcttaaactgc

SEQ ID NO: 108949 - DNA, 848 bp, Homo sapiens
  Payload ID: 1405
  Gene Symbol: ASNA1
  Gene Name: arsA arsenite transporter, ATP-binding, homolog 1 (bacterial)
  ENST ID: ENST00000586561
  CDS Start-End: 249-848
gggagtagcctagaccgtaccgatgtgttcattaggtagggggaacccttggaaaattatagaccagaggttgacaaagtgaaccctggaagcaaagaatagtgaaaatataatttatatttctcctaaaaggcaagtaatgaggaaattaactcatgctcctagcttcgctaggaatgtgatagagaatttcccctgtaggttcttcgtatggtgcgctccgctggatcacgtgagccagttccaaaatggcggcaggggtggccgggtggggggttgaggcagaggagttcgaagatgctcctgatgtggagccgctggagcctacacttagcaacatcatcgagcagcgcagcctgaagtggatcttcgtcgggggcaagggtggtgtgggcaagaccacctgcagctgcagcctggcagtccagctctccaaggggcgtgagagtgttctgatcatctccacagacccagcacacaacatctcagatgcttttgaccagaagttctcaaaggtgcctaccaaggtcaaaggctatgacaacctctttgctatggagattgaccccagcctgggcgtggcggagctgcctgacgagttcttcgaggaggacaacatgctgagcatgggcaagaagatgatgcaggaggccatgagcgcatttcccggcatcgatgaggccatgagctatgccgaggtcatgaggctggtgaagggcatgaacttctcggtggtggtatttgacacggcacccacgggccacaccctgaggctgctcaacttccccaccatcgtggagcggggcctgggccggcttatgcagatcaagaaccagatcagccctttc

SEQ ID NO: 108950 - DNA, 1214 bp, Homo sapiens
  Payload ID: 1405
  Gene Symbol: ASNA1
  Gene Name: arsA arsenite transporter, ATP-binding, homolog 1 (bacterial)
  ENST ID: ENST00000611688
  CDS Start-End: 1-996
atgctcgatgtggagccgctggagcctacacttagcaacatcatcgagcagcgcagcctgaagtggatcttcgtcgggggcaagggtggtgtgggcaagaccacctgcagctgcagcctggcagtccagctctccaaggggcgtgagagtgttctgatcatctccacagacccagcacacaacatctcagatgcttttgaccagaagttctcaaaggtgcctaccaaggtcaaaggctatgacaacctctttgctatggagattgaccccagcctgggcgtggcggagctgcctgacgagttcttcgaggaggacaacatgctgagcatgggcaagaagatgatgcaggaggccatgagcgcatttcccggcatcgatgaggccatgagctatgccgaggtcatgaggctggtgaagggcatgaacttctcggtggtggtatttgacacggcacccacgggccacaccctgaggctgctcaacttccccaccatcgtggagcggggcctgggccggcttatgcagatcaagaaccagatcagccctttcatctcacagatgtgcaacatgctgggcctgggggacatgaacgcagaccagctggcctccaagctggaggagacgctgcccgtcatccgctcagtcagcgaacagttcaaggaccctgagcagacaactttcatctgcgtatgcattgctgagttcctgtccctgtatgagacagagaggctgatccaggagctggccaagtgcaagattgacacacacaatataattgtcaaccagctcgtcttccccgaccccgagaagccctgcaagatgtgtgaggcccgtcacaagatccaggccaagtatctggaccagatggaggacctgtatgaagacttccacatcgtgaagctgccgctgttaccccatgaggtgcggggggcagacaaggtcaacaccttctcggccctcctcctggagccctacaagccccccagtgcccagtagcacagctgccagccccaaccgctgccatttcacactcaccctccaccctccccaccccctcggggcagagtttgcacaaagtcccccccataatacagggggagccacttgggcaggaggcagggaggggtccattccccctggtggggctggtggggagctgtagttgccccctacctctcccacctcttgctcttcaataaaatgatcttaaactg

SEQ ID NO: 108951 - DNA, 2404 bp, Homo sapiens
  Payload ID: 1406
  Gene Symbol: AS3MT
  Gene Name: arsenite methyltransferase
  Uniprot ID: Q9HBK9
  ENST ID: ENST00000369880
  CDS Start-End: 78-1205
gagacagtgagtgcgcgccctgagtcgcaggccgaggagacagtgagtgcgcgccctgagtcgcaggccgaggagacatggctgcacttcgtgacgctgagatacagaaggacgtgcagacctactacgggcaggtgctgaagagatcggcagacctccagaccaacggctgtgtcaccacagccaggccggtccccaagcacatccgggaagccttgcaaaatgtacacgaagaagtagccctaagatattatggctgtggtctggtgatccctgagcatctagaaaactgctggattttggatctgggtagtggaagtggcagagattgctatgtacttagccagctggttggtgaaaaaggacacgtgactggaatagacatgaccaaaggccaggtggaagtggctgaaaagtatcttgactatcacatggaaaaatatggcttccaggcatctaatgtgacttttattcatggctacattgagaagttgggagaggctggaatcaagaatgagagccatgatattgttgtatcaaactgtgttattaaccttgtgcctgataaacaacaagtgcttcaggaggcatatcgggtgctgaagcatggtggggagttatatttcagtgacgtctatacgagccttgaactgccagaagaaatcaggacacacaaagttttatggggtgagtgtctgggtggtgctttatactggaaggaacttgctgtccttgctcaaaaaattgggttctgccctccacgtttggtcactgccaatctcattacaattcaaaacaaggaactggaaagagttatcggtgactgtcgttttgtttctgcaacatttcgcctcttcaaacactctaagacaggaccaaccaagagatgccaagttatttacaatggaggaattacaggacatgaaaaagaactaatgtttgatgccaattttacatttaaggaaggtgaaattgttgaagtggatgaagaaacagcagctatcttgaagaattcaagatttgctcaagattttctgatcagaccaattggagagaagttgccaacatctggaggctgttctgctttggagttaaaggatataatcacagatccatttaagcttgcagaagagtctgacagtatgaagtccagatgtgtccctgatgctgctggaggctgctgtggcacaaagaaaagctgctaaatctatagccaaccaggggaccacagtagtgggcaagagtgatctgcatgttttttaacctgcttttccccatagcacagaccataagaaacaacaaatggggccgggcacagtggctcatgcctataatcccagcactttgggaggccgaggcaggcagatcacctgaggtcaggagtttgataccagcctggccaacatggtgaaatcctgtctctaccaaaaatacaaaaaaaattagctgggcatggtggtgcacacctatagtctcagctactcgggaggctgaggcaggagaattgcttgaacccaggaagtagaggctgcagtgagtaagcatcacgccactgtactccagcctgggcaacagagcaagactctgtctcaaaagcaaaaaaaaaaaaaaaaaaagaaagaaagaaaaagaaaacaacaaatggcagagagccaccatattccaaatcactgaaaaaaataaatgaattatttttatttatttatttatttttttgagatggagtctcggtctgttgcccaggctgaagtgcagtggccccatctcaactcactgcaagctccacctcctgggttcacgccattctcctgcctcagactcccaagtagctgggactacaggcacctaccaccatgcccagctaattttttgtatttttagtagagacggggtttcaccatgttagccaggatggtcttgatctcctgacctcgtgatccgcccgcctcggcctcccaaagtgctgggattacaagcatgagccactgcgcccggccataaatgaattatttttaagaggcattgattaaagattcacagcaaatcactagttaagcagattttttttctatttcctacttcaaagttctggtgccacatagtggtcagaaatggaacagagaagctgtcttaagccttgttcaagaagcaggaaaggcatcagaagaagtaacagttggcagagggtctcaggaaaaacatcttccttctgatcttttgcatagcaccttttggaattttcatcatgtttgcttattaaacaaagctcctactgccatcatactaatcatgcaaaaagattgccaaatcatgtttggtaggaggacttttgaggtagcttttgaacaaatgtttttttcttttttctttttttttgcaataaagaaaacaaattaatcataaa

SEQ ID NO: 108952 - DNA, 1723 bp, Homo sapiens
  Payload ID: 1406
  Gene Symbol: AS3MT
  Gene Name: arsenite methyltransferase
  ENST ID: ENST00000615257
  CDS Start-End: 78-1094
gagacagtgagtgcgcgccctgagtcgcaggccgaggagacagtgagtgcgcgccctgagtcgcaggccgaggagacatggctgcacttcgtgacgctgagatacagaaggacgtgcagacctactacgggcaggtgctgaagagatcggcagacctccagaccaacggctgtgtcaccacagccaggccggtccccaagcacatccgggaagccttgcaaaatgtacacgaagaagtagccctaagatattatggctgtggtctggtgatccctgagcatctagaaaactgctggattttggatctgggtagtggaagtggcagagattgctatgtacttagccagctggttggtgaaaaaggacacgtgactggaatagacatgaccaaaggccaggtggaagtggctgaaaagtatcttgactatcacatggaaaaatatggcttccaggcatctaatgtgacttttattcatggctacattgagaagttgggagaggctggaatcaagaatgagagccatgatattgttgtatcaaactgtgttattaaccttgtgcctgataaacaacaagtgcttcaggaggcatatcgggtgctgaagcatggtggggagttatatttcagtgacgtctatacgagccttgaactgccagaagaaatcaggacacacaaagttttatggggtgagtgtctgggtggtgctttatactggaaggaacttgctgtccttgctcaaaaaattgggttctgccctccacgtttggtcactgccaatctcattacaattcaaaacaaggaactggaaagagttatcggtgactgtcgttttgtttctgcaacatttcgcctcttcaaacactctaagacaggaccaaccaagagatgccaagttatttacaatggaggaattacaggacatgaaaaagaactaatgtttgatgccaattttacatttaaggaaggtgaaattgttgaagtggatgaagaaacagcagctatcttgaagaattcaagatttgctcaagattttctgatcagaccaattggagagaagttgccaacatctggagctgttctgctttggagttaaaggatataatcacagatccatttaagcttgcagaagagtctgacagtatgaagtccagatgtgtccctgatgctgctggaggctgctgtggcacaaagaaaagctgctaaatctatagccaaccaggggaccacagtagtgggcaagagtgatctgcatgttttttaacctgcttttccccatagcacagaccataagaaacaacaaatgagccactgcgcccggccataaatgaattatttttaagaggcattgattaaagattcacagcaaatcactagttaagcagattttttttctatttcctacttcaaagttctggtgccacatagtggtcagaaatggaacagagaagctgtcttaagccttgttcaagaagcaggaaaggcatcagaagaagtaacagttggcagagggtctcaggaaaaacatcttccttctgatcttttgcatagcaccttttggaattttcatcatgtttgcttattaaacaaagctcctactgccatcatactaatcatgcaaaaagattgccaaatcatgtttggtaggaggacttttgaggtagcttttgaacaaatgtttttttcttttttctttttttttgcaataaagaaaacaaattaatc

SEQ ID NO: 108953 - DNA, 1003 bp, Homo sapiens
  Payload ID: 1407
  Gene Symbol: ARTN
  Gene Name: artemin
  Uniprot ID: Q5T4W7
  ENST ID: ENST00000372354
  CDS Start-End: 299-961
ctctgagcttctctgagccttgtttgctcatctggaaaaaggggattaaaccatttacctcatggagttgtgaaagaatagctgcaaagcacctaacacatagtaaggttcccagtgcagctacttctgctgggttgagtctagctgtgtaggccccttgttcctcacctggagaaactggggtggcaggccggtcccccacaaaagataactcatctcttaatttgcaagctgcctcaacaggagggtgggggaacagctcaacaatggctgatgggcgctcctggtgttgatagagatggaacttggacttggaggcctctccacgctgtcccactgcccctggcctaggcagcagcctgccctgtggcccaccctggccgctctggctctgctgagcagcgtcgcagaggcctccctgggctccgcgccccgcagccctgccccccgcgaaggccccccgcctgtcctggcgtcccccgccggccacctgccggggggacgcacggcccgctggtgcagtggaagagcccggcggccgccgccgcagccttctcggcccgcgcccccgccgcctgcacccccatctgctcttccccgcgggggccgcgcggcgcgggctgggggcccgggcagccgcgctcgggcagcgggggcgcggggctgccgcctgcgctcgcagctggtgccggtgcgcgcgctcggcctgggccaccgctccgacgagctggtgcgtttccgcttctgcagcggctcctgccgccgcgcgcgctctccacacgacctcagcctggccagcctactgggcgccggggccctgcgaccgcccccgggctcccggcccgtcagccagccctgctgccgacccacgcgctacgaagcggtctccttcatggacgtcaacagcacctggagaaccgtggaccgcctctccgccaccgcctgcggctgcctgggctgagggctcgctccagggctttgcagactggacccttaccggtgg

SEQ ID NO: 108954 - DNA, 1921 bp, Homo sapiens
  Payload ID: 1407
  Gene Symbol: ARTN
  Gene Name: artemin
  Uniprot ID: Q5T4W7
  ENST ID: ENST00000372359
  CDS Start-End: 783-1445
actggccgctgagagaagaatcgggtggagcagagagcagctgctgcagggcagacagccggacccccaaatctgcacgtaccagcagtcagccgccccacgcagggaccggcttacccctcgctccccgccctcactcactttctcccgccctcggcccggcctcccagctctctacttcgcgagtctacaaactcaactcccggtttccgtgcctctccaccgctcgagttctctactctccatatccgaggggcccctcccagcatctacccccctcccaacctcgggggacctagccaagctaggggggactggatccgacgggtggagcagccaggtgagccccgaaaggtggggcggggcaggggcgctcccagccccaccccgggatctggtgacgctggggctggaatttgacaccggacggctgcggcggcgggcaggaggctgctgagggatggagttgggcccggcccccagacaaggcccgggggctccgccagcagcaggtccctcgggccccagccctcgctgccacccgggcctggagccccacacccgagggtgcagactggctgccaaggccacacttttggctaaaagaggcactgccaggtgtacagtcctgggcatgcgctgtttgagcttcgggggagagcccagcactggtccccggaaaggtgcctagaagaacaaggtgcaggaccccgtgctgcctcaacaggagggtgggggaacagctcaacaatggctgatgggcgctcctggtgttgatagagatggaacttggacttggaggcctctccacgctgtcccactgcccctggcctaggcagcagcctgccctgtggcccaccctggccgctctggctctgctgagcagcgtcgcagaggcctccctgggctccgcgccccgcagccctgccccccgcgaaggccccccgcctgtcctggcgtcccccgccggccacctgccggggggacgcacggcccgctggtgcagtggaagagcccggcggccgccgccgcagccttctcggcccgcgcccccgccgcctgcacccccatctgctcttccccgcgggggccgcgcggcgcgggctgggggcccgggcagccgcgctcgggcagcgggggcgcggggctgccgcctgcgctcgcagctggtgccggtgcgcgcgctcggcctgggccaccgctccgacgagctggtgcgtttccgcttctgcagcggctcctgccgccgcgcgcgctctccacacgacctcagcctggccagcctactgggcgccggggccctgcgaccgcccccgggctcccggcccgtcagccagccctgctgccgacccacgcgctacgaagcggtctccttcatggacgtcaacagcacctggagaaccgtggaccgcctctccgccaccgcctgcggctgcctgggctgagggctcgctccagggctttgcagactggacccttaccggtggctcttcctgcctgggaccctcccgcagagtcccactagccagcggcctcagccagggacgaaggcctcaaagctgagaggcccctgccggtgggtgatggatatcatccccgaacaggtgaagggacaactgactagcagccccagagccctcaccctgcggatcccagcctaaaagacaccagagacctcagctatggagcccttcggacccacttctcacagactctggcactggccaggcctcgaacctgggacccctcctctgatgaacactacagtggctgaggcatcagcccccgcccaggccctgtagggacagcatttgaaggacacatattgcagttgcttggttgaaagtgcctgtgctggaactggcctgtactcactcatgggagctggcccctatttattatttctaagttatttatttac

SEQ ID NO: 108955 - DNA, 1943 bp, Homo sapiens
  Payload ID: 1407
  Gene Symbol: ARTN
  Gene Name: artemin
  Uniprot ID: Q5T4W7
  ENST ID: ENST00000414809
  CDS Start-End: 783-1469
actggccgctgagagaagaatcgggtggagcagagagcagctgctgcagggcagacagccggacccccaaatctgcacgtaccagcagtcagccgccccacgcagggaccggcttacccctcgctccccgccctcactcactttctcccgccctcggcccggcctcccagctctctacttcgcgagtctacaaactcaactcccggtttccgtgcctctccaccgctcgagttctctactctccatatccgaggggcccctcccagcatctacccccctcccaacctcgggggacctagccaagctaggggggactggatccgacgggtggagcagccaggtgagccccgaaaggtggggcggggcaggggcgctcccagccccaccccgggatctggtgacgctggggctggaatttgacaccggacggctgcggcggcgggcaggaggctgctgagggatggagttgggcccggcccccagacaaggcccgggggctccgccagcagcaggtccctcgggccccagccctcgctgccacccgggcctggagccccacacccgagggtgcagactggctgccaaggccacacttttggctaaaagaggcactgccaggtgtacagtcctgggcatgcgctgtttgagcttcgggggagagcccagcactggtccccggaaaggtgcctagaagaacaaggtgcaggaccccgtgctgcctcaacaggagggtgggggaacagctcaacaatggctgatgggcgctcctggtgttgatagagatggaacttggacttggaggcctctccacgctgtcccactgcccctggcctaggcagcaggctccacttggtctctccgcgcagcctgccctgtggcccaccctggccgctctggctctgctgagcagcgtcgcagaggcctccctgggctccgcgccccgcagccctgccccccgcgaaggccccccgcctgtcctggcgtcccccgccggccacctgccggggggacgcacggcccgctggtgcagtggaagagcccggcggccgccgccgcagccttctcggcccgcgcccccgccgcctgcacccccatctgctcttccccgcgggggccgcgcggcgcgggctgggggcccgggcagccgcgctcgggcagcgggggcgcggggctgccgcctgcgctcgcagctggtgccggtgcgcgcgctcggcctgggccaccgctccgacgagctggtgcgtttccgcttctgcagcggctcctgccgccgcgcgcgctctccacacgacctcagcctggccagcctactgggcgccggggccctgcgaccgcccccgggctcccggcccgtcagccagccctgctgccgacccacgcgctacgaagcggtctccttcatggacgtcaacagcacctggagaaccgtggaccgcctctccgccaccgcctgcggctgcctgggctgagggctcgctccagggctttgcagactggacccttaccggtggctcttcctgcctgggaccctcccgcagagtcccactagccagcggcctcagccagggacgaaggcctcaaagctgagaggcccctgccggtgggtgatggatatcatccccgaacaggtgaagggacaactgactagcagccccagagccctcaccctgcggatcccagcctaaaagacaccagagacctcagctatggagcccttcggacccacttctcacagactctggcactggccaggcctcgaacctgggacccctcctctgatgaacactacagtggctgaggcatcagcccccgcccaggccctgtagggacagcatttgaaggacacatattgcagttgcttggttgaaagtgcctgtgctggaactggcctgtactcactcatgggagctggcccctatttattatttctaagttatttattt

SEQ ID NO: 108956 - DNA, 889 bp, Homo sapiens
  Payload ID: 1407
  Gene Symbol: ARTN
  Gene Name: artemin
  Uniprot ID: Q5T4W7
  ENST ID: ENST00000438616
  CDS Start-End: 176-889
aggtgtgggagggaaaatggtcagggagggaccaggtgaatgggaggaggagcgggacttctctgaatggtcggtgcactcaggtgattcctcccctgggctcccagaggcagcaaacccattatactggaacctaggcccttcctgagtttcccctccacacagctaggagcccatgcccggcctgatctcagcccgaggacagcccctccttgaggtccttcctccccaagcccacctgggtgccctctttctccctgaggctccacttggtctctccgcgcagcctgccctgtggcccaccctggccgctctggctctgctgagcagcgtcgcagaggcctccctgggctccgcgccccgcagccctgccccccgcgaaggccccccgcctgtcctggcgtcccccgccggccacctgccggggggacgcacggcccgctggtgcagtggaagagcccggcggccgccgccgcagccttctcggcccgcgcccccgccgcctgcacccccatctgctcttccccgcgggggccgcgcggcgcgggctgggggcccgggcagccgcgctcgggcagcgggggcgcggggctgccgcctgcgctcgcagctggtgccggtgcgcgcgctcggcctgggccaccgctccgacgagctggtgcgtttccgcttctgcagcggctcctgccgccgcgcgcgctctccacacgacctcagcctggccagcctactgggcgccggggccctgcgaccgcccccgggctcccggcccgtcagccagccctgctgccgacccacgcgctacgaagcggtctccttcatggacgtcaacagcacctggagaaccgtggaccgcctctccgccaccgcctgcggctgcctgggctga

SEQ ID NO: 108957 - DNA, 471 bp, Homo sapiens
  Payload ID: 1407
  Gene Symbol: ARTN
  Gene Name: artemin
  ENST ID: ENST00000479128
  CDS Start-End: 134-364
ttcgggggagagcccagcactggtccccggaaaggtgcctagaagaacaaggtgcaggaccccgtgctgcctcaacaggagggtgggggaacagctcaacaatggctgatgggcgctcctggtgttgatagagatggaacttggacttggaggcctctccacgctgtcccactgcccctggcctaggcagcaggctccacttggtctctccgcgcagcctgccctgtggcccaccctggccgctctggctctgctgagcagcgtcgcagaggcctccctgggctccgcgccccgcagccctgccccccgcgaaggccccccgcctgtcctggcgtcccccgccggccacctgccgggtaggtgagagggcgagggggcggggcggggctggcccgggacaccgcgcgtgactgggtctcattccagggggacgcacggcccgctggtgcagtggaagagcccggcggccgc

SEQ ID NO: 108958 - DNA, 477 bp, Homo sapiens
  Payload ID: 1407
  Gene Symbol: ARTN
  Gene Name: artemin
  ENST ID: ENST00000477048
  CDS Start-End: 279-477
tggggcggggcaggggcgctcccagccccaccccgggatctggtgacgctggggctggaatttgacaccggacggctgcggcggcgggcaggaggctgctgagggatggagttgggcccggcccccagacaaggcccgggggctccgccagcagcaggtccctcgggccccagccctcgctgccacccgggcctggagccccacacccgagctgcctcaacaggagggtgggggaacagctcaacaatggctgatgggcgctcctggtgttgatagagatggaacttggacttggaggcctctccacgctgtcccactgcccctggcctaggcagcagcctgccctgtggcccaccctggccgctctggctctgctgagcagcgtcgcagaggcctccctgggctccgcgccccgcagccctgccccccgcgaaggccccccgcctgtcctggcgtcccccgccggccacctgccgg

SEQ ID NO: 108959 - DNA, 485 bp, Homo sapiens
  Payload ID: 1407
  Gene Symbol: ARTN
  Gene Name: artemin
  ENST ID: ENST00000474592
  CDS Start-End: 218-485
gagggctcctaaggctgccctgcctgcctttccctccatcacggacaacagtcactggcctggctcggaggccttgattccacttagccaagaggcacacaccaggacctggaggacaaccccgggaaggcctgggggtctgttccacagctgcctcaacaggagggtgggggaacagctcaacaatggctgatgggcgctcctggtgttgatagagatggaacttggacttggaggcctctccacgctgtcccactgcccctggcctaggcagcaggctccacttggtctctccgcgcagcctgccctgtggcccaccctggccgctctggctctgctgagcagcgtcgcagaggcctccctgggctccgcgccccgcagccctgccccccgcgaaggccccccgcctgtcctggcgtcccccgccggccacctgccggggggacgcacggcccgctggtgcagtggaagagcccggcggccgc

SEQ ID NO: 108960 - DNA, 402 bp, Homo sapiens
  Payload ID: 1407
  Gene Symbol: ARTN
  Gene Name: artemin
  ENST ID: ENST00000472435
  CDS Start-End: 66-296
gggggagagcccagcactggtccccggaaaggtgcctagaagaacaaggtgcaggaccccgtgagatggaacttggacttggaggcctctccacgctgtcccactgcccctggcctaggcagcaggctccacttggtctctccgcgcagcctgccctgtggcccaccctggccgctctggctctgctgagcagcgtcgcagaggcctccctgggctccgcgccccgcagccctgccccccgcgaaggccccccgcctgtcctggcgtcccccgccggccacctgccgggtaggtgagagggcgagggggcggggcggggctggcccgggacaccgcgcgtgactgggtctcattccagggggacgcacggcccgctggtgcagtggaagagcccggcggccg

SEQ ID NO: 108961 - DNA, 517 bp, Homo sapiens
  Payload ID: 1407
  Gene Symbol: ARTN
  Gene Name: artemin
  ENST ID: ENST00000471394
  CDS Start-End: 319-517
gacgctggggctggaatttgacaccggacggctgcggcggcgggcaggaggctgctgagggatggagttgggcccggcccccagacaaggcccgggggctccgccagcagcaggtccctcgggccccagccctcgctgccacccgggcctggagccccacacccgagggtgcagactggctgccaaggccacacttttggctaaaagaggcactgccaggtgtacagtcctgggcatgcgctgtttgagcttcgggggagagcccagcactggtccccggaaaggtgcctagaagaacaaggtgcaggaccccgtgagatggaacttggacttggaggcctctccacgctgtcccactgcccctggcctaggcagcagcctgccctgtggcccaccctggccgctctggctctgctgagcagcgtcgcagaggcctccctgggctccgcgccccgcagccctgccccccgcgaaggccccccgcctgtcctggcgtcccccgccggccacctgccgg

SEQ ID NO: 108962 - DNA, 524 bp, Homo sapiens
  Payload ID: 1407
  Gene Symbol: ARTN
  Gene Name: artemin
  ENST ID: ENST00000491846
  CDS Start-End: 257-524
agccctcgctgccacccgggcctggagccccacacccgagggtgcagactggctgccaaggccacacttttggctaaaagaggcactgccaggtgtacagtcctgggcatgcgctgtttgagcttcgggggagagcccagcactggtccccggaaaggtgcctagaagaacaaggtgcaggaccccgtgctgcctcaacaggagggtgggggaacagctcaacaatggctgatgggcgctcctggtgttgatagagatggaacttggacttggaggcctctccacgctgtcccactgcccctggcctaggcagcaggctccacttggtctctccgcgcagcctgccctgtggcccaccctggccgctctggctctgctgagcagcgtcgcagaggcctccctgggctccgcgccccgcagccctgccccccgcgaaggccccccgcctgtcctggcgtcccccgccggccacctgccggggggacgcacggcccgctggtgcagtggaagagcccggcggccgc

SEQ ID NO: 108963 - DNA, 1303 bp, Homo sapiens
  Payload ID: 1407
  Gene Symbol: ARTN
  Gene Name: artemin
  Uniprot ID: Q5T4W7
  ENST ID: ENST00000498139
  CDS Start-End: 142-828
gggggctccgccagcagcaggtccctcgggccccagccctcgctgccacccgggcctggagccccacacccgagctgcctcaacaggagggtgggggaacagctcaacaatggctgatgggcgctcctggtgttgatagagatggaacttggacttggaggcctctccacgctgtcccactgcccctggcctaggcagcaggctccacttggtctctccgcgcagcctgccctgtggcccaccctggccgctctggctctgctgagcagcgtcgcagaggcctccctgggctccgcgccccgcagccctgccccccgcgaaggccccccgcctgtcctggcgtcccccgccggccacctgccggggggacgcacggcccgctggtgcagtggaagagcccggcggccgccgccgcagccttctcggcccgcgcccccgccgcctgcacccccatctgctcttccccgcgggggccgcgcggcgcgggctgggggcccgggcagccgcgctcgggcagcgggggcgcggggctgccgcctgcgctcgcagctggtgccggtgcgcgcgctcggcctgggccaccgctccgacgagctggtgcgtttccgcttctgcagcggctcctgccgccgcgcgcgctctccacacgacctcagcctggccagcctactgggcgccggggccctgcgaccgcccccgggctcccggcccgtcagccagccctgctgccgacccacgcgctacgaagcggtctccttcatggacgtcaacagcacctggagaaccgtggaccgcctctccgccaccgcctgcggctgcctgggctgagggctcgctccagggctttgcagactggacccttaccggtggctcttcctgcctgggaccctcccgcagagtcccactagccagcggcctcagccagggacgaaggcctcaaagctgagaggcccctgccggtgggtgatggatatcatccccgaacaggtgaagggacaactgactagcagccccagagccctcaccctgcggatcccagcctaaaagacaccagagacctcagctatggagcccttcggacccacttctcacagactctggcactggccaggcctcgaacctgggacccctcctctgatgaacactacagtggctgaggcatcagcccccgcccaggccctgtagggacagcatttgaaggacacatattgcagttgcttggttgaaagtgcctgtgctggaactggcctgtactcactcatgggagctggcccctatttattatttctaagttatttattta

SEQ ID NO: 108964 - DNA, 1335 bp, Homo sapiens
  Payload ID: 1408
  Gene Symbol: ARV1
  Gene Name: ARV1 homolog, fatty acid homeostasis modulator
  Uniprot ID: Q9H2C2
  ENST ID: ENST00000310256
  CDS Start-End: 58-873
gcgtctgacgtcttaccctccacagaatcggaagttctggactgcagttgagtggaaatgggcaacggcgggcggagcggcctgcagcaggggaaggggaacgtggatggggtggcagcgactcctactgctgcctcggcctcctgccagtacaggtgcatcgaatgcaaccaggaggccaaagagttgtaccgagactataaccacggtgtgctgaagataaccatctgtaaatcctgccagaaacctgtagacaaatatatcgagtatgatcctgttatcatcttgattaatgctatattgtgcaaagctcaggcctacagacatattcttttcaatactcaaataaatatccatggaaaactctgcatattttgtttgctttgtgaagcatacctgaggtggtggcagcttcaagattccaaccagaatactgcccctgatgacttgatcagatatgctaaggaatgggatttctatagaatgtttgcgattgctgctttagaacaaactgcctattttattggcatttttaccttcctgtgggtagaacggcccatgacggcaaaaaaaaagcccaacttcattttgctgctgaaagcattattattatctagctacggaaaactcttgctgattccagctgtcatttgggaacatgactacacatctgtgtgcctcaaactcattaaagtatttgttcttacatcaaattttcaggcaattagagtgaccctaaacatcaaccgtaagctctccttcttggccgtgttgagtggcttactgctggaaagcatcatggtctacttcttccagagtatggaatgggatgttggaagtgattatgccatctttaaatctcaggacttctgaagagttttattcttcttcactatctgtggcatgaccagctgtatctgaaagagaaaagacatgaaatataaaccaacctcctcatttctgttgagtaaaatgaagcaaagattggaaacactttctgaaaaagaaagcaatgataatagcggtggatacccacccccacaaatgcacccaagagacaagccatttacatacagatattcacagtcacacatagaaacacccacatggacacaaggaatgttgctgcagagactgaatgacatgcaacaggtgaaggtttatacgttatacacaaggccaggtaagcgctcataattcacacataataaaacatctaggtttcattcctttgacatgtttatatctttttaatttaaatgttgttactggcttaaaatattttgtgttcttacaatagaaacgcttttaataaagtctttcagaataaaccaa

SEQ ID NO: 108965 - DNA, 1170 bp, Homo sapiens
  Payload ID: 1408
  Gene Symbol: ARV1
  Gene Name: ARV1 homolog, fatty acid homeostasis modulator
  ENST ID: ENST00000366658
  CDS Start-End: 13-708
agttgagtggaaatgggcaacggcgggcggagcggcctgcagcaggggaaggggaacgtggatggggtggcagcgactcctactgctgcctcggcctcctgccagtacaggtgcatcgaatgcaaccaggaggccaaagagttgtaccgagactataaccacggtgtgctgaagataaccatctgtatccatggaaaactctgcatattttgtttgctttgtgaagcatacctgaggtggtggcagcttcaagattccaaccagaatactgcccctgatgacttgatcagatatgctaaggaatgggatttctatagaatgtttgcgattgctgctttagaacaaactgcctattttattggcatttttaccttcctgtgggtagaacggcccatgacggcaaaaaaaaagcccaacttcattttgctgctgaaagcattattattatctagctacggaaaactcttgctgattccagctgtcatttgggaacatgactacacatctgtgtgcctcaaactcattaaagtatttgttcttacatcaaattttcaggcaattagagtgaccctaaacatcaaccgtaagctctccttcttggccgtgttgagtggcttactgctggaaagcatcatggtctacttcttccagagtatggaatgggatgttggaagtgattatgccatctttaaatctcaggacttctgaagagttttattcttcttcactatctgtggcatgaccagctgtatctgaaagagaaaagacatgaaatataaaccaacctcctcatttctgttgagtaaaatgaagcaaagattggaaacactttctgaaaaagaaagcaatgataatagcggtggatacccacccccacaaatgcacccaagagacaagccatttacatacagatattcacagtcacacatagaaacacccacatggacacaaggaatgttgctgcagagactgaatgacatgcaacaggtgaaggtttatacgttatacacaaggccaggtaagcgctcataattcacacataataaaacatctaggtttcattcctttgacatgtttatatctttttaatttaaatgttgttactggcttaaaatattttgtgttcttacaatagaaacgcttttaataaagtctttcagaataaaccaa

SEQ ID NO: 108966 - DNA, 879 bp, Homo sapiens
  Payload ID: 1408
  Gene Symbol: ARV1
  Gene Name: ARV1 homolog, fatty acid homeostasis modulator
  ENST ID: ENST00000435927
  CDS Start-End: 1-875
ggaacgtggatggggtggcagcgactcctactgctgcctcggcctcctgccagtacaggtgcatcgaatgcaaccaggaggccaaagagttgtaccgagactataaccacggtgtgctgaagataaccatctgtaaatcctgccagaaacctgtagacaaatatatcgagtatgatcctgttatcatcttgattaatgctatattgtgcaaagctcaggcctacagacatattcttttcaatactcaaataaatatccatggaaaactctgcatattttgtttgctttgtgaagcatacctgaggtggtggcagcttcaagattccaaccagaatactgcccctgatgacttgatcagatatgctaaggaatgggatttctatagaatgtttgcgattgctgctttaggctggagtgcagtggcacagtcacagctcactgcagccctgaactcctgggctcaagcaatcctcctgcctcggcccccccaggtagctggaaccacagaacaaactgcctattttattggcatttttaccttcctgtgggtagaacggcccatgacggcaaaaaaaaagcccaacttcattttgctgctgaaagcattattattatctagctacggaaaactcttgctgattccagctgtcatttgggaacatgactacacatctgtgtgcctcaaactcattaaagtatttgttcttacatcaaattttcaggcaattagagtgaccctaaacatcaaccgtaagctctccttcttggccgtgttgagtggcttactgctggaaagcatcatggtctacttcttccagagtatggaatgggatgttggaagtgattatgccatctttaaatctcaggacttctgaagag

SEQ ID NO: 108967 - DNA, 991 bp, Homo sapiens
  Payload ID: 1408
  Gene Symbol: ARV1
  Gene Name: ARV1 homolog, fatty acid homeostasis modulator
  ENST ID: ENST00000450711
  CDS Start-End: 1-806
gcgggcggagcggcctgcagcaggggaaggggaacgtggatggggtggcagcgactcctactgctgcctcggcctcctgccagtacaggtgcatcgaatgcaaccaggaggccaaagagttgtaccgagactataaccacggtgtgctgaagataaccatctgtaaatcctgccagaaacctgtagacaaatatatcgagtatgatcctgttatcatcttgattaatgctatattgtgcaaagctcaggcctacagacatattcttttcaatactcaaataaatatccatggaaaactctgcatattttgtttgctttgtgaagcatacctgaggtggtggcagcttcaagattccaaccagaatactgcccctgatgacttgatcagatatgctaaggaatgggatttctatagaatgtttgcgattgctgctttagaacaaactgcctattttattggcatttttaccttcctgtgggtagaacggcccatgacggcaaaaaaaaagcccaacttcattttgctgctgaaagcattattattatctagctacggaaaactcttgctgattccagctgtcatttgggaacatgactacacatctgtgtgcctcaaactcattaaagtatttgttcttacatcaaattttcaggcaattagagtgaccctaaacatcaaccgtaagctctccttcttggccgtgttgagtggcttactgctggaaagcatcatggtctacttcttccagagtatggaatgggatgttggaagtgattatgccatctttaaatctcaggacttctgaagaggtcctgcagtgcccttgtctccacctaaccagatacggtcagctttgcctctccatggaataagtgaagactttccaaaaactccagtttgcagtgcttactttttccgttgacctccgagtgctcagcttaacacctacagcagtcacgtgcccaagaacttctgacattgccccagggt

SEQ ID NO: 108968 - DNA, 1009 bp, Homo sapiens
  Payload ID: 1408
  Gene Symbol: ARV1
  Gene Name: ARV1 homolog, fatty acid homeostasis modulator
  ENST ID: ENST00000459891
  CDS Start-End: 1-368
aacaaactgcctattttattggcatttttaccttcctgtgggtagaacggcccatgacggcaaaaaaaaagcccaacttcattttgctgctgaaagcattattattatctagctacggaaaactcttgctgattccagctgtcatttgggaacatgactacacatctgtgtgcctcaaactcattaaagtatttgttcttacatcaaattttcaggcaattagagtgaccctaaacatcaaccgtaagctctccttcttggccgtgttgagtggcttactgctggaaagcatcatggtctacttcttccagagtatggaatgggatgttggaagtgattatgccatctttaaatctcaggacttctgaagaggtcctgcagtgcccttgtctccacctaaccagatacggtcagctttgcctctccatggaataagtgaagactttccaaaaactccagtttgcagtgcttactttttccgttgacctccgagtgctcagcttaacacctacagcagtcacgtgcccaagaacttctgacattgccccaggttttattcttcttcactatctgtggcatgaccagctgtatctgaaagagaaaagacatgaaatataaaccaacctcctcatttctgttgagtaaaatgaagcaaagattggaaacactttctgaaaaagaaagcaatgataatagcggtggatacccacccccacaaatgcacccaagagacaagccatttacatacagatattcacagtcacacatagaaacacccacatggacacaaggaatgttgctgcagagactgaatgacatgcaacaggtgaaggtttatacgttatacacaaggccaggtaagcgctcataattcacacataataaaacatctaggtttcattcctttgacatgtttatatctttttaatttaaatgttgttactggcttaaaatattttgtgttcttacaatagaaacgcttttaataaagtctttcagaataaaccaa

SEQ ID NO: 108969 - DNA, 1037 bp, Homo sapiens
  Payload ID: 1408
  Gene Symbol: ARV1
  Gene Name: ARV1 homolog, fatty acid homeostasis modulator
  ENST ID: ENST00000480519
  CDS Start-End: 45-788
caacggcgggcggagcggcctgcagcaggggaaggggaacgtggatggggtggcagcgactcctactgctgcctcggcctcctgccagtacaggtgcatcgaatgcaaccaggaggccaaagagttgtaccgagactataaccacgaaatcctgccagaaacctgtagacaaatatatcgagtatgatcctgttatcatcttgattaatgctatattgtgcaaagctcaggcctacagacatattcttttcaatactcaaataaatatccatggaaaactctgcatattttgtttgctttgtgaagcatacctgaggtggtggcagcttcaagattccaaccagaatactgcccctgatgacttgatcagatatgctaaggaatgggatttctatagaatgtttgcgattgctgctttagaacaaactgcctattttattggcatttttaccttcctgtgggtagaacggcccatgacggcaaaaaaaaagcccaacttcattttgctgctgaaagcattattattatctagctacggaaaactcttgctgattccagctgtcatttgggaacatgactacacatctgtgtgcctcaaactcattaaagtatttgttcttacatcaaattttcaggcaattagagtgaccctaaacatcaaccgtaagctctccttcttggccgtgttgagtggcttactgctggaaagcatcatggtctacttcttccagagtatggaatgggatgttggaagtgattatgccatctttaaatctcaggacttctgaagaggtcctgcagtgcccttgtctccacctaaccagatacggtcagctttgcctctccatggaataagtgaagactttccaaaaactccagtttgcagtgcttactttttccgttgacctccgagtgctcagcttaacacctacagcagtcacgtgcccaagaacttctgacattgccccagggtcagatcttttgtttctacttttcataagtgcatctgcttgtctgacaatcaattataatttata

SEQ ID NO: 108970 - DNA, 6276 bp, Homo sapiens
  Payload ID: 1409
  Gene Symbol: AHR
  Gene Name: aryl hydrocarbon receptor
  Uniprot ID: P35869
  ENST ID: ENST00000242057
  CDS Start-End: 644-3190
attcagccggtgcgcgcggcggcgggaggcagtggctggggagtcccgtcgacgctctgttccgagagcgtgccccggaccgccagctcagaacaggggcagccgtgtagccgaacggaagctgggagcagccgggactggtggcccgcgcccgagctccgcaggcgggaagcaccctggatttaggaagtcccgggagcagcgcggcggcacctccctcacccaaggggccgcggcgacggtcacggggcgcggcgccaccgtgagcgacccaggccaggattctaaatagacggcccaggctcctcctccgcccgggccgcctcacctgcgggcattgccgcgccgcctccgccggtgtagacggcacctgcgccgccttgctcgcgggtctccgcccctcgcccaccctcactgcgccaggcccaggcagctcacctgtactggcgcgggctgcggaagcctgcgtgagccgaggcgttgaggcgcggcgcccacgccactgtcccgagaggacgcaggtggagcgggcgcggcttcgcggaacccggcgccggccgccgcagtggtcccagcctacaccgggttccggggacccggccgccagtgcccggggagtagccgccgccgtcggctgggcaccatgaacagcagcagcgccaacatcacctacgccagtcgcaagcggcggaagccggtgcagaaaacagtaaagccaatcccagctgaaggaatcaagtcaaatccttccaagcggcatagagaccgacttaatacagagttggaccgtttggctagcctgctgcctttcccacaagatgttattaataagttggacaaactttcagttcttaggctcagcgtcagttacctgagagccaagagcttctttgatgttgcattaaaatcctcccctactgaaagaaacggaggccaggataactgtagagcagcaaatttcagagaaggcctgaacttacaagaaggagaattcttattacaggctctgaatggctttgtattagttgtcactacagatgctttggtcttttatgcttcttctactatacaagattatctagggtttcagcagtctgatgtcatacatcagagtgtatatgaacttatccataccgaagaccgagctgaatttcagcgtcagctacactgggcattaaatccttctcagtgtacagagtctggacaaggaattgaagaagccactggtctcccccagacagtagtctgttataacccagaccagattcctccagaaaactctcctttaatggagaggtgcttcatatgtcgtctaaggtgtctgctggataattcatctggttttctggcaatgaatttccaagggaagttaaagtatcttcatggacagaaaaagaaagggaaagatggatcaatacttccacctcagttggctttgtttgcgatagctactccacttcagccaccatccatacttgaaatccggaccaaaaattttatctttagaaccaaacacaaactagacttcacacctattggttgtgatgccaaaggaagaattgttttaggatatactgaagcagagctgtgcacgagaggctcaggttatcagtttattcatgcagctgatatgctttattgtgccgagtcccatatccgaatgattaagactggagaaagtggcatgatagttttccggcttcttacaaaaaacaaccgatggacttgggtccagtctaatgcacgcctgctttataaaaatggaagaccagattatatcattgtaactcagagaccactaacagatgaggaaggaacagagcatttacgaaaacgaaatacgaagttgccttttatgtttaccactggagaagctgtgttgtatgaggcaaccaacccttttcctgccataatggatcccttaccactaaggactaaaaatggcactagtggaaaagactctgctaccacatccactctaagcaaggactctctcaatcctagttccctcctggctgccatgatgcaacaagatgagtctatttatctctatcctgcttcaagtacttcaagtactgcaccttttgaaaacaactttttcaacgaatctatgaatgaatgcagaaattggcaagataatactgcaccgatgggaaatgatactatcctgaaacatgagcaaattgaccagcctcaggatgtgaactcatttgctggaggtcacccagggctctttcaagatagtaaaaacagtgacttgtacagcataatgaaaaacctaggcattgattttgaagacatcagacacatgcagaatgaaaaatttttcagaaatgatttttctggtgaggttgacttcagagacattgacttaacggatgaaatcctgacgtatgtccaagattctttaagtaagtctcccttcataccttcagattatcaacagcaacagtccttggctctgaactcaagctgtatggtacaggaacacctacatctagaacagcaacagcaacatcaccaaaagcaagtagtagtggagccacagcaacagctgtgtcagaagatgaagcacatgcaagttaatggcatgtttgaaaattggaactctaaccaattcgtgcctttcaattgtccacagcaagacccacaacaatataatgtctttacagacttacatgggatcagtcaagagttcccctacaaatctgaaatggattctatgccttatacacagaactttatttcctgtaatcagcctgtattaccacaacattccaaatgtacagagctggactaccctatggggagttttgaaccatccccataccccactacttctagtttagaagattttgtcacttgtttacaacttcctgaaaaccaaaagcatggattaaatccacagtcagccataataactcctcagacatgttatgctggggccgtgtcgatgtatcagtgccagccagaacctcagcacacccacgtgggtcagatgcagtacaatccagtactgccaggccaacaggcatttttaaacaagtttcagaatggagttttaaatgaaacatatccagctgaattaaataacataaataacactcagactaccacacatcttcagccacttcatcatccgtcagaagccagaccttttcctgatttgacatccagtggattcctgtaattccaagcccaattttgaccctggtttttggattaaattagtttgtgaaggattatggaaaaataaaactgtcactgttggacgtcagcaagttcacatggaggcattgatgcatgctattcacaattattccaaaccaaattttaatttttgcttttagaaaagggagtttaaaaatggtatcaaaattacatatactacagtcaagatagaaagggtgctgccacggagtggtgaggtaccgtctacatttcacattattctgggcaccacaaaatatacaaaactttatcagggaaactaagattcttttaaattagaaaatattctctatttgaattatttctgtcacagtaaaaataaaatactttgagttttgagctactggattcttattagttccccaaatacaaagttagagaactaaactagtttttcctatcatgttaacctctgcttttatctcagatgttaaaataaatggtttggtgctttttataaaaagataatctcagtgctttcctccttcactgtttcatctaagtgcctcacatttttttctacctataacactctaggatgtatattttatataaagtattctttttcttttttaaattaatatctttctgcacacaaatattatttgtgtttcctaaatccaaccattttcattaattcaggcatattttaactccactgcttacctactttcttcaggtaaagggcaaataatgatcgaaaaaataattatttattacataatttagttgtttctagactataaatgttgctatgtgccttatgttgaaaaaatttaaaagtaaaatgtctttccaaattatttcttaattattataaaaatattaagacaatagcacttaaattcctcaacagtgttttcagaagaaataaatataccactctttacctttattgatatctccatgatgatagttgaatgttgcaatgtgaaaaatctgctgttaactgcaaccttgtttattaaattgcaagaagctttatttctagctttttaattaagcaaagcacccatttcaatgtgtataaattgtctttaaaaactgttttagacctataatccttgataatatattgtgttgactttataaatttcgcttcttagaacagtggaaactatgtgtttttctcatatttgaggagtgttaagattgcagatagcaaggtttggtgcaaagtattgtaatgagtgaattgaatggtgcattgtatagatataatgaacaaaattatttgtaagatatttgcagtttttcattttaaaaagtccataccttatatatgcacttaatttgttggggctttacatactttatcaatgtgtctttctaagaaatcaagtaatgaatccaactgcttaaagttggtattaataaaaagacaaccacatagttcgtttaccttcaaactttaggtttttttaatgatatactgatcttcattaccaataggcaaattaatcaccctaccaactttactgtcctaacatggtttaaaagaaaaaatgacaccatcttttattcttttttttttttttttttgagagagagtcttactctgccgcccaaactggagtgcagtggcacaatcttggctcactgcaacctctacctcctgggttcaagtgattctcttgcctcagcctcccgagttgctgggattacaggcatgtgccaccatgcccagctaatttttgtatttttagtagaaacgggtttcaccatgttggccagactggtctcaaactcctgacctcaggtgagcctcccaccttggcctcccaaagtgctgggattacaggcgtgagccactgcattcagctcttcttttctttagatatgagagctgaagagcttagacacattttgcatgtattatttgaaaatctgatggaatcccaaactgagatgtattaaaatacaatttttggccgggtgcagtggctcacgcctgtaatcccagcacttggggagggcgaggagggtggatcacgaggtcaagagatggagaccatcctgaccaacatggtgaaaccctgtctctactaaaaatacagaaattagctgggcatggtggcgtgagcctgtagtcctagctactcaggaggctgaggcaggagaatagcctgaacctgggaatcggaggttgcagagccaagatcgccccactgcactccagcctggcaatagaccgagactccgtctccaaaaaaaaaaaaaatacaatttttatttcttttactttttttagtaagttaatgtatataaaaatggcttcggacaaaatatctctgagttctgtgtattttcagtcaaaactttaaacctgtagaatcaatttaagtgttggaaaaaatttgtctgaaacatttcataatttgtttccagcatgaggtatctaaggatttagaccagaggtctagattaatactctatttttacatttaaaccttttattataagtcttacataaaccatttttgttactctcttccacatgttactggataaattgtttagtggaaaataggctttttaatcatgaatatgatgacaatcagttatacagttataaaattaaaagtttgaaaagcaatattgtatatttttatctatataaaataactaaaatgtatctaagaataataaaatcacgttaaaccaaatacacgtttgtctgtattgttaagtgccaaacaaaggatacttagtgcactgctacattgtgggatttatttctagatgatgtgcacatctaaggatatggatgtgtctaatttagtcttttcctgtaccaggtttttcttacaatacctgaagacttaccagtattctagtgtattatgaagctttcaacattactatgcacaaactagtgtttttcgatgttactaaattttaggtaaatgctttcatggcttttttcttcaaaatgttactgcttacatatatcatgcatagatttttgcttaaagtatgatttataatatcctcattatcaaagttgtatacaataatatataataaaataacaaatatgaataa

SEQ ID NO: 108971 - DNA, 4820 bp, Homo sapiens
  Payload ID: 1409
  Gene Symbol: AHR
  Gene Name: aryl hydrocarbon receptor
  Uniprot ID: P35869
  ENST ID: ENST00000463496
  CDS Start-End: 583-3129
ccgagagcgtgccccggaccgccagctcagaacaggggcagccgtgtagccgaacggaagctgggagcagccgggactggtggcccgcgcccgagctccgcaggcgggaagcaccctggatttaggaagtcccgggagcagcgcggcggcacctccctcacccaaggggccgcggcgacggtcacggggcgcggcgccaccgtgagcgacccaggccaggattctaaatagacggcccaggctcctcctccgcccgggccgcctcacctgcgggcattgccgcgccgcctccgccggtgtagacggcacctgcgccgccttgctcgcgggtctccgcccctcgcccaccctcactgcgccaggcccaggcagctcacctgtactggcgcgggctgcggaagcctgcgtgagccgaggcgttgaggcgcggcgcccacgccactgtcccgagaggacgcaggtggagcgggcgcggcttcgcggaacccggcgccggccgccgcagtggtcccagcctacaccgggttccggggacccggccgccagtgcccggggagtagccgccgccgtcggctgggcaccatgaacagcagcagcgccaacatcacctacgccagtcgcaagcggcggaagccggtgcagaaaacagtaaagccaatcccagctgaaggaatcaagtcaaatccttccaagcggcatagagaccgacttaatacagagttggaccgtttggctagcctgctgcctttcccacaagatgttattaataagttggacaaactttcagttcttaggctcagcgtcagttacctgagagccaagagcttctttgatgttgcattaaaatcctcccctactgaaagaaacggaggccaggataactgtagagcagcaaatttcagagaaggcctgaacttacaagaaggagaattcttattacaggctctgaatggctttgtattagttgtcactacagatgctttggtcttttatgcttcttctactatacaagattatctagggtttcagcagtctgatgtcatacatcagagtgtatatgaacttatccataccgaagaccgagctgaatttcagcgtcagctacactgggcattaaatccttctcagtgtacagagtctggacaaggaattgaagaagccactggtctcccccagacagtagtctgttataacccagaccagattcctccagaaaactctcctttaatggagaggtgcttcatatgtcgtctaaggtgtctgctggataattcatctggttttctggcaatgaatttccaagggaagttaaagtatcttcatggacagaaaaagaaagggaaagatggatcaatacttccacctcagttggctttgtttgcgatagctactccacttcagccaccatccatacttgaaatccggaccaaaaattttatctttagaaccaaacacaaactagacttcacacctattggttgtgatgccaaaggaagaattgttttaggatatactgaagcagagctgtgcacgagaggctcaggttatcagtttattcatgcagctgatatgctttattgtgccgagtcccatatccgaatgattaagactggagaaagtggcatgatagttttccggcttcttacaaaaaacaaccgatggacttgggtccagtctaatgcacgcctgctttataaaaatggaagaccagattatatcattgtaactcagagaccactaacagatgaggaaggaacagagcatttacgaaaacgaaatacgaagttgccttttatgtttaccactggagaagctgtgttgtatgaggcaaccaacccttttcctgccataatggatcccttaccactaaggactaaaaatggcactagtggaaaagactctgctaccacatccactctaagcaaggactctctcaatcctagttccctcctggctgccatgatgcaacaagatgagtctatttatctctatcctgcttcaagtacttcaagtactgcaccttttgaaaacaactttttcaacgaatctatgaatgaatgcagaaattggcaagataatactgcaccgatgggaaatgatactatcctgaaacatgagcaaattgaccagcctcaggatgtgaactcatttgctggaggtcacccagggctctttcaagatagtaaaaacagtgacttgtacagcataatgaaaaacctaggcattgattttgaagacatcagacacatgcagaatgaaaaatttttcagaaatgatttttctggtgaggttgacttcagagacattgacttaacggatgaaatcctgacgtatgtccaagattctttaagtaagtctcccttcataccttcagattatcaacagcaacagtccttggctctgaactcaagctgtatggtacaggaacacctacatctagaacagcaacagcaacatcaccaaaagcaagtagtagtggagccacagcaacagctgtgtcagaagatgaagcacatgcaagttaatggcatgtttgaaaattggaactctaaccaattcgtgcctttcaattgtccacagcaagacccacaacaatataatgtctttacagacttacatgggatcagtcaagagttcccctacaaatctgaaatggattctatgccttatacacagaactttatttcctgtaatcagcctgtattaccacaacattccaaatgtacagagctggactaccctatggggagttttgaaccatccccataccccactacttctagtttagaagattttgtcacttgtttacaacttcctgaaaaccaaaagcatggattaaatccacagtcagccataataactcctcagacatgttatgctggggccgtgtcgatgtatcagtgccagccagaacctcagcacacccacgtgggtcagatgcagtacaatccagtactgccaggccaacaggcatttttaaacaagtttcagaatggagttttaaatgaaacatatccagctgaattaaataacataaataacactcagactaccacacatcttcagccacttcatcatccgtcagaagccagaccttttcctgatttgacatccagtggattcctgtaattccaagcccaattttgaccctggtttttggattaaattagtttgtgaaggattatggaaaaataaaactgtcactgttggacgtcagcaagttcacatggaggcattgatgcatgctattcacaattattccaaaccaaattttaatttttgcttttagaaaagggagtttaaaaatggtatcaaaattacatatactacagtcaagatagaaagggtgctgccacggagtggtgaggtaccgtctacatttcacattattctgggcaccacaaaatatacaaaactttatcagggaaactaagattcttttaaattagaaaatattctctatttgaattatttctgtcacagtaaaaataaaatactttgagttttgagctactggattcttattagttccccaaatacaaagttagagaactaaactagtttttcctatcatgttaacctctgcttttatctcagatgttaaaataaatggtttggtgctttttataaaaagataatctcagtgctttcctccttcactgtttcatctaagtgcctcacatttttttctacctataacactctaggatgtatattttatataaagtattctttttcttttttaaattaatatctttctgcacacaaatattatttgtgtttcctaaatccaaccattttcattaattcaggcatattttaactccactgcttacctactttcttcaggtaaagggcaaataatgatcgaaaaaataattatttattacataatttagttgtttctagactataaatgttgcagagccaagatcgccccactgcactccagcctggcaatagaccgagactccgtctccaaaaaaaaaaaaaatacaatttttatttcttttactttttttagtaagttaatgtatataaaaatggcttcggacaaaatatctctgagttctgtgtattttcagtcaaaactttaaacctgtagaatcaatttaagtgttggaaaaaatttgtctgaaacatttcataatttgtttccagcatgaggtatctaaggatttagaccagaggtctagattaatactctatttttacatttaaaccttttattataagtcttacataaaccatttttgttactctcttccacatgttactggataaattgtttagtggaaaataggctttttaatcatgaatatgatgacaatcagttatacagttataaaattaaaagtttgaaaagcaatattgtatatttttatctatataaaataactaaaatgtatctaagaataataaaatcacgttaaaccaaatacacgtttgtctgtattgttaagtgccaaacaaaggatacttagtgcactgctacattgtgggatttatttctagatgatgtgcacatctaaggatatggatgtgtctaatttagtcttttcctgtaccaggtttttcttacaatacctgaagacttaccagtattctagtgtattatgaagctttcaacattactatgcacaaactagtgtttttcgatgttactaaattttaggtaaatgctttcatggcttttttcttcaaaatgttactgcttacatatatcatgcatagatttttgcttaaagtatgatttataatatcctcattatcaaagttgtatacaataatatataataaaataacaaatatgaataata

SEQ ID NO: 108972 - DNA, 1221 bp, Homo sapiens
  Payload ID: 1410
  Gene Symbol: AIP
  Gene Name: aryl hydrocarbon receptor interacting protein
  Uniprot ID: O00170
  ENST ID: ENST00000279146
  CDS Start-End: 119-1111
ccctcaaccaaaatggcgctagctcggaagctgccgaggtgctaggagttgccgaagcaagtccggaagctaccgagcgagtccggaagttgccgaaagggagcagcggggaaggaggatggcggatatcatcgcaagactccgggaggacgggatccaaaaacgtgtgatacaggaaggccgaggagagctcccggactttcaagatgggaccaaggccacgttccactaccggacgctgcacagtgacgacgagggcaccgtgctggacgacagccgggctcgtggcaagcccatggagctcatcattggcaagaagttcaagctgcctgtgtgggagaccatcgtgtgcaccatgcgagaaggggagattgcccagttcctctgtgacatcaagcatgtggtcctgtacccgctggtggccaagagtctccgcaacatcgcggtgggcaaggaccccctggagggccagcggcactgctgcggtgttgcacagatgcgtgaacacagctccctgggccatgctgacctggacgccctgcagcagaacccccagcccctcatcttccacatggagatgctgaaggtggagagccctggcacgtaccagcaggacccatgggccatgacagacgaagagaaggcaaaggcagtgccacttatccaccaggagggcaaccggttgtaccgcgaggggcatgtgaaggaggctgctgccaagtactacgatgccattgcctgcctcaagaacctgcagatgaaggaacagcctgggtcccctgaatggatccagctggaccagcagatcacgccgctgctgctcaactactgccagtgcaagctggtggtcgaggagtactacgaggtgctggaccactgctcttccatcctcaacaagtacgacgacaacgtcaaggcctacttcaagcggggcaaggcccacgcggccgtgtggaatgcccaggaggcccaggctgactttgccaaagtgctggagctggacccagccctggcgcctgtggtgagccgagagctgcgggccctggaggcacggatccggcagaaggacgaagaggacaaagcccggttccgggggatcttctcccattgacaggagcacttggccctgccttacctgccaagcccactgctgcagctgccagcccccctgcccgtgctgcgtcatgcttctgtgtatataaaggcctttatttatctctc

SEQ ID NO: 108973 - DNA, 815 bp, Homo sapiens
  Payload ID: 1410
  Gene Symbol: AIP
  Gene Name: aryl hydrocarbon receptor interacting protein
  ENST ID: ENST00000528641
  CDS Start-End: 119-815
ccctcaaccaaaatggcgctagctcggaagctgccgaggtgctaggagttgccgaagcaagtccggaagctaccgagcgagtccggaagttgccgaaagggagcagcggggaaggaggatggcggatatcatcgcaagactccgggaggacgggatccaaaaacgtgtgatacaggaaggccgaggagagctcccggactttcaagatgggaccaaggccacgttccactaccggacgctgcacagtgacgacgagggcaccgtgctggacgacagccgggctcgtggcaagcccatggagctcatcattggcaagaagttcaagctgcctgtgtgggagaccatcgtgtgcaccatgcgagaaggggagattgcccagttcctctgtgacatcaaggtggagagccctggcacgtaccagcaggacccatgggccatgacagacgaagagaaggcaaaggcagtgccacttatccaccaggagggcaaccggttgtaccgcgaggggcatgtgaaggaggctgctgccaagtactacgatgccattgcctgcctcaagaacctgcagatgaaggaacagcctgggtcccctgaatggatccagctggaccagcagatcacgccgctgctgctcaactactgccagtgcaagctggtggtcgaggagtactacgaggtgctggaccactgctcttccatcctcaacaagtacgacgacaacgtcaaggcctacttcaagcggggcaaggcccacgcggccgtgtggaatgcccaggaggcccaggctgactttgccaaagtgctggagctggacc

SEQ ID NO: 108974 - DNA, 635 bp, Homo sapiens
  Payload ID: 1410
  Gene Symbol: AIP
  Gene Name: aryl hydrocarbon receptor interacting protein
  ENST ID: ENST00000525341
  CDS Start-End: 1-567
ggccagcggcactgctgcggtgttgcacagatgcgtgaacacagctccctgggccatgctgacctggacgccctgcagcagaacccccagcccctcatcttccacatggagatgctgaaggtggagagccctggcacgtaccagcaggacccatgggccatgacagacgaagagaaggcaaaggcagtgccacttatccaccaggagggcaaccggttgtaccgcgaggggcatgtgaaggaggctgctgccaagtactacgatgccattgcctgcctcaagaacctgcagatgaaggaacagcctgggtcccctgaatggatccagctggaccagcagatcacgccgctgctgctcaactactgccagtgcaagctggtggtcgaggagtactacgaggtgctggaccactgctcttccatcctcaacaagtacgacggtgagcaccgggccctgggctgccgggggctgcgagtggtcagagagtggcctttctcctgtcactgctggggtcaagacctagcctttcacaacccccattctgagctcccacgggggcctgactaaatgcctctactcggcagggctgtgggccccattgtgccaatgaagcatgaatggtgtattgggggtgg

SEQ ID NO: 108975 - DNA, 2783 bp, Homo sapiens
  Payload ID: 1411
  Gene Symbol: AIPL1
  Gene Name: aryl hydrocarbon receptor interacting protein-like 1
  Uniprot ID: Q9NZN9
  ENST ID: ENST00000250087
  CDS Start-End: 96-1061
gctgggtaaatcccagagtctcagccgcctaagtgtcttccccggaggtgagattatctccgcctgtgctggacacctccctttctcctgcagccatggatgccgctctgctcctgaacgtggaaggggtcaagaaaaccattctgcacgggggcacgggcgagctcccaaacttcatcaccggatcccgagtgatctttcatttccgcaccatgaaatgtgatgaggagcggacagtcattgacgacagtcggcaggtgggccagcccatgcacatcatcatcggaaacatgttcaagctcgaggtctgggagatcctgcttacctccatgcgggtgcacgaggtggccgagttctggtgcgacaccatcgttgatgccccgagtgattaccagagggagacctggaacctgagcaatcatgagaagatgaaggcggtgcccgtcctccacggagagggaaatcggctcttcaagctgggccgctacgaggaggcctcttccaagtaccaggaggccatcatctgcctaaggaacctgcagaccaaggagaagccatgggaggtgcagtggctgaagctggagaagatgatcaatactctgatcctcaactactgccagtgcctgctgaagaaggaggagtactatgaggtgctggagcacaccagtgatattctccggcaccacccaggcatcgtgaaggcctactacgtgcgtgcccgggctcacgcagaggtgtggaatgaggccgaggccaaggcggacctccagaaagtgctggagctggagccgtccatgcagaaggcggtgcgcagggagctgaggctgctggagaaccgcatggcggagaagcaggaggaggagcggctgcgctgccggaacatgctgagccagggtgccacgcagcctcccgcagagccacccacagagccacccgcacagtcatccacagagccacctgcagagccacccacagcaccatctgcagagctgtccgcagggccccctgcagagccagccacagagccacccccgtccccagggcactcgctgcagcactgagccccctgaggcccacagccacccaggcagggagcaagtggcctggtcacttctggttcgattgaccaggatcgtggtgtcactttttaaaatttaaaattaatttttgaaatcaaagtcagacacacccatggtaaaaaaaaaaaaaaaaacaatcccaagggtacagaagagcttatgaataaaagtagttttctcctctacccctctcattccttccgtgccatggttttaattgaccctgtttttaattcttctggtagttttctctatttccaagtaatctgtttaaatcagtttctagattttaccccatgtcaatgacaaatgaggatttgatgctctgatcctttctcatgcctgatacccctccctgtctccccattttggatagttacatttgggggtcatctcggtgatttttgtaactttacgcaggacacttagagctctctagaatcccactgactttagtgggtcttgatgtagggtgggcaagccccgacactggagcttagcctgagagggttcttggcctcccccaggaaagatttcaaaggcaagcgccagtggtagggtagaagaaaacagctgtggtcgggcacggtggctcacgcctataatcccagcactttgggaggccgaggcgggtggatcacctgaggtcaggagttccagaccagcctggccaacatggtgaaacctcatctctactaaaaatacaaaaaaactagctgggcgtggtggcgggcgcctataatcccagctacttgggaggctgaggcaggagaattgattgaacctgggaggcggaggttgcagtgagccaagatcacgtcattgcactccagcctggtcaacaagagtaaaacttcatctcaaaaaacaaaacaaaacaaaaacaacaacaaaaaacaaaagaaaaacaaacaaaaccaaaaccaaaacagctgtattgaagctgcagtgttgcagctctgtgactgccctgcagagcagggctaccccataggcagcgagcagcagctcagggcagttctgcagtcagatttatacccacttttaattacatgtagattaaggagctgcatatacaaagatttctagggaaggagtagtaacttctgggtcctggggtctttgccacggaacagggcagtatgccagggtgttgccacggcaatggtaaactgacatggcaccctgggggtcatgccttagggaaagccgcttccactcgcccctgttttagctcatcttcaagttagtctggtgtccaagctccaccgcctgcctcagtctggtgacctccttctgtgtctgatgagcatggcagcgttgggaccttccccttccaactctctccctcctcttcgtcctccctaaaggacgggtacgaggaggggctatcacgccagcgacatcctctagcaccacccaggtgtgtggggtggggcaggggggcgacgaagtatccagcccagggccacgtagtcaactgccaagggcttcctgggcttctcttctgccccagagcttgtctccacccagcaggggttcccccagcgctaactgtatccctaaagttctgatgtactttacttttccatcttccttgttgttaacatctaccttctgctctgtaagcaaaactaaatcttctgtgctttgtccataggttgattctacaatctgaaaatcaataaacagcatttgcatgat

SEQ ID NO: 108976 - DNA, 2964 bp, Homo sapiens
  Payload ID: 1411
  Gene Symbol: AIPL1
  Gene Name: aryl hydrocarbon receptor interacting protein-like 1
  ENST ID: ENST00000381128
  CDS Start-End: 29-214
gctggacacctccctttctcctgcagccatggatgccgctctgctcctgaacgtggaaggggtcaagaaaaccattctgcacgggggcacgggcgagctcccaaacttcatcaccggatcccgagtgagtggggcccctccggagcagacagggtcccccacagcagctttcaacattccaggtgatctttcatttccgcaccatgaaatgtgatgaggagcggacagtcattgacgacagtcggcaggtgggccagcccatgcacatcatcatcggaaacatgttcaagctcgaggtctgggagatcctgcttacctccatgcgggtgcacgaggtggccgagttctggtgcgacaccatccacacgggggtctaccccatcctatcccggagcctgaggcagatggcccagggcaaggaccccacagagtggcacgtgcacacgtgcgggctggccaacatgttcgcctaccacacgctgggctacgaggacctggacgagctgcagaaggagcctcagcctctggtctttgtgatcgagctgctgcaggttgatgccccgagtgattaccagagggagacctggaacctgagcaatcatgagaagatgaaggcggtgcccgtcctccacggagagggaaatcggctcttcaagctgggccgctacgaggaggcctcttccaagtaccaggaggccatcatctgcctaaggaacctgcagaccaaggagaagccatgggaggtgcagtggctgaagctggagaagatgatcaatactctgatcctcaactactgccagtgcctgctgaagaaggaggagtactatgaggtgctggagcacaccagtgatattctccggcaccacccaggcatcgtgaaggcctactacgtgcgtgcccgggctcacgcagaggtgtggaatgaggccgaggccaaggcggacctccagaaagtgctggagctggagccgtccatgcagaaggcggtgcgcagggagctgaggctgctggagaaccgcatggcggagaagcaggaggaggagcggctgcgctgccggaacatgctgagccagggtgccacgcagcctcccgcagagccacccacagagccacccgcacagtcatccacagagccacctgcagagccacccacagcaccatctgcagagctgtccgcagggccccctgcagagccagccacagagccacccccgtccccagggcactcgctgcagcactgagccccctgaggcccacagccacccaggcagggagcaagtggcctggtcacttctggttcgattgaccaggatcgtggtgtcactttttaaaatttaaaattaatttttgaaatcaaagtcagacacacccatggtaaaaaaaaaaaaaaaaacaatcccaagggtacagaagagcttatgaataaaagtagttttctcctctacccctctcattccttccgtgccatggttttaattgaccctgtttttaattcttctggtagttttctctatttccaagtaatctgtttaaatcagtttctagattttaccccatgtcaatgacaaatgaggatttgatgctctgatcctttctcatgcctgatacccctccctgtctccccattttggatagttacatttgggggtcatctcggtgatttttgtaactttacgcaggacacttagagctctctagaatcccactgactttagtgggtcttgatgtagggtgggcaagccccgacactggagcttagcctgagagggttcttggcctcccccaggaaagatttcaaaggcaagcgccagtggtagggtagaagaaaacagctgtggtcgggcacggtggctcacgcctataatcccagcactttgggaggccgaggcgggtggatcacctgaggtcaggagttccagaccagcctggccaacatggtgaaacctcatctctactaaaaatacaaaaaaactagctgggcgtggtggcgggcgcctataatcccagctacttgggaggctgaggcaggagaattgattgaacctgggaggcggaggttgcagtgagccaagatcacgtcattgcactccagcctggtcaacaagagtaaaacttcatctcaaaaaacaaaacaaaacaaaaacaacaacaaaaaacaaaagaaaaacaaacaaaaccaaaaccaaaacagctgtattgaagctgcagtgttgcagctctgtgactgccctgcagagcagggctaccccataggcagcgagcagcagctcagggcagttctgcagtcagatttatacccacttttaattacatgtagattaaggagctgcatatacaaagatttctagggaaggagtagtaacttctgggtcctggggtctttgccacggaacagggcagtatgccagggtgttgccacggcaatggtaaactgacatggcaccctgggggtcatgccttagggaaagccgcttccactcgcccctgttttagctcatcttcaagttagtctggtgtccaagctccaccgcctgcctcagtctggtgacctccttctgtgtctgatgagcatggcagcgttgggaccttccccttccaactctctccctcctcttcgtcctccctaaaggacgggtacgaggaggggctatcacgccagcgacatcctctagcaccacccaggtgtgtggggtggggcaggggggcgacgaagtatccagcccagggccacgtagtcaactgccaagggcttcctgggcttctcttctgccccagagcttgtctccacccagcaggggttcccccagcgctaactgtatccctaaagttctgatgtactttacttttccatcttccttgttgttaacatctaccttctgctctgtaagcaaaactaaatcttctgtgctttgtccataggttgattctacaatctgaaaatcaataaacagcatttgcatgatt

SEQ ID NO: 108977 - DNA, 2959 bp, Homo sapiens
  Payload ID: 1411
  Gene Symbol: AIPL1
  Gene Name: aryl hydrocarbon receptor interacting protein-like 1
  Uniprot ID: Q9NZN9
  ENST ID: ENST00000381129
  CDS Start-End: 82-1236
agagtctcagccgcctaagtgtcttccccggaggtgagattatctccgcctgtgctggacacctccctttctcctgcagccatggatgccgctctgctcctgaacgtggaaggggtcaagaaaaccattctgcacgggggcacgggcgagctcccaaacttcatcaccggatcccgagtgatctttcatttccgcaccatgaaatgtgatgaggagcggacagtcattgacgacagtcggcaggtgggccagcccatgcacatcatcatcggaaacatgttcaagctcgaggtctgggagatcctgcttacctccatgcgggtgcacgaggtggccgagttctggtgcgacaccatccacacgggggtctaccccatcctatcccggagcctgaggcagatggcccagggcaaggaccccacagagtggcacgtgcacacgtgcgggctggccaacatgttcgcctaccacacgctgggctacgaggacctggacgagctgcagaaggagcctcagcctctggtctttgtgatcgagctgctgcaggttgatgccccgagtgattaccagagggagacctggaacctgagcaatcatgagaagatgaaggcggtgcccgtcctccacggagagggaaatcggctcttcaagctgggccgctacgaggaggcctcttccaagtaccaggaggccatcatctgcctaaggaacctgcagaccaaggagaagccatgggaggtgcagtggctgaagctggagaagatgatcaatactctgatcctcaactactgccagtgcctgctgaagaaggaggagtactatgaggtgctggagcacaccagtgatattctccggcaccacccaggcatcgtgaaggcctactacgtgcgtgcccgggctcacgcagaggtgtggaatgaggccgaggccaaggcggacctccagaaagtgctggagctggagccgtccatgcagaaggcggtgcgcagggagctgaggctgctggagaaccgcatggcggagaagcaggaggaggagcggctgcgctgccggaacatgctgagccagggtgccacgcagcctcccgcagagccacccacagagccacccgcacagtcatccacagagccacctgcagagccacccacagcaccatctgcagagctgtccgcagggccccctgcagagccagccacagagccacccccgtccccagggcactcgctgcagcactgagccccctgaggcccacagccacccaggcagggagcaagtggcctggtcacttctggttcgattgaccaggatcgtggtgtcactttttaaaatttaaaattaatttttgaaatcaaagtcagacacacccatggtaaaaaaaaaaaaaaaaacaatcccaagggtacagaagagcttatgaataaaagtagttttctcctctacccctctcattccttccgtgccatggttttaattgaccctgtttttaattcttctggtagttttctctatttccaagtaatctgtttaaatcagtttctagattttaccccatgtcaatgacaaatgaggatttgatgctctgatcctttctcatgcctgatacccctccctgtctccccattttggatagttacatttgggggtcatctcggtgatttttgtaactttacgcaggacacttagagctctctagaatcccactgactttagtgggtcttgatgtagggtgggcaagccccgacactggagcttagcctgagagggttcttggcctcccccaggaaagatttcaaaggcaagcgccagtggtagggtagaagaaaacagctgtggtcgggcacggtggctcacgcctataatcccagcactttgggaggccgaggcgggtggatcacctgaggtcaggagttccagaccagcctggccaacatggtgaaacctcatctctactaaaaatacaaaaaaactagctgggcgtggtggcgggcgcctataatcccagctacttgggaggctgaggcaggagaattgattgaacctgggaggcggaggttgcagtgagccaagatcacgtcattgcactccagcctggtcaacaagagtaaaacttcatctcaaaaaacaaaacaaaacaaaaacaacaacaaaaaacaaaagaaaaacaaacaaaaccaaaaccaaaacagctgtattgaagctgcagtgttgcagctctgtgactgccctgcagagcagggctaccccataggcagcgagcagcagctcagggcagttctgcagtcagatttatacccacttttaattacatgtagattaaggagctgcatatacaaagatttctagggaaggagtagtaacttctgggtcctggggtctttgccacggaacagggcagtatgccagggtgttgccacggcaatggtaaactgacatggcaccctgggggtcatgccttagggaaagccgcttccactcgcccctgttttagctcatcttcaagttagtctggtgtccaagctccaccgcctgcctcagtctggtgacctccttctgtgtctgatgagcatggcagcgttgggaccttccccttccaactctctccctcctcttcgtcctccctaaaggacgggtacgaggaggggctatcacgccagcgacatcctctagcaccacccaggtgtgtggggtggggcaggggggcgacgaagtatccagcccagggccacgtagtcaactgccaagggcttcctgggcttctcttctgccccagagcttgtctccacccagcaggggttcccccagcgctaactgtatccctaaagttctgatgtactttacttttccatcttccttgttgttaacatctaccttctgctctgtaagcaaaactaaatcttctgtgctttgtccataggttgattctacaatctgaaaatcaataaacagcatttgcatgatt

SEQ ID NO: 108978 - DNA, 2074 bp, Homo sapiens
  Payload ID: 1411
  Gene Symbol: AIPL1
  Gene Name: aryl hydrocarbon receptor interacting protein-like 1
  ENST ID: ENST00000574506
  CDS Start-End: 30-1148
tgctggacacctccctttctcctgcagccatggatgccgctctgctcctgaacgtggaaggggtcaagaaaaccattctgcacgggggcacgggcgagctcccaaacttcatcaccggatcccgagagcggacagtcattgacgacagtcggcaggtgggccagcccatgcacatcatcatcggaaacatgttcaagctcgaggtctgggagatcctgcttacctccatgcgggtgcacgaggtggccgagttctggtgcgacaccatccacacgggggtctaccccatcctatcccggagcctgaggcagatggcccagggcaaggaccccacagagtggcacgtgcacacgtgcgggctggccaacatgttcgcctaccacacgctgggctacgaggacctggacgagctgcagaaggagcctcagcctctggtctttgtgatcgagctgctgcaggttgatgccccgagtgattaccagagggagacctggaacctgagcaatcatgagaagatgaaggcggtgcccgtcctccacggagagggaaatcggctcttcaagctgggccgctacgaggaggcctcttccaagtaccaggaggccatcatctgcctaaggaacctgcagaccaaggagaagccatgggaggtgcagtggctgaagctggagaagatgatcaatactctgatcctcaactactgccagtgcctgctgaagaaggaggagtactatgaggtgctggagcacaccagtgatattctccggcaccacccaggcatcgtgaaggcctactacgtgcgtgcccgggctcacgcagaggtgtggaatgaggccgaggccaaggcggacctccagaaagtgctggagctggagccgtccatgcagaaggcggtgcgcagggagctgaggctgctggagaaccgcatggcggagaagcaggaggaggagcggctgcgctgccggaacatgctgagccagggtgccacgcagcctcccgcagagccacccacagagccacccgcacagtcatccacagagccacctgcagagccacccacagcaccatctgcagagctgtccgcagggccccctgcagagccagccacagagccacccccgtccccagggcactcgctgcagcactgagccccctgaggcccacagccacccaggcagggagcaagtggcctggtcacttctggttcgattgaccaggatcgtggtgtcactttttaaaatttaaaattaatttttgaaatcaaagtcagacacacccatggtaaaaaaaaaaaaaaaaacaatcccaagggtacagaagagcttatgaataaaagtagttttctcctctacccctctcattccttccgtgccatggttttaattgaccctgtttttaattcttctggtagttttctctatttccaagtaatctgtttaaatcagtttctagattttaccccatgtcaatgacaaatgaggatttgatgctctgatcctttctcatgcctgatacccctccctgtctccccattttggatagttacatttgggggtcatctcggtgatttttgtaactttacgcaggacacttagagctctctagaatcccactgactttagtgggtcttgatgtagggtgggcaagccccgacactggagcttagcctgagagggttcttggcctcccccaggaaagatttcaaaggcaagcgccagtggtagggtagaagaaaacagctgtggtcgggcacggtggctcacgcctataatcccagcactttgggaggccgaggcgggtggatcacctgaggtcaggagttccagaccagcctggccaacatggtgaaacctcatctctactaaaaatacaaaaaaactagctgggcgtggtggcgggcgcctataatcccagctacttgggaggctgaggcaggagaattgattgaacctgggaggcggaggttgcagtgagccaagatcacgtcattgcactccagcctggtcaacaagagtaaaacttcatctcaaaaaacaaaacaaaacaaaaacaacaacaaaaaacaaaagaaaaa

SEQ ID NO: 108979 - DNA, 1077 bp, Homo sapiens
  Payload ID: 1411
  Gene Symbol: AIPL1
  Gene Name: aryl hydrocarbon receptor interacting protein-like 1
  Uniprot ID: Q9NZN9
  ENST ID: ENST00000576307
  CDS Start-End: 49-1023
gtgagattatctccgcctgtgctggacacctccctttctcctgcagccatggatgccgctctgctcctgaacgtggaaggggtcaagaaaaccattctgcacgggggcacgggcgagctcccaaacttcatcaccggatcccgacacacgggggtctaccccatcctatcccggagcctgaggcagatggcccagggcaaggaccccacagagtggcacgtgcacacgtgcgggctggccaacatgttcgcctaccacacgctgggctacgaggacctggacgagctgcagaaggagcctcagcctctggtctttgtgatcgagctgctgcaggttgatgccccgagtgattaccagagggagacctggaacctgagcaatcatgagaagatgaaggcggtgcccgtcctccacggagagggaaatcggctcttcaagctgggccgctacgaggaggcctcttccaagtaccaggaggccatcatctgcctaaggaacctgcagaccaaggagaagccatgggaggtgcagtggctgaagctggagaagatgatcaatactctgatcctcaactactgccagtgcctgctgaagaaggaggagtactatgaggtgctggagcacaccagtgatattctccggcaccacccaggcatcgtgaaggcctactacgtgcgtgcccgggctcacgcagaggtgtggaatgaggccgaggccaaggcggacctccagaaagtgctggagctggagccgtccatgcagaaggcggtgcgcagggagctgaggctgctggagaaccgcatggcggagaagcaggaggaggagcggctgcgctgccggaacatgctgagccagggtgccacgcagcctcccgcagagccacccacagagccacccgcacagtcatccacagagccacctgcagagccacccacagcaccatctgcagagctgtccgcagggccccctgcagagccagccacagagccacccccgtccccagggcactcgctgcagcactgagccccctgaggcccacagccacccaggcagggagcaagtggcctggtcacttct

SEQ ID NO: 108980 - DNA, 2111 bp, Homo sapiens
  Payload ID: 1411
  Gene Symbol: AIPL1
  Gene Name: aryl hydrocarbon receptor interacting protein-like 1
  ENST ID: ENST00000575265
  CDS Start-End: 18-830
ccctttctcctgcagccatggatgccgctctgctcctgaacgtggaaggggtcaagaaaaccattctgcacgggggcacgggcgagctcccaaacttcatcaccggatcccgagtgatctttcatttccgcaccatgaaatgtgatgaggagcggacagtcattgacgacagtcggcaggtgggccagcccatgcacatcatcatcggaaacatgttcaagctcgaggtctgggagatcctgcttacctccatgcgggtgcacgaggtggccgagttctggtgcgacaccatccacacgggggtctaccccatcctatcccggagcctgaggcagatggcccagggcaaggaccccacagagtggcacgtgcacacgtgcgggctggccaacatgttcgcctaccacacgctgggctacgaggacctggacgagctgcagaaggagcctcagcctctggtctttgtgatcgagctgctgcaggttgatgccccgagtgattaccagagggagacctggaacctgagcaatcatgagaagatgaaggcggtgcccgtcctccacggagagggaaatcggctcttcaagctgggccgctacgaggaggcctcttccaagtaccaggaggccatcatctgcctaaggaacctgcagaccaaggagaagccatgggaggtgcagtggctgaagctggagaagatgatcaatactctgatcctcaactactgccagtgcctgctgaagaaggaggagtactatgaggtgctggagcacaccagtgatattctccggcaccacccaggtgcgcggggctgcaggggcggacagtgagggggcgcccagcccagggccacggagacacctgccatagccttcctggacttttctttccaccccaccagggcaccaaaccttgtctccacccagccgggtttccccgagtgtgtaactgaattgtgggtgatggatgggcagtgcttggcgcggggcggccctttattttaatgtgtgtttgaacacttacccaggaagctcgccaagcttgtgatttcagcggaacggtaaacaggcgtttaaaaaagaggggcaatcaatatagggaaaaatattatgatgtcggtactagtactggtgttgcgaggatatggcaccgtcagtactagtattgacttaatgctcgaatcgtgctcacagtaaaaacatccagcccctggctcatgcatcaggcacacgtcgtctgcgtttattatctcatttaatcctcataatcctcataatcaccatatgagggaggtgcagggaaagggcctgaaggttatctaatttaggtagcgtctataagaaaaataaaacaaagttatgaatataaaattactcacagggccttaaaaaggagaggaggaggtactgctattatgatcatcatctccatcttacagttgaggaaaccgagggatgggggatacagagaggttaaggatcatggcggggctgagggtcttggaggctggtgagtcccagctgggctggggctgcctctgaggctgggaagggagctgtagctggatgctccctgctccccacaggcatcgtgaaggcctactacgtgcgtgcccgggctcacgcagaggtgtggaatgaggccgaggccaaggcggacctccagaaagtgctggagctggagccgtccatgcagaaggcggtgcgcagggagctgaggctgctggagaaccgcatggcggagaagcaggaggaggagcggctgcgctgccggaacatgctgagccagggtgccacgcagcctcccgcagagccacccacagagccacccgcacagtcatccacagagccacctgcagagccacccacagcaccatctgcagagctgtccgcagggccccctgcagagccagccacagagccacccccgtccccagggcactcgctgcagcactgagccccctgaggcccacagccacccaggcagggagcaagtggcctggtcacttctggttcgattgaccaggatcgtggtgtcactttttaaaatttaaaattaatttttgaaatcaaagtcagacacacccatggtaaaaaaaaaaaaaaaaacaa

SEQ ID NO: 108981 - DNA, 1202 bp, Homo sapiens
  Payload ID: 1411
  Gene Symbol: AIPL1
  Gene Name: aryl hydrocarbon receptor interacting protein-like 1
  ENST ID: ENST00000571740
  CDS Start-End: 17-805
cctttctcctgcagccatggatgccgctctgctcctgaacgtggaaggggtcaagaaaaccattctgcacgggggcacgggcgagctcccaaacttcatcaccggatcccgagtgatctttcatttccgcaccatgaaatgtgatgaggagcggacagtcattgacgacagtcggcaggtgggccagcccatgcacatcatcatcggaaacatgttcaagctcgaggtctgggagatcctgcttacctccatgcgggtgcacgaggtggccgagttctggtgcgacaccatccacacgggggtctaccccatcctatcccggagcctgaggcagatggcccagggcaaggaccccacagagtggcacgtgcacacgtgcgggctggccaacatgttcgcctaccacacgctgggctacgaggacctggacgagctgcagaaggagcctcagcctctggtctttgtgatcgagctgctgcagagggagacctggaacctgagcaatcatgagaagatgaaggcggtgcccgtcctccacggagagggaaatcggctcttcaagctgggccgctacgaggaggcctcttccaagtaccaggaggccatcatctgcctaaggaacctgcagaccaaggagaagccatgggaggtgcagtggctgaagctggagaagatgatcaatactctgatcctcaactactgccagtgcctgctgaagaaggaggagtactatgaggtgctggagcacaccagtgatattctccggcaccacccaggtgcgcggggctgcaggggcggacagtgagggggcgcccagcccagggccacggagacacctgccatagccttcctggacttttctttccaccccaccagggcaccaaaccttgtctccacccagccgggtttccccgagtgtgtaactgaattgtgggtgatggatgggcagtgcttggcgcggggcggccctttattttaatgtgtgtttgaacacttacccaggaagctcgccaagcttgtgatttcagcggaacggtaaacaggcgtttaaaaaagaggggcaatcaatatagggaaaaatattatgatgtcggtactagtactggtgttgcgaggatatggcaccgtcagtactagtattgacttaatgctcgaatcgtgctcacagtaaaaacatccagcccctggctcatgcatcaggc

SEQ ID NO: 108982 - DNA, 653 bp, Homo sapiens
  Payload ID: 1411
  Gene Symbol: AIPL1
  Gene Name: aryl hydrocarbon receptor interacting protein-like 1
  ENST ID: ENST00000574913
  CDS Start-End: 4-653
gccatggatgccgctctgctcctgaacgtggaaggggtcaagaaaaccattctgcacgggggcacgggcgagctcccaaacttcatcaccggatcccgagtgatctttcatttccgcaccatgaaatgtgatgaggagcggacagtcattgacgacagtcggcaggtgggccagcccatgcacatcatcatcggaaacatgttcaagctcgaggtctgggagatcctgcttacctccatgcgggtgcacgaggtggccgagttctggtgcgacaccatccacacgggggtctaccccatcctatcccggagcctgaggcagatggcccagggcaaggaccccacagagtggcacgtgcacacgtgcgggctggccaacatgttcgcctaccacacgctgggctacgaggacctggacgagctgcagaaggagcctcagcctctggtctttgtgatcgagctgctgcagctctggggccaggttgatgccccgagtgattaccagagggagacctggaacctgagcaatcatgagaagatgaaggcggtgcccgtcctccacggagagggaaatcggctcttcaagctgggccgctacgaggaggcctcttccaagtaccaggaggccatcatctgcctaaggaacctgcagac

SEQ ID NO: 108983 - DNA, 1190 bp, Homo sapiens
  Payload ID: 1411
  Gene Symbol: AIPL1
  Gene Name: aryl hydrocarbon receptor interacting protein-like 1
  Uniprot ID: Q9NZN9
  ENST ID: ENST00000576776
  CDS Start-End: 49-1131
gtgagattatctccgcctgtgctggacacctccctttctcctgcagccatggatgccgctctgctcctgaacgtggaaggggtcaagaaaaccattctgcacgggggcacgggcgagctcccaaacttcatcaccggatcccgagtgatctttcatttccgcaccatgaaatgtgatgaggagcggacagtcattgacgacagtcggcaggtgggccagcccatgcacatcatcatcggaaacatgttcaagctcgaggtctgggagatcctgcttacctccatgcgggtgcacgaggtggccgagttctggtgcgacaccatccacacgggggtctaccccatcctatcccggagcctgaggcagatggcccagggcaaggaccccacagagtggcacgtgcacacgtgcgggctggccaacatgttcgcctaccacacgctgggctacgaggacctggacgagctgcagaaggagcctcagcctctggtctttgtgatcgagctgctgcaggttgatgccccgagtgattaccagagggagacctggaacctgagcaatcatgagaagatgaaggcggtgcccgtcctccacggagagggaaatcggctcttcaagctgggccgctacgaggaggcctcttccaagtaccaggaggccatcatctgcctaaggaacctgcagaccaagtgcctgctgaagaaggaggagtactatgaggtgctggagcacaccagtgatattctccggcaccacccaggcatcgtgaaggcctactacgtgcgtgcccgggctcacgcagaggtgtggaatgaggccgaggccaaggcggacctccagaaagtgctggagctggagccgtccatgcagaaggcggtgcgcagggagctgaggctgctggagaaccgcatggcggagaagcaggaggaggagcggctgcgctgccggaacatgctgagccagggtgccacgcagcctcccgcagagccacccacagagccacccgcacagtcatccacagagccacctgcagagccacccacagcaccatctgcagagctgtccgcagggccccctgcagagccagccacagagccacccccgtccccagggcactcgctgcagcactgagccccctgaggcccacagccacccaggcagggagcaagtggcctggtcacttctggttc

SEQ ID NO: 108984 - DNA, 1196 bp, Homo sapiens
  Payload ID: 1411
  Gene Symbol: AIPL1
  Gene Name: aryl hydrocarbon receptor interacting protein-like 1
  Uniprot ID: Q9NZN9
  ENST ID: ENST00000570466
  CDS Start-End: 49-1137
gtgagattatctccgcctgtgctggacacctccctttctcctgcagccatggatgccgctctgctcctgaacgtggaaggggtcaagaaaaccattctgcacgggggcacgggcgagctcccaaacttcatcaccggatcccgagtgggccagcccatgcacatcatcatcggaaacatgttcaagctcgaggtctgggagatcctgcttacctccatgcgggtgcacgaggtggccgagttctggtgcgacaccatccacacgggggtctaccccatcctatcccggagcctgaggcagatggcccagggcaaggaccccacagagtggcacgtgcacacgtgcgggctggccaacatgttcgcctaccacacgctgggctacgaggacctggacgagctgcagaaggagcctcagcctctggtctttgtgatcgagctgctgcaggttgatgccccgagtgattaccagagggagacctggaacctgagcaatcatgagaagatgaaggcggtgcccgtcctccacggagagggaaatcggctcttcaagctgggccgctacgaggaggcctcttccaagtaccaggaggccatcatctgcctaaggaacctgcagaccaaggagaagccatgggaggtgcagtggctgaagctggagaagatgatcaatactctgatcctcaactactgccagtgcctgctgaagaaggaggagtactatgaggtgctggagcacaccagtgatattctccggcaccacccaggcatcgtgaaggcctactacgtgcgtgcccgggctcacgcagaggtgtggaatgaggccgaggccaaggcggacctccagaaagtgctggagctggagccgtccatgcagaaggcggtgcgcagggagctgaggctgctggagaaccgcatggcggagaagcaggaggaggagcggctgcgctgccggaacatgctgagccagggtgccacgcagcctcccgcagagccacccacagagccacccgcacagtcatccacagagccacctgcagagccacccacagcaccatctgcagagctgtccgcagggccccctgcagagccagccacagagccacccccgtccccagggcactcgctgcagcactgagccccctgaggcccacagccacccaggcagggagcaagtggcctggtcacttctggttc

SEQ ID NO: 108985 - DNA, 409 bp, Homo sapiens
  Payload ID: 1411
  Gene Symbol: AIPL1
  Gene Name: aryl hydrocarbon receptor interacting protein-like 1
  ENST ID: ENST00000570584
  CDS Start-End: 1-409
tggaaggggtcaagaaaaccattctgcacgggggcacgggcgagctcccaaacttcatcaccggatcccgagtgatctttcatttccgcaccatgaaatgtgatgaggagcggacagtcattgacgacagtcggcaggtgggccagcccatgcacatcatcatcggaaacatgttcaagctcgaggtctgggagatcctgcttacctccatgcgggtgcacgaggtggccgagttctggtgcgacaccatccctgaacccacgccctcatggttttctcctctgaatgctaagactgccccattactgagccctcacgtccagccggctggaatgagctccccgtcgctggaggtattcaaggagcaacctgatgctttcttgtgcttcatgctctgggtgggaggagt

SEQ ID NO: 108986 - DNA, 1237 bp, Homo sapiens
  Payload ID: 1411
  Gene Symbol: AIPL1
  Gene Name: aryl hydrocarbon receptor interacting protein-like 1
  ENST ID: ENST00000621374
  CDS Start-End: 15-995
tttctcctgcagccatggatgccgctctgctcctgaacgtggaaggggtcaagaaaaccattctgcacgggggcacgggcgagctcccaaacttcatcaccggatcccgagtgatctttcatttccgcaccatgaaatgtgatgaggagcggacagtcattgacgacagtcggcaggtgggccagcccatgcacatcatcatcggaaacatgttcaagctcgaggtctgggagatcctgcttacctccatgcgggtgcacgaggtggccgagttctggtgcgacaccatccacacgggggtctaccccatcctatcccggagcctgaggcagatggcccagggcaaggaccccacagagtggcacgtgcacacgtgcgggctggccaacatgttcgcctaccacacgctgggctacgaggacctggacgagctgcagaaggagcctcagcctctggtctttgtgatcgagctgctgcaggttgatgccccgagtgattaccagagggagacctggaacctgagcaatcatgagaagatgaaggcggtgcccgtcctccacggagagggaaatcggctcttcaagctgggccgctacgaggaggcctcttccaagtaccaggaggccatcatctgcctaaggaacctgcagaccaaggagaagccatgggaggtgcagtggctgaagctggagaagatgatcaatactctgatcctcaactactgccagtgcctgctgaagaaggaggagtactatgaggtgctggagcacaccagtgatattctccggcaccacccaggcatcgtgaaggcctactacgtgcgtgcccgggctcacgcagaggtgtggaatgaggccgaggccaaggcggacctccagaaagtgctggagctggagccgtccatgcagaaggcggtgcgcagggagctgaggctgctggagaacgcatggcggagaagcaggaggaggagcggctgcgctgccggaacatgctgagccagggtgccacgcagcctcccgcagagccacccacagagccacccgcacagtcatccacagagccacctgcagagccacccacagcaccatctgcagagctgtccgcagggccccctgcagagccagccacagagccacccccgtccccagggcactcgctgcagcactgagccccctgaggcccacagccacccaggcagggagcaagtggcctggtcacttctggttcgattgaccag

SEQ ID NO: 108987 - DNA, 3538 bp, Homo sapiens
  Payload ID: 1412
  Gene Symbol: ARNT
  Gene Name: aryl hydrocarbon receptor nuclear translocator
  Uniprot ID: P27540
  ENST ID: ENST00000354396
  CDS Start-End: 13-2376
gcatctgcggccatggcggcgactactgccaaccccgaaatgacatcagatgtaccatcactgggtccagccattgcctctggaaactctggacctggaattcaaggtggaggagccattgtccagagggctattaagcggcgaccagggctggattttgatgatgatggagaagggaacagtaaatttttgaggtgtgatgatgatcagatgtctaacgataaggagcggtttgccaggtcggatgatgagcagagctctgcggataaagagagacttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcaggtgtttccctcccagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggtagtgaaattaaaaggccaagtgctgtctgtcatgttccggttccggtctaagaaccaagaatggctctggatgagaaccagctcctttactttccagaacccttactcagatgaaattgagtacatcatctgtaccaacaccaatgtgaagaactctagccaagaaccacggcctacactctccaacacaatccagaggccacaactaggtcccacagctaatttacccctggagatgggctcaggacagctggcacccaggcagcagcaacagcaaacagaattggacatggtaccaggaagagatggactggccagctacaatcattcccaggtggttcagcctgtgacaaccacaggaccagaacacagcaagccccttgagaagtcagatggtttatttgcccaggatagagatccaagattttcagaaatctatcacaacatcaatgcggatcagagtaaaggcatctcctccagcactgtccctgccacccaacagctattctcccagggcaacacattccctcctaccccccggccggcagagaatttcagtggcctagcccctcctgtaaccattgtccagccatcagcttctgcaggacagatgttggcccagatttcccgccactccaaccccacccaaggagcaaccccaacttggacccctactacccgctcaggcttttctgcccagcaggtggctacccaggctactgctaagactcgtacttcccagtttggtgtgggcagctttcagactccatcctccttcagctccatgtccctccctggtgccccaactgcatcgcctggtgctgctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgtatagtgttgatttgtgctgagatcaagaggcaggttagaagaacctgacatccactgtttgccttggatagtatggcttgtttttggaaagaaattctgaagagagtggaggagaggagaaatgtcctcatatttgaggaccatgaaacattgtaggtatatatggggctttagcaagtttgagcataggctctttttgctgcctgtgagcagtccctctggaaagaaacatgtgagtaagtgagagagagtgtgtgtgtatgtgtgtgtgtgtgtgtgtgcgcacacatgcttctgtatttcactctttctccctattagggagttatgcaaaatttgtccccgattttacctttgtctttctgtgtacttttcaaagagtcctaaggagttaaatcttccaggtattttccacttagtattgcagccaaagaatatttaaataaacgtctttgctgcgcttgcatccatgcccagccaatatacaactgtaaagcaaatatagaaagtcggctgttgatacgattgtctgttatcgaacacattcagtgataaagctgggttactgctgcttttggtgctctcaccttatctggaagatctgcaaacattacctaaataggctggcaagataaacactttctggaacccgagacttggccataaagataatgctgcatttttctgtcagaatcacatatgatgtgtgttctgtagaggttatttctgcatggaaactcaacttcttggattagccgtcccagtgaaaatcctcattgttggagtgtaaaccaaatacgaagccctcttgcaaagtagcctctttcatcccatactcaaaatacccagtttagcaagcaactgagatttaagtctctctg

SEQ ID NO: 108988 - DNA, 4887 bp, Homo sapiens
  Payload ID: 1412
  Gene Symbol: ARNT
  Gene Name: aryl hydrocarbon receptor nuclear translocator
  Uniprot ID: P27540
  ENST ID: ENST00000358595
  CDS Start-End: 202-2571
atataggcggggtctccccgccgcaggggctgggatgctgggggctgctgaagccgccatcttggattccgcggtagcggaggcggcggtcaggcgccgcttctggggagtggcctttcttttcccctccctcccggttcggtggcggcggctcctcccactgggggggggggtggcgcggcggcggtggcatctgcggccatggcggcgactactgccaaccccgaaatgacatcagatgtaccatcactgggtccagccattgcctctggaaactctggacctggaattcaaggtggaggagccattgtccagagggctattaagcggcgaccagggctggattttgatgatgatggagaagggaacagtaaatttttgaggtgtgatgatgatcagatgtctaacgataaggagcggtttgccaggtcggatgatgagcagagctctgcggataaagagagacttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcaggtgtttccctcccagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggtagtgaaattaaaaggccaagtgctgtctgtcatgttccggttccggtctaagaaccaagaatggctctggatgagaaccagctcctttactttccagaacccttactcagatgaaattgagtacatcatctgtaccaacaccaatgtgaagaactctagccaagaaccacggcctacactctccaacacaatccagaggccacaactaggtcccacagctaatttacccctggagatgggctcaggacagctggcacccaggcagcagcaacagcaaacagaattggacatggtaccaggaagagatggactggccagctacaatcattcccaggtggttcagcctgtgacaaccacaggaccagaacacagcaagccccttgagaagtcagatggtttatttgcccaggatagagatccaagattttcagaaatctatcacaacatcaatgcggatcagagtaaaggcatctcctccagcactgtccctgccacccaacagctattctcccagggcaacacattccctcctaccccccggccggcagagaatttcaggaatagtggcctagcccctcctgtaaccattgtccagccatcagcttctgcaggacagatgttggcccagatttcccgccactccaaccccacccaaggagcaaccccaacttggacccctactacccgctcaggcttttctgcccagcaggtggctacccaggctactgctaagactcgtacttcccagtttggtgtgggcagctttcagactccatcctccttcagctccatgtccctccctggtgccccaactgcatcgcctggtgctgctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgtatagtgttgatttgtgctgagatcaagaggcaggttagaagaacctgacatccactgtttgccttggatagtatggcttgtttttggaaagaaattctgaagagagtggaggagaggagaaatgtcctcatatttgaggaccatgaaacattgtaggtatatatggggctttagcaagtttgagcataggctctttttgctgcctgtgagcagtccctctggaaagaaacatgtgagtaagtgagagagagtgtgtgtgtatgtgtgtgtgtgtgtgtgtgcgcacacatgcttctgtatttcactctttctccctattagggagttatgcaaaatttgtccccgattttacctttgtctttctgtgtacttttcaaagagtcctaaggagttaaatcttccaggtattttccacttagtattgcagccaaagaatatttaaataaacgtctttgctgcgcttgcatccatgcccagccaatatacaactgtaaagcaaatatagaaagtcggctgttgatacgattgtctgttatcgaacacattcagtgataaagctgggttactgctgcttttggtgctctcaccttatctggaagatctgcaaacattacctaaataggctggcaagataaacactttctggaacccgagacttggccataaagataatgctgcatttttctgtcagaatcacatatgatgtgtgttctgtagaggttatttctgcatggaaactcaacttcttggattagccgtcccagtgaaaatcctcattgttggagtgtaaaccaaatacgaagccctcttgcaaagtagcctctttcatcccatactcaaaatacccagtttagcaagcaactgagatttaagtctctctggccctaagaggtttttcctctttgctccctccaatcttgagattgggttttgctttagagtgcaagtatcataattccgtatgatagatggggcctggacacccatctcaacagggtcacttggtaattaacaatagccatataaatgcggatacaggttactaccctcaccctttaccttcctcaggtaacagtcgtagataccagcttttttttttttttttttaaattggctttggccagtagctaaagtgcaagactgaattaatgagaagatatattaaatgtagtcataggggactgaggagcaagggtggccttgaagaggccaaaggaatgtccatttgctgagtttcccttccttatgtctccagtctggtgccaggtagtggagtaaaaaaggagacagtttatttttttattctatgtgcacacttacagtatacatatatatttatatcacaatttacgaaaccaaaaagttgagtttccaatggaacccttgttttttaataatcgactttttaaatgtgatcaggactataatattgtacagttattatagggcttttggggaaggggaggatagcgagaagatgctctgggggttttgtttttgcttttccttcagggttttatttttgactgttttgttttcttgttggccatttctgtattgctggcatctgtgctaagctttacagtggcaaaaataatgacatgtagcaaagattttcaaacaaaatattttttccttttgtaaaatttcttgtgttgtgtgatcttgattgcggctttatcattcctttccagttcataaacaacaggcacccacaaccagaggaatctatagtttaagctccagacatacaaacataaggcacattgtgtctttaatttcaggaatcagaaatcatagggttctgatcacattgcacgcctcccccctcacttgtcctcctgatcctgacacattctgagtaacatcagcaggaatgctctgaccatgaggtgggggttttggggtgggcgttgcctgggttcttgggagagaggggaagagtcgggacttgaaaaccactagggcacatctggatgccttcccccagtatgtccttttctggattaaaatgagtgaaatttaaactgttcaa

SEQ ID NO: 108989 - DNA, 2892 bp, Homo sapiens
  Payload ID: 1412
  Gene Symbol: ARNT
  Gene Name: aryl hydrocarbon receptor nuclear translocator
  Uniprot ID: P27540
  ENST ID: ENST00000515192
  CDS Start-End: 225-2552
cttggattccgcggtagcggaggcggcggtcaggcgccgcttctggggagtggcctttcttttcccctccctcccggttcggtggcggcggctcctcccactgggggggggggtggcgcggcggcggtggcatctgcggccatggcggcgactactgccaaccccgcctgatcttggactcaagattctcctgcctcagaccccgagtagctgggactacagaaatgacatcagatgtaccatcactgggtccagccattgcctctggaaactctggacctggaattcaaggtggaggagccattgtccagagggctattaagcggcgaccagggctggattttgatgatgatggagaagggaacagtaaatttttgaggtgtgatgatgatcagatgtctaacgataaggagcggtttgccaggtcggatgatgagcagagctctgcggataaagagagacttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggtagtgaaattaaaaggccaagtgctgtctgtcatgttccggttccggtctaagaaccaagaatggctctggatgagaaccagctcctttactttccagaacccttactcagatgaaattgagtacatcatctgtaccaacaccaatgtgaagaactctagccaagaaccacggcctacactctccaacacaatccagaggccacaactaggtcccacagctaatttacccctggagatgggctcaggacagctggcacccaggcagcagcaacagcaaacagaattggacatggtaccaggaagagatggactggccagctacaatcattcccaggtggttcagcctgtgacaaccacaggaccagaacacagcaagccccttgagaagtcagatggtttatttgcccaggatagagatccaagattttcagaaatctatcacaacatcaatgcggatcagagtaaaggcatctcctccagcactgtccctgccacccaacagctattctcccagggcaacacattccctcctaccccccggccggcagagaatttcaggaatagtggcctagcccctcctgtaaccattgtccagccatcagcttctgcaggacagatgttggcccagatttcccgccactccaaccccacccaaggagcaaccccaacttggacccctactacccgctcaggcttttctgcccagcaggtggctacccaggctactgctaagactcgtacttcccagtttggtgtgggcagctttcagactccatcctccttcagctccatgtccctccctggtgccccaactgcatcgcctggtgctgctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgtatagtgttgatttgtgctgagatcaagaggcaggttagaagaacctgacatccactgtt

SEQ ID NO: 108990 - DNA, 571 bp, Homo sapiens
  Payload ID: 1412
  Gene Symbol: ARNT
  Gene Name: aryl hydrocarbon receptor nuclear translocator
  ENST ID: ENST00000504358
  CDS Start-End: 130-297
ggtagcggaggcggcggtcaggcgccgcttctggggagtggcctttcttttcccctccctcccggttcggtggcggcggctcctcccactgggggggggggtggcgcggcggcggtggcatctgcggccatggcggcgactactgccaaccccgaaatgacatcagatgtaccatcactgggtccagccattgcctctggaaactctggacctggaattcaaggtggaggagccattgtccagagggctattaagcggcgaccaggatggagtcttgcagttgtcgcccaggcttgagtgcaatggtgcgatcttggctcactgaaacctccacctcccgggttccagcaattctcctgcctcagcctcctgagtagctgagattacaggctggattttgatgatgatggagaagggaacagtaaatttttgaggtgtgatgatgatcagatgtctaacgataaggagcggtttgccaggtcggatgatgagcagagctctgcggataaagagagacttgccagggaaaatcacagtgaaattgaacggcggcgacggaacaagatgacag

SEQ ID NO: 108991 - DNA, 3703 bp, Homo sapiens
  Payload ID: 1412
  Gene Symbol: ARNT
  Gene Name: aryl hydrocarbon receptor nuclear translocator
  ENST ID: ENST00000471844
  CDS Start-End: 139-1389
ggattccgcggtagcggaggcggcggtcaggcgccgcttctggggagtggcctttcttttcccctccctcccggttcggtggcggcggctcctcccactgggggggggggtggcgcggcggcggtggcatctgcggccatggcggcgactactgccaaccccgaaatgacatcagatgtaccatcactgggtccagccattgcctctggaaactctggacctggaattcaaggtggaggagccattgtccagagggctattaagcggcgaccagggctggattttgatgatgatggagaagggaacagtaaatttttgaggtgtgatgatgatcagatgtctaacgataaggagcggtttgccaggtcggatgatgagcagagctctgcggataaagagagacttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcaggtgtttccctcccagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggaactctagccaagaaccacggcctacactctccaacacaatccagaggccacaactaggtcccacagctaatttacccctggagatgggctcaggacagctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgtatagtgttgatttgtgctgagatcaagaggcaggttagaagaacctgacatccactgtttgccttggatagtatggcttgtttttggaaagaaattctgaagagagtggaggagaggagaaatgtcctcatatttgaggaccatgaaacattgtaggtatatatggggctttagcaagtttgagcataggctctttttgctgcctgtgagcagtccctctggaaagaaacatgtgagtaagtgagagagagtgtgtgtgtatgtgtgtgtgtgtgtgtgtgcgcacacatgcttctgtatttcactctttctccctattagggagttatgcaaaatttgtccccgattttacctttgtctttctgtgtacttttcaaagagtcctaaggagttaaatcttccaggtattttccacttagtattgcagccaaagaatatttaaataaacgtctttgctgcgcttgcatccatgcccagccaatatacaactgtaaagcaaatatagaaagtcggctgttgatacgattgtctgttatcgaacacattcagtgataaagctgggttactgctgcttttggtgctctcaccttatctggaagatctgcaaacattacctaaataggctggcaagataaacactttctggaacccgagacttggccataaagataatgctgcatttttctgtcagaatcacatatgatgtgtgttctgtagaggttatttctgcatggaaactcaacttcttggattagccgtcccagtgaaaatcctcattgttggagtgtaaaccaaatacgaagccctcttgcaaagtagcctctttcatcccatactcaaaatacccagtttagcaagcaactgagatttaagtctctctggccctaagaggtttttcctctttgctccctccaatcttgagattgggttttgctttagagtgcaagtatcataattccgtatgatagatggggcctggacacccatctcaacagggtcacttggtaattaacaatagccatataaatgcggatacaggttactaccctcaccctttaccttcctcaggtaacagtcgtagataccagcttttttttttttttttttaaattggctttggccagtagctaaagtgcaagactgaattaatgagaagatatattaaatgtagtcataggggactgaggagcaagggtggccttgaagaggccaaaggaatgtccatttgctgagtttcccttccttatgtctccagtctggtgccaggtagtggagtaaaaaaggagacagtttatttttttattctatgtgcacacttacagtatacatatatatttatatcacaatttacgaaaccaaaaagttgagtttccaatggaacccttgttttttaataatcgactttttaaatgtgatcaggactataatattgtacagttattatagggcttttggggaaggggaggatagcgagaagatgctctgggggttttgtttttgcttttccttcagggttttatttttgactgttttgttttcttgttggccatttctgtattgctggcatctgtgctaagctttacagtggcaaaaataatgacatgtagcaaagattttcaaacaaaatattttttccttttgtaaaa

SEQ ID NO: 108992 - DNA, 2427 bp, Homo sapiens
  Payload ID: 1412
  Gene Symbol: ARNT
  Gene Name: aryl hydrocarbon receptor nuclear translocator
  Uniprot ID: P27540
  ENST ID: ENST00000505755
  CDS Start-End: 43-2367
actgggggggggggtggcgcggcggcggtggcatctgcggccatggcggcgactactgccaaccccgaaatgacatcagatgtaccatcactgggtccagccattgcctctggaaactctggacctggaattcaaggtggaggagccattgtccagagggctattaagcggcgaccagggctggattttgatgatgatggagaagggaacagtaaatttttgaggtgtgatgatgatcagatgtctaacgataaggagcggtttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcaggtgtttccctcccagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggtagtgaaattaaaaggccaagtgctgtctgtcatgttccggttccggtctaagaaccaagaatggctctggatgagaaccagctcctttactttccagaacccttactcagatgaaattgagtacatcatctgtaccaacaccaatgtgaagaactctagccaagaaccacggcctacactctccaacacaatccagaggccacaactaggtcccacagctaatttacccctggagatgggctcaggacagctggcacccaggcagcagcaacagcaaacagaattggacatggtaccaggaagagatggactggccagctacaatcattcccaggtggttcagcctgtgacaaccacaggaccagaacacagcaagccccttgagaagtcagatggtttatttgcccaggatagagatccaagattttcagaaatctatcacaacatcaatgcggatcagagtaaaggcatctcctccagcactgtccctgccacccaacagctattctcccagggcaacacattccctcctaccccccggccggcagagaatttcaggaatagtggcctagcccctcctgtaaccattgtccagccatcagcttctgcaggacagatgttggcccagatttcccgccactccaaccccacccaaggagcaaccccaacttggacccctactacccgctcaggcttttctgcccagcaggtggctacccaggctactgctaagactcgtacttcccagtttggtgtgggcagctttcagactccatcctccttcagctccatgtccctccctggtgccccaactgcatcgcctggtgctgctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagc

SEQ ID NO: 108993 - DNA, 2776 bp, Homo sapiens
  Payload ID: 1413
  Gene Symbol: ARNTL
  Gene Name: aryl hydrocarbon receptor nuclear translocator-like
  Uniprot ID: O00327
  ENST ID: ENST00000389707
  CDS Start-End: 389-2266
gacatttagggaaggcagaaagtaggtcagggacggaggtgcctgtttacccgcgccggactcaccgccgccgccgccgcgggatccgagtgcgggcgcgggcgcgggcgctcccggcgagccacggtggtgctggctagagtgtatacgtttggacccaagcttaacttttccaatgtggaatcctgggccttcattggttccgatgtcataggaatctacgctagagggcttcctgtgtgccgggcactgtggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattttaaatggagggactccagacattccttccagtggcctactatcaggccaggctcaggagaacccaggttatccatattctgatagttcttctattcttggtgagaacccccacataggtatagacatgattgacaacgaccaaggatcaagtagtcccagtaatgatgaggcagcaatggctgtcatcatgagcctcttggaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttctataaa

SEQ ID NO: 108994 - DNA, 2746 bp, Homo sapiens
  Payload ID: 1413
  Gene Symbol: ARNTL
  Gene Name: aryl hydrocarbon receptor nuclear translocator-like
  Uniprot ID: O00327
  ENST ID: ENST00000403290
  CDS Start-End: 356-2236
cggaggtgcctgtttacccgcgccggactcaccgccgccgccgccgcgggatccgagtgcgggcgcgggcgcgggcgctcccggcgagccacggtggtgctggctagagtgtatacgtttggacccaagcttaacttttccaatgtggaatcctgggccttcattggttccgatgtcataggaatctacgctagagggcttcctgtgtgccgggcactgtggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagcagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattttaaatggagggactccagacattccttccagtggcctactatcaggccaggctcaggagaacccaggttatccatattctgatagttcttctattcttggtgagaacccccacataggtatagacatgattgacaacgaccaaggatcaagtagtcccagtaatgatgaggcagcaatggctgtcatcatgagcctcttggaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttctataaa

SEQ ID NO: 108995 - DNA, 2745 bp, Homo sapiens
  Payload ID: 1413
  Gene Symbol: ARNTL
  Gene Name: aryl hydrocarbon receptor nuclear translocator-like
  Uniprot ID: O00327
  ENST ID: ENST00000403510
  CDS Start-End: 490-2238
gtttacccgcgccggactcaccgccgccgccgccgcgggatccgagtgcgggcgcgggcgcgggcgctcccggcgagccacggtggtgctggctagagtgtatacgtttggacccaagcttaacttttccaatgtggaatcctgggccttcattggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccattcacaggtcgaatttggggagcacaatggctggaggtcagatgcccactaggagatgctatgattaatatagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattttaaatggagggactccagacattccttccagtggcctactatcaggccaggctcaggagaacccaggttatccatattctgatagttcttctattcttggtgagaacccccacataggtatagacatgattgacaacgaccaaggatcaagtagtcccagtaatgatgaggcagcaatggctgtcatcatgagcctcttggaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttctat

SEQ ID NO: 108996 - DNA, 2389 bp, Homo sapiens
  Payload ID: 1413
  Gene Symbol: ARNTL
  Gene Name: aryl hydrocarbon receptor nuclear translocator-like
  Uniprot ID: O00327
  ENST ID: ENST00000403482
  CDS Start-End: 5-1879
ggagatgagcaaggaggccgtgagcctgtgggcgctcactgtgtccctccaacccccagtccccttgtgtgtctgcagagagatgacaggatcaggcagaagaaaacagcaatgtgtaactttgccattcatctccagagaattatgtttttatcttttgctttttcctccccccaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagcagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattttaaatggagggactccagacattccttccagtggcctactatcaggccaggctcaggagaacccaggttatccatattctgatagttcttctattcttggtgagaacccccacataggtatagacatgattgacaacgaccaaggatcaagtagtcccagtaatgatgaggcagcaatggctgtcatcatgagcctcttggaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttctataaa

SEQ ID NO: 108997 - DNA, 2788 bp, Homo sapiens
  Payload ID: 1413
  Gene Symbol: ARNTL
  Gene Name: aryl hydrocarbon receptor nuclear translocator-like
  Uniprot ID: O00327
  ENST ID: ENST00000401424
  CDS Start-End: 527-2278
gacatttagggaaggcagaaagtaggtcagggacggaggtgcctgtttacccgcgccggactcaccgccgccgccgccgcgggatccgagtgcgggcgcgggcgcgggcgctcccggcgagccacggtggtgctggctagagtgtatacgtttggacccaagcttaacttttccaatgtggaatcctgggccttcattggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccagtcgaatttggggagcacaatggctggaggtcagatgcccactaggagatgctatgattaatatagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccagaatgatctgattggtcagagtttgtttgactacctgcatcctaaagatattgccaaagtcaaggagcagctctcctcctctgacaccgcaccccgggagcggctcatagatgcaaaaactggacttccagttaaaacagatataacccctgggccatctcgattatgttctggagcacgacgttctttcttctgtaggatgaagtgtaacaggccttcagtaaaggttgaagacaaggacttcccctctacctgctcaaagaaaaaagcagatcgaaaaagcttctgcacaatccacagcacaggctatttgaaaagctggccacccacaaagatggggctggatgaagacaacgaaccagacaatgaggggtgtaacctcagctgcctcgtcgcaattggacgactgcattctcatgtagttccacaaccagtgaacggggaaatcagggtgaaatctatggaatatgtttctcggcacgcgatagatggaaagtttgtttttgtagaccagagggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattttaaatggagggactccagacattccttccagtggcctactatcaggccaggctcaggagaacccaggttatccatattctgatagttcttctattcttggtgagaacccccacataggtatagacatgattgacaacgaccaaggatcaagtagtcccagtaatgatgaggcagcaatggctgtcatcatgagcctcttggaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttctataaa

SEQ ID NO: 108998 - DNA, 567 bp, Homo sapiens
  Payload ID: 1413
  Gene Symbol: ARNTL
  Gene Name: aryl hydrocarbon receptor nuclear translocator-like
  ENST ID: ENST00000533520
  CDS Start-End: 266-567
ggtgcgacatttagggaaggcagaaagtaggtcagggacggaggtgcctgtttacccgcgccggactcaccgccgccgccgccgcgggatccgagtgcgggcgcgggcgcgggcgctcccggcgagccacggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaac

SEQ ID NO: 108999 - DNA, 807 bp, Homo sapiens
  Payload ID: 1413
  Gene Symbol: ARNTL
  Gene Name: aryl hydrocarbon receptor nuclear translocator-like
  ENST ID: ENST00000534544
  CDS Start-End: 629-807
accctaccccagcaggcgctaaaggagagctgacatgatggataacgaaaaagaagacgctgtccttctattcagggagtttaacatctggaagagccgggagttctttgtgctaaaggccctctacaaagtgcctgagatgcaaaaataagtcactttctctgtcctctcagcaaccgagtcgcatgtcgttatcaaatttttattttctgtaactgtttccttccgtcttgctccgtagacagctttttgcagcagagagcgctgccgcggggctggtgtctactcttcagtaagtggtcaaaacctggctactggaaggaaatgcaatggaatcgctccgcgctcgagtattctctttggaactacgggaatgacagctccagtgggacacttggaggtcatgatgaacgcaaagaacgtggtgctggctagagtgtatacgtttggacccaagcttaacttttccaatgtggaatcctgggccttcattggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaag

SEQ ID NO: 109000 - DNA, 519 bp, Homo sapiens
  Payload ID: 1413
  Gene Symbol: ARNTL
  Gene Name: aryl hydrocarbon receptor nuclear translocator-like
  ENST ID: ENST00000527998
  CDS Start-End: 292-519
cgggcgttcggattggctggcgggaagaggtggtgctggctagagtgtatacgtttggacccaagcttaacttttccaatgtggaatcctgggccttcattggttccgatgtcataggaatctacgctagagggcttcctgtgtgccgggcactgtggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaaggttagaatatacagaacaccaaggaaggataaaaaatgcaagggaagct

SEQ ID NO: 109001 - DNA, 610 bp, Homo sapiens
  Payload ID: 1413
  Gene Symbol: ARNTL
  Gene Name: aryl hydrocarbon receptor nuclear translocator-like
  ENST ID: ENST00000529388
  CDS Start-End: 204-610
tttagggaaggcagaaagtaggtcagggacggaggtgcctgtttacccgcgccggactcaccgccgccgccgccgcgggatccgagtgcgggcgcgggcgcgggcgctcccggcgagccacggtggtgctggctagagtgtatacgtttggacccaagcttaacttttccaatgtggaatcctgggccttcattgatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccaagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaa

SEQ ID NO: 109002 - DNA, 571 bp, Homo sapiens
  Payload ID: 1413
  Gene Symbol: ARNTL
  Gene Name: aryl hydrocarbon receptor nuclear translocator-like
  ENST ID: ENST00000529050
  CDS Start-End: 503-571
accctaccccagcaggcgctaaaggagagctgacatgatggataacgaaaaagaagacgctgtccttctattcagggagtttaacatctggaagagccgggagttctttgtgctaaaggccctctacaaagtgcctgagatgcaaaaataagtcactttctctgtcctctcagcaaccgagtcgcatgtcgttatcaaatttttattttctgtaactgtttccttccgtcttgctccgtagacagctttttgcagcagagagcgctgccgcggggctggtgtctactcttcagtaagtggtcaaaacctggctactggaaggaaatgcaatggaatcgctccgcgctcgagtattctctttggaactacgggaatgacagctccagtgggacacttggaggtcatgatgaacgcaaagaacgtggtgctggctagagtgtatacgtttggacccaagcttaacttttccaatgtggaatcctgggccttcattgatcatccaatggcagaccagagaatggacatttcttcaaccatcagtgatttcatgtccccgggccccaccgacctg

SEQ ID NO: 109003 - DNA, 551 bp, Homo sapiens
  Payload ID: 1413
  Gene Symbol: ARNTL
  Gene Name: aryl hydrocarbon receptor nuclear translocator-like
  ENST ID: ENST00000529825
  CDS Start-End: 412-551
gtgcgacatttagggaaggcagaaagtaggtcagggacggaggtgcctgtttacccgcgccggactcaccgccgccgccgccgcgggatccgagtgcgggcgcgggcgcgggcgctcccggcgagccacggtggtgctggctagagtgtatacgtttggacccaagcttaacttttccaatgtggaatcctgggccttcattgatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccattcacaggtcgaatttggggagcacaatggctggaggtcagatgcccactaggagatgctatgattaatatagaaagcatggacacagacaaagatgaccctcatggaaggttagaatatacagaacaccaaggaaggataaaaaatgcaagggaagctcacagtcagattgaaaagcggcgtcgggataaaatgaacag

SEQ ID NO: 109004 - DNA, 390 bp, Homo sapiens
  Payload ID: 1413
  Gene Symbol: ARNTL
  Gene Name: aryl hydrocarbon receptor nuclear translocator-like
  ENST ID: ENST00000531665
  CDS Start-End: 209-390
ggtggtgctggctagagtgtatacgtttggacccaagcttaacttttccaatgtggaatcctgggccttcattggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccagttagaatatacagaacaccaaggaaggataaaaaatgcaag

SEQ ID NO: 109005 - DNA, 868 bp, Homo sapiens
  Payload ID: 1413
  Gene Symbol: ARNTL
  Gene Name: aryl hydrocarbon receptor nuclear translocator-like
  ENST ID: ENST00000530357
  CDS Start-End: 446-868
gaaagtaggtcagggacggaggtgcctgtttacccgcgccggactcaccgccgccgccgccgcgggatccgagtgcgggcgcgggcgcgggcgctcccggcgagccacggtggtgctggctagagtgtatacgtttggacccaagcttaacttttccaatgtggaatcctgggccttcattggttccgatgtcataggaatctacgctagagggcttcctgtgtgccgggcactgtgatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccattcacaggtcgaatttggggagcacaatggctggaggtcagatgcccactaggagatgctatgattaatatagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaaggatggctgttcagcacatgaaaacattaagaggtgccaccaatccatacacagaagcaaactacaaaccaacttttctatcagacgatgaattgaaacacctcattctcagggcagcagatggatttttgtttgtcgtaggatgtgaccgagggaagatactctttgtctcagagtctgtcttcaagatcctcaactacagccag

SEQ ID NO: 109006 - DNA, 1421 bp, Homo sapiens
  Payload ID: 1413
  Gene Symbol: ARNTL
  Gene Name: aryl hydrocarbon receptor nuclear translocator-like
  ENST ID: ENST00000524392
  CDS Start-End: 1-516
agggcaacagctattttggcatatttaccacaagaacttctaggcacatcgtgttatgaatattttcaccaagatgacataggacatcttgcagaatgtcataggcaagttttacagacgagagaaaaaattacaactaattgctataaatttaaaatcaaagatggttcttttatcacactacggagtcgatggttcagtttcatgaacccttggaccaaggaagtagaatatattgtctcaactaacactgttgttttgtccagagtggacaccggacaccttggccaagttgaatggtgcacagttctgagcaggcctgactcacgtttccttattgctgggatgttcacagagccaacgtcctggaaggcggggacccaaccttcccacagctcacagcatccccccacagcatggacagcatgctgccctctggagaaggtggcccaaagaggacccaccccactgttccagggattccagggggaacccgggctggggcaggaaaaataggccgaatgattgctgaggaaatcatggaaatccacaggataagagggtcatcgccttctagctgtggctccagcccattgaacatcacgagtacgcctccccctgatgcctcttctccaggaggcaagaagattttaaatggagggactccagacattccttccagtggcctactatcaggccaggctcaggagaacccaggttatccatattctgatagttcttctattcttggtgagaacccccacataggtatagacatgattgacaacgaccaaggatcaagtagtcccagtaatgatgaggcagcaatggctgtcatcatgagcctcttggaagcagatgctggactgggtggccctgttgactttagtgacttgccatggccgctgtaaacactacatgttgctttggcaacagctatagtatcaaagtgcattactggtggagttttacagtctgtgaagcttactggataaggagagaatagcttttatgtactgacttcataaaagccatctcagagccattgatacaagtcaatcttactatatgtaacttcagacaaagtggaactaagcctgctccagtgtttcctcatcattgattattgggctagctgtggatagcttgcattaattgtatattttggattctgtttgtgttgaattttttaatcattgtgcacagaagcatcattggtagcttttatatgcaaatggtcatttcagatgtatggtgtttttacactacaaagaagtcccccatgtggatatttcttatactaattgtatcataaagccgtttattcttccttgtaagaatcctttactataaatatgggttaaagtataatgtactagacagttaaatatttttaataaatgtttcccttgttctataaa

SEQ ID NO: 109007 - DNA, 739 bp, Homo sapiens
  Payload ID: 1413
  Gene Symbol: ARNTL
  Gene Name: aryl hydrocarbon receptor nuclear translocator-like
  ENST ID: ENST00000482049
  CDS Start-End: 523-739
gagtgcgggcgcgggcgcgggcgctcccggcgagccacggtggtgctggctagagtgtatacgtttggacccaagcttaacttttccaatgtggaatcctgggccttcattggttccgatgtcataggaatctacgctagagggcttcctgtgtgccgggcactgtggtttttggaagaagctgaccgcctgaaaagaaattataaaacatgaaaatcgctttgaggtgaccaagtccagaggcccctaactcctcccaagctggatctggggtgtaagaactgtgacttcagatcatccaatggcagaccagagaatggacatttcttcaaccatcagtgatttcatgtccccgggccccaccgacctgctttccagctctcttggtaccagtggtgtggattgcaaccgcaaacggaaaggcagctccactgactaccaacttgttgacttttcgtttgattcacaggtcgaatttggggagcacaatggctggaggtcagatgcccactaggagatgctatgattaatatagaaagcatggacacagacaaagatgaccctcatggaaggttagaatatacagaacaccaaggaaggataaaaaatgcaagggaagctcacagtcagattgaaaagcggcgtcgggataaaatgaacagttttatagatgaattggcttctttggtaccaacatgcaacgcaatgtccaggaaattagataaacttactgtgctaa

SEQ ID NO: 109008 - DNA, 1843 bp, Homo sapiens
  Payload ID: 1414
  Gene Symbol: ARNTL2
  Gene Name: aryl hydrocarbon receptor nuclear translocator-like 2
  Uniprot ID: Q8WYA1
  ENST ID: ENST00000261178
  CDS Start-End: 19-1785
gaccaagtggctcctgcgatggcggcggaagaggaggctgcggcgggaggtaaagtgttgagagaggagaaccagtgcattgctcctgtggtttccagccgcgtgagtccagggacaagaccaacagctatggggtctttcagctcacacatgacagagtttccacgaaaacgcaaaggaagtgattcagacccatcccaagaagctcatagccaaactgaaaagcggaggagagataaaatgaataacctgattgaagaactgtctgcaatgatccctcagtgcaaccccatggcgcgtaaactggacaaacttacagttttaagaatggctgttcaacacttgagatctttaaaaggcttgacaaattcttatgtgggaagtaattatagaccatcatttcttcaggataatgagctcagacatttaatccttaagactgcagaaggcttcttatttgtggttggatgtgaaagaggaaaaattctcttcgtttctaagtcagtctccaaaatacttaattatgatcaggctagtttgactggacaaagcttatttgacttcttacatccaaaagatgttgccaaagtaaaggaacaactttcttcttttgatatttcaccaagagaaaagctaatagatgccaaaactggtttgcaagttcacagtaatctccacgctggaaggacacgtgtgtattctggctcaagacgatcttttttctgtcggataaagagttgtaaaatctctgtcaaagaagagcatggatgcttacccaactcaaagaagaaagagcacagaaaattctatactatccattgcactggttacttgagaagctggcctccaaatattgttggaatggaagaagaaaggaacagtaagaaagacaacagtaattttacctgccttgtggccattggaagattacagccatatattgttccacagaacagtggagagattaatgtgaaaccaactgaatttataacccggtttgcagtgaatggaaaatttgtctatgtagatcaaagggcaacagcgattttaggatatctgcctcaggaacttttgggaacttcttgttatgaatattttcatcaagatgaccacaataatttgactgacaagcacaaagcagttctacagagtaaggagaaaatacttacagattcctacaaattcagagcaaaagatggctcttttgtaactttaaaaagccaatggtttagtttcacaaatccttggacaaaagaactggaatatattgtatctgtcaacactttagttttgggacatagtgagcctggagaagcatcatttttaccttgtagctctcaatcatcagaagaatcctctagacagtcctgtatgagtgtacctggaatgtctactggaacagtacttggtgctggtagtattggaacagatattgcaaatgaaattctggatttacagaggttacagtcttcttcataccttgatgattcgagtccaacaggtttaatgaaagatactcatactgtaaactgcaggagtatgtcaaataaggagttgtttccaccaagtccttctgaaatgggggagctagaggctaccaggcaaaaccagagtactgttgctgtccacagccatgagccactcctcagtgatggtgcacagttggatttcgatgccctatgtgacaatgatgacacagccatggctgcatttatgaattacttagaagcagaggggggcctgggagaccctggggacttcagtgacatccagtggaccctctagcctttgatttttaactccaaaaatgagaaacattttaaagcatttcatttacgaaaaa

SEQ ID NO: 109009 - DNA, 2291 bp, Homo sapiens
  Payload ID: 1414
  Gene Symbol: ARNTL2
  Gene Name: aryl hydrocarbon receptor nuclear translocator-like 2
  Uniprot ID: Q8WYA1
  ENST ID: ENST00000266503
  CDS Start-End: 19-1929
gaccaagtggctcctgcgatggcggcggaagaggaggctgcggcgggaggtaaagtgttgagagaggagaaccagtgcattgctcctgtggtttccagccgcgtgagtccagggacaagaccaacagctatggggtctttcagctcacacatgacagagtttccacgaaaacgcaaaggaagtgattcagacccatcccagtcaggaatcatgacagaaaaagtggtggaaaagctttctcagaatccccttacctatcttctttcaacaaggatagaaatatcagcctccagtggcagcagagtggaagatggtgaacaccaagttaaaatgaaggccttcagagaagctcatagccaaactgaaaagcggaggagagataaaatgaataacctgattgaagaactgtctgcaatgatccctcagtgcaaccccatggcgcgtaaactggacaaacttacagttttaagaatggctgttcaacacttgagatctttaaaaggcttgacaaattcttatgtgggaagtaattatagaccatcatttcttcaggataatgagctcagacatttaatccttaagactgcagaaggcttcttatttgtggttggatgtgaaagaggaaaaattctcttcgtttctaagtcagtctccaaaatacttaattatgatcaggctagtttgactggacaaagcttatttgacttcttacatccaaaagatgttgccaaagtaaaggaacaactttcttcttttgatatttcaccaagagaaaagctaatagatgccaaaactggtttgcaagttcacagtaatctccacgctggaaggacacgtgtgtattctggctcaagacgatcttttttctgtcggataaagagttgtaaaatctctgtcaaagaagagcatggatgcttacccaactcaaagaagaaagagcacagaaaattctatactatccattgcactggttacttgagaagctggcctccaaatattgttggaatggaagaagaaaggaacagtaagaaagacaacagtaattttacctgccttgtggccattggaagattacagccatatattgttccacagaacagtggagagattaatgtgaaaccaactgaatttataacccggtttgcagtgaatggaaaatttgtctatgtagatcaaagggcaacagcgattttaggatatctgcctcaggaacttttgggaacttcttgttatgaatattttcatcaagatgaccacaataatttgactgacaagcacaaagcagttctacagagtaaggagaaaatacttacagattcctacaaattcagagcaaaagatggctcttttgtaactttaaaaagccaatggtttagtttcacaaatccttggacaaaagaactggaatatattgtatctgtcaacactttagttttgggacatagtgagcctggagaagcatcatttttaccttgtagctctcaatcatcagaagaatcctctagacagtcctgtatgagtgtacctggaatgtctactggaacagtacttggtgctggtagtattggaacagatattgcaaatgaaattctggatttacagaggttacagtcttcttcataccttgatgattcgagtccaacaggtttaatgaaagatactcatactgtaaactgcaggagtatgtcaaataaggagttgtttccaccaagtccttctgaaatgggggagctagaggctaccaggcaaaaccagagtactgttgctgtccacagccatgagccactcctcagtgatggtgcacagttggatttcgatgccctatgtgacaatgatgacacagccatggctgcatttatgaattacttagaagcagaggggggcctgggagaccctggggacttcagtgacatccagtggaccctctagcctttgatttttaactccaaaaatgagaaacattttaaagcatttcatttacgaaaaactgtctcaactattcttaagtactgtattgatattgtttgtatcttttattaatgttctaccactttttatagatttgcatcttcctgtcacagggatgtggggaaatacgttttcctcccaagagaaccaagtttattatagactcctttattcagtgaaatggcttataatccactagttgccatatttttgctaaaatatttctaaccaagaatactacttacatattgttttggctttgttttatttttgatgcagttttttttagttgaggtaatgtaatatattgatgttttcctttg

SEQ ID NO: 109010 - DNA, 1888 bp, Homo sapiens
  Payload ID: 1414
  Gene Symbol: ARNTL2
  Gene Name: aryl hydrocarbon receptor nuclear translocator-like 2
  Uniprot ID: Q8WYA1
  ENST ID: ENST00000311001
  CDS Start-End: 19-1887
gaccaagtggctcctgcgatggcggcggaagaggaggctgcggcgggaggtaaagtgttgagagaggagaaccagtgcattgctcctgtggtttccagccgcgtgagtccagggacaagaccaacagctatggggtctttcagctcacacatgacagagtttccacgaaaacgcaaaggaagtgattcagacccatcccagtcaggaatcatgacagaaaaagtggtggaaaagctttctcagaatccccttacctatcttctttcaacaaggatagaaatatcagcctccagtggcagcagagaagctcatagccaaactgaaaagcggaggagagataaaatgaataacctgattgaagaactgtctgcaatgatccctcagtgcaaccccatggcgcgtaaactggacaaacttacagttttaagaatggctgttcaacacttgagatctttaaaaggcttgacaaattcttatgtgggaagtaattatagaccatcatttcttcaggataatgagctcagacatttaatccttaagactgcagaaggcttcttatttgtggttggatgtgaaagaggaaaaattctcttcgtttctaagtcagtctccaaaatacttaattatgatcaggctagtttgactggacaaagcttatttgacttcttacatccaaaagatgttgccaaagtaaaggaacaactttcttcttttgatatttcaccaagagaaaagctaatagatgccaaaactggtttgcaagttcacagtaatctccacgctggaaggacacgtgtgtattctggctcaagacgatcttttttctgtcggataaagagttgtaaaatctctgtcaaagaagagcatggatgcttacccaactcaaagaagaaagagcacagaaaattctatactatccattgcactggttacttgagaagctggcctccaaatattgttggaatggaagaagaaaggaacagtaagaaagacaacagtaattttacctgccttgtggccattggaagattacagccatatattgttccacagaacagtggagagattaatgtgaaaccaactgaatttataacccggtttgcagtgaatggaaaatttgtctatgtagatcaaagggcaacagcgattttaggatatctgcctcaggaacttttgggaacttcttgttatgaatattttcatcaagatgaccacaataatttgactgacaagcacaaagcagttctacagagtaaggagaaaatacttacagattcctacaaattcagagcaaaagatggctcttttgtaactttaaaaagccaatggtttagtttcacaaatccttggacaaaagaactggaatatattgtatctgtcaacactttagttttgggacatagtgagcctggagaagcatcatttttaccttgtagctctcaatcatcagaagaatcctctagacagtcctgtatgagtgtacctggaatgtctactggaacagtacttggtgctggtagtattggaacagatattgcaaatgaaattctggatttacagaggttacagtcttcttcataccttgatgattcgagtccaacaggtttaatgaaagatactcatactgtaaactgcaggagtatgtcaaataaggagttgtttccaccaagtccttctgaaatgggggagctagaggctaccaggcaaaaccagagtactgttgctgtccacagccatgagccactcctcagtgatggtgcacagttggatttcgatgccctatgtgacaatgatgacacagccatggctgcatttatgaattacttagaagcagaggggggcctgggagaccctggggacttcagtgacatccagtggaccctctagc

SEQ ID NO: 109011 - DNA, 1954 bp, Homo sapiens
  Payload ID: 1414
  Gene Symbol: ARNTL2
  Gene Name: aryl hydrocarbon receptor nuclear translocator-like 2
  Uniprot ID: Q8WYA1
  ENST ID: ENST00000395901
  CDS Start-End: 154-1953
gggctgcggtggcggccgccgcggcacccggcagggcccgccagtccccgcttccctgctccagagccgccgcctgggccggggcagggcgggcccggggctcctccatgctgccagccgcggggctgcggagccgaccaagtggctcctgcgatggcggcggaagaggaggctgcggcgggaggtgaggttgccggtggcgaggcgacggccccaggtaaagtgttgagagaggagaaccagtgcattgctcctgtggtttccagccgcgtgagtccagggacaagaccaacagctatggggtctttcagctcacacatgacagagtttccacgaaaacgcaaaggaagtgattcagacccatcccaagaagctcatagccaaactgaaaagcggaggagagataaaatgaataacctgattgaagaactgtctgcaatgatccctcagtgcaaccccatggcgcgtaaactggacaaacttacagttttaagaatggctgttcaacacttgagatctttaaaaggcttgacaaattcttatgtgggaagtaattatagaccatcatttcttcaggataatgagctcagacatttaatccttaagactgcagaaggcttcttatttgtggttggatgtgaaagaggaaaaattctcttcgtttctaagtcagtctccaaaatacttaattatgatcaggctagtttgactggacaaagcttatttgacttcttacatccaaaagatgttgccaaagtaaaggaacaactttcttcttttgatatttcaccaagagaaaagctaatagatgccaaaactggtttgcaagttcacagtaatctccacgctggaaggacacgtgtgtattctggctcaagacgatcttttttctgtcggataaagagttgtaaaatctctgtcaaagaagagcatggatgcttacccaactcaaagaagaaagagcacagaaaattctatactatccattgcactggttacttgagaagctggcctccaaatattgttggaatggaagaagaaaggaacagtaagaaagacaacagtaattttacctgccttgtggccattggaagattacagccatatattgttccacagaacagtggagagattaatgtgaaaccaactgaatttataacccggtttgcagtgaatggaaaatttgtctatgtagatcaaagggcaacagcgattttaggatatctgcctcaggaacttttgggaacttcttgttatgaatattttcatcaagatgaccacaataatttgactgacaagcacaaagcagttctacagagtaaggagaaaatacttacagattcctacaaattcagagcaaaagatggctcttttgtaactttaaaaagccaatggtttagtttcacaaatccttggacaaaagaactggaatatattgtatctgtcaacactttagttttgggacatagtgagcctggagaagcatcatttttaccttgtagctctcaatcatcagaagaatcctctagacagtcctgtatgagtgtacctggaatgtctactggaacagtacttggtgctggtagtattggaacagatattgcaaatgaaattctggatttacagaggttacagtcttcttcataccttgatgattcgagtccaacaggtttaatgaaagatactcatactgtaaactgcaggagtatgtcaaataaggagttgtttccaccaagtccttctgaaatgggggagctagaggctaccaggcaaaaccagagtactgttgctgtccacagccatgagccactcctcagtgatggtgcacagttggatttcgatgccctatgtgacaatgatgacacagccatggctgcatttatgaattacttagaagcagaggggggcctgggagaccctggggacttcagtgacatccagtggaccctctagc

SEQ ID NO: 109012 - DNA, 1959 bp, Homo sapiens
  Payload ID: 1414
  Gene Symbol: ARNTL2
  Gene Name: aryl hydrocarbon receptor nuclear translocator-like 2
  ENST ID: ENST00000457040
  CDS Start-End: 1-1766
ctcctgtggtttccagccgcgtgagtccagggacaagaccaacagctatggggtctttcagctcacacatgacagagtttccacgaaaacgcaaaggaagtgattcagacccatcccatcagaatccccttacctatcttctttcaacaaggatagaaatatcagcctccagtggcagcagagaagctcatagccaaactgaaaagcggaggagagataaaatgaataacctgattgaagaactgtctgcaatgatccctcagtgcaaccccatggcgcgtaaactggacaaacttacagttttaagaatggctgttcaacacttgagatctttaaaaggcttgacaaattcttatgtgggaagtaattatagaccatcatttcttcaggataatgagctcagacatttaatccttaagactgcagaaggcttcttatttgtggttggatgtgaaagaggaaaaattctcttcgtttctaagtcagtctccaaaatacttaattatgatcaggctagtttgactggacaaagcttatttgacttcttacatccaaaagatgttgccaaagtaaaggaacaactttcttcttttgatatttcaccaagagaaaagctaatagatgccaaaactggtttgcaagttcacagtaatctccacgctggaaggacacgtgtgtattctggctcaagacgatcttttttctgtcggataaagagttgtaaaatctctgtcaaagaagagcatggatgcttacccaactcaaagaagaaagagcacagaaaattctatactatccattgcactggttacttgagaagctggcctccaaatattgttggaatggaagaagaaaggaacagtaagaaagacaacagtaattttacctgccttgtggccattggaagattacagccatatattgttccacagaacagtggagagattaatgtgaaaccaactgaatttataacccggtttgcagtgaatggaaaatttgtctatgtagatcaaagggcaacagcgattttaggatatctgcctcaggaacttttgggaacttcttgttatgaatattttcatcaagatgaccacaataatttgactgacaagcacaaagcagttctacagagtaaggagaaaatacttacagattcctacaaattcagagcaaaagatggctcttttgtaactttaaaaagccaatggtttagtttcacaaatccttggacaaaagaactggaatatattgtatctgtcaacactttagttttgggacatagtgagcctggagaagcatcatttttaccttgtagctctcaatcatcagaagaatcctctagacagtcctgtatgagtgtacctggaatgtctactggaacagtacttggtgctggtagtattggaacagatattgcaaatgaaattctggatttacagaggttacagtcttcttcataccttgatgattcgagtccaacaggtttaatgaaagatactcatactgtaaactgcaggagtatgtcaaataaggagttgtttccaccaagtccttctgaaatgggggagctagaggctaccaggcaaaaccagagtactgttgctgtccacagccatgagccactcctcagtgatggtgcacagttggatttcgatgccctatgtgacaatgatgacacagccatggctgcatttatgaattacttagaagcagaggggggcctgggagaccctggggacttcagtgacatccagtggaccctctagcctttgatttttaactccaaaaatgagaaacattttaaagcatttcatttacgaaaaactgtctcaactattcttaagtactgtattgatattgtttgtatcttttattaatgttctaccactttttatagatttgcatcttcctgtcacagggatgtggggaaatacgttttcctcccaagagaaccaagtt

SEQ ID NO: 109013 - DNA, 1861 bp, Homo sapiens
  Payload ID: 1414
  Gene Symbol: ARNTL2
  Gene Name: aryl hydrocarbon receptor nuclear translocator-like 2
  Uniprot ID: Q8WYA1
  ENST ID: ENST00000546179
  CDS Start-End: 154-1776
gggctgcggtggcggccgccgcggcacccggcagggcccgccagtccccgcttccctgctccagagccgccgcctgggccggggcagggcgggcccggggctcctccatgctgccagccgcggggctgcggagccgaccaagtggctcctgcgatggcggcggaagaggaggctgcggcgggaggtgaggttgccggtggcgaggcgacggccccaggtaaagtgttgagagaggagaaccagtgcattgctcctgtggtttccagccgcgtgagtccagggacaagaccaacagctatggggtctttcagctcacacatgacagagtttccacgaaaacgcaaaggaagtgattcagacccatcccaagaagctcatagccaaactgaaaagcggaggagagataaaatgaataacctgattgaagaactgtctgcaatgatccctcagtgcaaccccatggcgcgtaaactggacaaacttacagttttaagaatggctgttcaacacttgagatctttaaaaggcttgacaaattcttatgtgggaagtaattatagaccatcatttcttcaggataatgagctcagacatttaatccttaagactgcagaaggcttcttatttgtggttggatgtgaaagaggaaaaattctcttcgtttctaagtcagtctccaaaatacttaattatgatcaggctagtttgactggacaaagcttatttgacttcttacatccaaaagatgttgccaaagtaaaggaacaactttcttcttttgatatttcaccaagagaaaagctaatagatgccaaaactggtttgcaagttcacagtaatctccacgctggaaggacacgtgtgtattctggctcaagacgatcttttttctgtcggataaagagttgtaaaatctctgtcaaagaagagcatggatgcttacccaactcaaagaagaaagagcacagaaaattctatactatccattgcactggttacttgagaagctggcctccaaatattgttggaatggaagaagaaaggaacagtaagaaagacaacagtaattttacctgccttgtggccattggaagattacagccatatattgttccacagaacagtggagagattaatgtgaaaccaactgaatttataacccggtttgcagtgaatggaaaatttgtctatgtagatcaaagggcaacagcgattttaggatatctgcctcaggaacttttgggaacttcttgttatgaatattttcatcaagatgaccacaataatttgactgacaagcacaaagcagttctacagagtaaggagaaaatacttacagattcctacaaattcagagcaaaagatggctcttttgtaactttaaaaagccaatggtttagtttcacaaatccttggacaaaagaactggaatatattgtatctgtcaacactttagttttgggacatagtgagcctggagaagcatcatttttaccttgtagctctcaatcatcagaagaatcctctagacagtcctgtatgagtgtacctggaatgtctactggaacagtacttggtgctggtagtattggaacagatattgcaaatgaaattctggatttacagaggttacagtcttcttcataccttgatgattcgagtccaacaggtttaatgaaagatactcatactgtaaactgcaggagtgtgatggtgcacagttggatttcgatgccctatgtgacaatgatgacacagccatggctgcatttatgaattacttagaagcagaggggggcctgggagaccctggggacttcagtgacatccagtggaccctctagcctttgatttttaactc

SEQ ID NO: 109014 - DNA, 6785 bp, Homo sapiens
  Payload ID: 1414
  Gene Symbol: ARNTL2
  Gene Name: aryl hydrocarbon receptor nuclear translocator-like 2
  Uniprot ID: Q8WYA1
  ENST ID: ENST00000544915
  CDS Start-End: 220-2028
ctccagtccgcatgctcagtagctgctgccggccgggctgcggggcggcgtcccgtgcgcgcctacgggctgcggtggcggccgccgcggcacccggcagggcccgccagtccccgcttccctgctccagagccgccgcctgggccggggcagggcgggcccggggctcctccatgctgccagccgcggggctgcggagccgaccaagtggctcctgcgatggcggcggaagaggaggctgcggcgggaggtaaagtgttgagagaggagaaccagtgcattgctcctgtggtttccagccgcgtgagtccagggacaagaccaacagctatggggtctttcagctcacacatgacagagtttccacgaaaacgcaaaggaagtgattcagacccatcccaagtggaagatggtgaacaccaagttaaaatgaaggccttcagagaagctcatagccaaactgaaaagcggaggagagataaaatgaataacctgattgaagaactgtctgcaatgatccctcagtgcaaccccatggcgcgtaaactggacaaacttacagttttaagaatggctgttcaacacttgagatctttaaaaggcttgacaaattcttatgtgggaagtaattatagaccatcatttcttcaggataatgagctcagacatttaatccttaagactgcagaaggcttcttatttgtggttggatgtgaaagaggaaaaattctcttcgtttctaagtcagtctccaaaatacttaattatgatcaggctagtttgactggacaaagcttatttgacttcttacatccaaaagatgttgccaaagtaaaggaacaactttcttcttttgatatttcaccaagagaaaagctaatagatgccaaaactggtttgcaagttcacagtaatctccacgctggaaggacacgtgtgtattctggctcaagacgatcttttttctgtcggataaagagttgtaaaatctctgtcaaagaagagcatggatgcttacccaactcaaagaagaaagagcacagaaaattctatactatccattgcactggttacttgagaagctggcctccaaatattgttggaatggaagaagaaaggaacagtaagaaagacaacagtaattttacctgccttgtggccattggaagattacagccatatattgttccacagaacagtggagagattaatgtgaaaccaactgaatttataacccggtttgcagtgaatggaaaatttgtctatgtagatcaaagggcaacagcgattttaggatatctgcctcaggaacttttgggaacttcttgttatgaatattttcatcaagatgaccacaataatttgactgacaagcacaaagcagttctacagagtaaggagaaaatacttacagattcctacaaattcagagcaaaagatggctcttttgtaactttaaaaagccaatggtttagtttcacaaatccttggacaaaagaactggaatatattgtatctgtcaacactttagttttgggacatagtgagcctggagaagcatcatttttaccttgtagctctcaatcatcagaagaatcctctagacagtcctgtatgagtgtacctggaatgtctactggaacagtacttggtgctggtagtattggaacagatattgcaaatgaaattctggatttacagaggttacagtcttcttcataccttgatgattcgagtccaacaggtttaatgaaagatactcatactgtaaactgcaggagtatgtcaaataaggagttgtttccaccaagtccttctgaaatgggggagctagaggctaccaggcaaaaccagagtactgttgctgtccacagccatgagccactcctcagtgatggtgcacagttggatttcgatgccctatgtgacaatgatgacacagccatggctgcatttatgaattacttagaagcagaggggggcctgggagaccctggggacttcagtgacatccagtggaccctctagcctttgatttttaactccaaaaatgagaaacattttaaagcatttcatttacgaaaaactgtctcaactattcttaagtactgtattgatattgtttgtatcttttattaatgttctaccactttttatagatttgcatcttcctgtcacagggatgtggggaaatacgttttcctcccaagagaaccaagtttattatagactcctttattcagtgaaatggcttataatccactagttgccatatttttgctaaaatatttctaaccaagaatactacttacatattgttttggctttgttttatttttgatgcagttttttttagttgaggtaatgtaatatattgatgttttcctttgtgtctaagattcatttataatagtaggtttgtataatttggaacattttccattccttgcgaatttccttaattgaggatagggcttacacactttaagaaaacagtgagtacttgaacatttaaagggacagtgcaatttatagtcataatcacattgaatactgtatttgatctttggagacttaggcaagcacagagctgggatatttatgctcagttgagcactttaagatgaattttaagtgagatgatttcttgcttaaaactcagaaagtcaaaagagtttcagctttccttacagaaaaggaaggatcttgggccctagatcttggggattaacctctgcatataagatttactcttaataggccagacgtggtggctcacgcctgtaatcccagtactttgggaggctgagacgggcagatcacttgaggtcaggagttcaagaccagcctggccaatatggtgaaaccccgtttctactaaaaatacaaaaaaaattacccaggcactcactcttgaggtaactaaccaactcccacgataatgacagtccattcatgagcgcaaaggcctcatgacctaatggcacacacctgtaatcccaactgcttgggaggctgaggcgagaggattgcttgaacctgggaggcagaggttgcagtgagccgagatcgcaccactgcactccagtctgggcaacagagtgagacttcatctcaaaaaaagtaaaaaaaaagatttaatataatcactgaagatctctattatagatagattaggtttttgacattggaaacatacttagggatagatttgtcctaaaggaaaaaagtaggcccgggcagattaaatgtcttgtgtaaagtcacacattaaattcagtcacacattaaattcatagagttttaaatgtttaatgtatataaaccagtttctttatacacatttgggaaaacattggtctcacagattaaatgattaactaactgacccaggaactagttgtagctttctaagtaattaggcaattacagttattgcctgtaaccaaaggtaataaaacaaaatgacaagtacatgtttaaaattatgaggcaatgagaaataatttaaaaaccaattttctagttataatttaaaatttggagagcatttttaacagtaattaatccagaggtggctcaaattgagtataagaattaagattatttaaaatactgcatgtctaccttctcggggatcatactttataacactttctgcttcagtagctcttcatagcttgccaagtatgctcccatattttctctctcgtgcctcgcaaatgaaagtcagataggctgggaactcatggggcagccctcagacttcaatgtgggcttcaaatccagtttcctgttctatatggtgctacatctttccagaaaatttccctcagagcccctcgccaaaacaaagcattattttgaccctgcatgctatttctttagctgtaggtgatagattagaacttctgtcagacatgttaatgacaaacataccaacagacaataaccaaaagcaaatgtttccttcaagtgtgaaatgtgcaggggcttcgtgggcaaggatgtattggcacactgtcctcttgaactgatagtgtcccagcaatgttggagggttggcaccattcctggtccgacacttgaggacctgagagacatcaggtttagaatgagccaaagaaatcctacaagatggggagaattggtgtgcagcagcctaagtgttatagttaagtctaaagaagtatgaaagatcccctgtgttctctaaattgagcagaggggcctgcctaccaatatcactttttaggggactgaaccattgcaggttagacttggcttccaaagagtctgcctaagccaggggtggcagggtaggccatcatagctggatggcctcaaaagcagatgggggcagacttgccctcgtgatgccaggatttgagaggcagagtttctagagggagaccagtgctgcctctcacagtggcagttttttctctttgcaagaggaggggctgttcaattccatagaccagtgggcagatagccagttgaatactctgtgcatggtttgatcctttattagttcgctctaatatttttctgtagatccttttgtcctggactcaaaatctaatccatgcattgtatgataccgtagctctcctaaggtttgtgtttccttcaaaatgttttagttttcttcaactaaatttgatttttgctgttagaagtgacatatttttatggtatacactatgttccttttttctactgcgagtcaattttttgaattttcgtgagaaagaatatatctacaaattgcacgaaagtatcataaaaacagtactctagacttttcttttcttttctttttttttttttttttttttttgagatggagtctcgctctatcgcccaggctggagtgcagtggcgcgatcttggctcactgccatctctgcctcctgggttcacgccattctgcctcagcctccagagcagctgggaccacaggcgcccgccaccacacctggctaattttgctttgtattttcagtagagacggggtttcaccatgttagccaggatggtctcgatctcctgacctcgtgatccgcccacttcggcctcccaaagtgctgggattacaggcatgagccactgcgcccggcctactctacactttttttaaccctaagaattaccactacagtaatgtagtggagtgggaagagtgcctggaatcagaagaccctgttgaggctgaatttagctgtatgacctcatgcaagccatttaaactctgtgcctcagcgtcctcatttttaaaaggaggtttgatctctatgtttacttccagctctgattctgggattctaatccacaggacttgggtgttagggtggaacctagaactgtgctgtccagtgcagtagccactagccacatgtggctactgagcacttgcaatgtggctagtacaaagtgagatgtgctatcaatgtaagatacataccagattttgaagactagtattaccaaaagaatgtaaaatatcacattaataattttatattaattacatgttcaaatgatattttggatatactgaattaaaacattaaaattagttctacttgtatctttttacttttttaatgtggctagaagaaaataaaattatacatgtggctcagattatatttctattggacagcgctgctctagaacattatattaagtggttattattgaagtagaccaaagtttataccataaggatatttttccttaaataccatgtttgaagaacaattatttattgatccttgaatctgtaagatcaaataacaagtctctatccatgttaccaaatttaaacttttgaaaataataaactttaaaatatcagatgtgttattacaggatgatacttggaatcaagtgaaatgagttatatggtcatcactaaatttagaaatctattgtgaaacaaagacaaacaggaaagtacagaatagagacttttagtaaataaatggaatttaaaagaaagtgtttatttacagtgtcacgacagaaaaggatgtctttgttgtcatagtctttgagggatctccgtaaaatctggggcacaggtacaagaaatagccaatatttagttcccagaccatgtttagtagtgtccagtttcagatcatgctgccaagaggtatctccccctcaggtgggtcatcactgagccctggaattggagactcatacttgcccagcacaatgttacgggcagacaggccgacatctatgattagctagaagccataaagaaaagctgctaagtggccactaggtgccacttttctgtttttgtaatgctttcattagcagatcttttttttccaagctccatggggcctatgagaggcatttatgatttttgtgcctacaataagtcagcctgtctggtgtgagttgttttatgagaaatgctttccaagggaggtctaggaagatcctgacacataagaactttggcttagagagctttccaggtgtagtgccaataaaaactgacctggaaagaaaacctgcccagcacggaacatgctttctgaactcacttgagagtgtatggtgtatgtcacttctcatatattcttgagtttagatttgtcttttatacaatttttagctcttttccagttcacttgtgctcgtctgtatattggtatttttaaatttttgtggtaaataatgaaaagagtgaaattatattttataattactcatttgtagtttttttttttaatttaataaacttcctccaaaaagtg

SEQ ID NO: 109015 - DNA, 1720 bp, Homo sapiens
  Payload ID: 1414
  Gene Symbol: ARNTL2
  Gene Name: aryl hydrocarbon receptor nuclear translocator-like 2
  Uniprot ID: Q8WYA1
  ENST ID: ENST00000542388
  CDS Start-End: 7-1662
acagctatggggtctttcagctcacacatgacagagtttccacgaaaacgcaaaggaagtgattcagacccatcccaagaagctcatagccaaactgaaaagcggaggagagataaaatgaataacctgattgaagaactgtctgcaatgatccctcagtgcaaccccatggcgcgtaaactggacaaacttacagttttaagaatggctgttcaacacttgagatctttaaaaggcttgacaaattcttatgtgggaagtaattatagaccatcatttcttcaggataatgagctcagacatttaatccttaagactgcagaaggcttcttatttgtggttggatgtgaaagaggaaaaattctcttcgtttctaagtcagtctccaaaatacttaattatgatcaggctagtttgactggacaaagcttatttgacttcttacatccaaaagatgttgccaaagtaaaggaacaactttcttcttttgatatttcaccaagagaaaagctaatagatgccaaaactggtttgcaagttcacagtaatctccacgctggaaggacacgtgtgtattctggctcaagacgatcttttttctgtcggataaagagttgtaaaatctctgtcaaagaagagcatggatgcttacccaactcaaagaagaaagagcacagaaaattctatactatccattgcactggttacttgagaagctggcctccaaatattgttggaatggaagaagaaaggaacagtaagaaagacaacagtaattttacctgccttgtggccattggaagattacagccatatattgttccacagaacagtggagagattaatgtgaaaccaactgaatttataacccggtttgcagtgaatggaaaatttgtctatgtagatcaaagggcaacagcgattttaggatatctgcctcaggaacttttgggaacttcttgttatgaatattttcatcaagatgaccacaataatttgactgacaagcacaaagcagttctacagagtaaggagaaaatacttacagattcctacaaattcagagcaaaagatggctcttttgtaactttaaaaagccaatggtttagtttcacaaatccttggacaaaagaactggaatatattgtatctgtcaacactttagttttgggacatagtgagcctggagaagcatcatttttaccttgtagctctcaatcatcagaagaatcctctagacagtcctgtatgagtgtacctggaatgtctactggaacagtacttggtgctggtagtattggaacagatattgcaaatgaaattctggatttacagaggttacagtcttcttcataccttgatgattcgagtccaacaggtttaatgaaagatactcatactgtaaactgcaggagtatgtcaaataaggagttgtttccaccaagtccttctgaaatgggggagctagaggctaccaggcaaaaccagagtactgttgctgtccacagccatgagccactcctcagtgatggtgcacagttggatttcgatgccctatgtgacaatgatgacacagccatggctgcatttatgaattacttagaagcagaggggggcctgggagaccctggggacttcagtgacatccagtggaccctctagcctttgatttttaactccaaaaatgagaaacattttaaagcatttcatttacgaaaaa

SEQ ID NO: 109016 - DNA, 1642 bp, Homo sapiens
  Payload ID: 1415
  Gene Symbol: AADAC
  Gene Name: arylacetamide deacetylase
  Uniprot ID: P22760
  ENST ID: ENST00000232892
  CDS Start-End: 127-1326
gagcaactctgttttcaaagcttttgggtggagctgaagcacactgcttattaaagtacactattcaggcatatcatgtaggtttactttctgtgtttctagagaccaagaagcgggacgttcaccatgggaagaaaatcgctgtaccttctgattgtggggatcctcatagcatattatatttatacgcctctcccagataacgttgaggagccatggagaatgatgtggataaacgcacatctgaaaactatacaaaatttggctacatttgtggagctcctgggacttcaccattttatggattcctttaaggttgtcgggagctttgatgaagtcccaccaacctcagatgaaaatgtcactgtgactgagacaaaattcaacaacattcttgttcgggtatatgtgccaaagagaaagtctgaagcactaagaagggggttgttttacatccatggtggaggctggtgcgtgggaagtgctgctctaagtggttatgacttgctgtcaagatggacagcagacagacttgatgctgtcgtcgtatcaaccaactacagattagcacctaagtatcatttcccaattcaatttgaagatgtatataatgccttaaggtggttcttacgtaaaaaagttcttgcaaaatatggtgtgaaccctgagagaatcggtatttctggagatagtgcaggagggaatttagctgcagcagtgactcaacagctccttgatgacccagatgtcaagatcaaactcaagatccagtctttaatttatcctgcccttcagcctcttgatgtagatttaccgtcatatcaagaaaattcaaattttctatttctatccaaatcactcatggtcagattctggagtgaatattttaccactgatagatcacttgaaaaagccatgctttccagacaacatgtacctgtggaatcaagtcatctcttcaaatttgttaattggagttccctgctccctgagaggtttataaaaggacatgtttataacaatccaaattatggcagttctgagctggctaaaaaatatccagggttcctagatgtgagggcagcccctttgttggctgatgacaacaaattacgtggcttacccctgacctatgtcatcacctgtcaatatgatctcttaagagatgatggactcatgtatgtcacccgacttcgcaacactggggttcaggtgactcataaccatgttgaggatggattccatggagcattttcatttctgggacttaaaattagtcacagacttataaatcagtatattgagtggctaaaggaaaatctatagtaaaacatgtagctataacatattttaaaaataaaatctgaaaacctcagaaaatttgcattagaaattggtctttcttagaatggtctagttaagttccacatgtagcataattcttaaataggcacttttctgttttttttttcttactgtgggatttcatttcaattttctacattgtctatctgctttttctgagattttccttcttacactgttaatcttattttaaaaaatattacattcttgtatactttatttttgtgagttggctactatttacgatgcaagagaataaatgtgagcaaatattgcc

SEQ ID NO: 109017 - DNA, 719 bp, Homo sapiens
  Payload ID: 1415
  Gene Symbol: AADAC
  Gene Name: arylacetamide deacetylase
  ENST ID: ENST00000488869
  CDS Start-End: 91-705
aagcacactgcttattaaagtacactattcaggcatatcatgtaggtttactttctgtgtttctagagaccaagaagcgggacgttcaccatgggaagaaaatcgctgtaccttctgattgtggggatcctcatagcatattatatttatacgcctctcccagataacgttgaggagccatggagaatgatgtggataaacgcacatctgaaaactatacaaaatttggctacatttgtggagctcctgggacttcaccattttatggattcctttaaggttgtcgggagctttgatgaagtcccaccaacctcagatgaaaatgtcactgtgactgagacaaaattcaacaacattcttgttcgggtatatgtgccaaagagaaagtctgaagcactaagaagggggttgttttacatccatggtggaggctggtgcgtgggaagtgctgctctaagtggttatgacttgctgtcaagatggacagcagacagacttgatgctgtcgtcgtatcaaccaactacagattagcacctaagtatcatttcccaattcaatttgaagatgtatataatgccttaaggtggttcttacgtaaaaaagttcttgcaaaatatggtgtgaaccctgagagaatcggtatttctggagatagtgcaggagggaatttagctgcagcagtgactcaacaggtatgttcataatttctatgcttttt

SEQ ID NO: 109018 - DNA, 1487 bp, Homo sapiens
  Payload ID: 1416
  Gene Symbol: AADACL2
  Gene Name: arylacetamide deacetylase-like 2
  Uniprot ID: Q6P093
  ENST ID: ENST00000356517
  CDS Start-End: 110-1315
atatcacctgagagagttcccaagtctacaattgctctactagttactattcagtgtttgtgaaaaattttaatctcagtactgtgaagaagctggaaaaagggatattatggggctaaaagctctctgtttggggctgctttgtgttctttttgtctctcatttttacacacccatgccagacaacattgaagaaagctggaaaataatggccttggatgccatcgctaaaacttgtacatttacggctatgtgttttgaaaatatgcgtattatgagatatgaagagtttatatccatgatattcaggctggattatacccaaccactttcagatgaatacatcacagtgactgatacaacatttgttgacattccagtacgattgtacttgccaaaaagaaagtcagaaacccgaaggcgagctgtgatatattttcatggtggtggtttttgttttggaagttccaaacagagggcttttgacttcctgaatagatggacggcaaacacgcttgatgctgttgttgtaggcgtggactataggctggctcctcaacaccactttcctgctcagtttgaagatggccttgctgcagtcaaattttttcttttggaaaaaattcttacaaaatatggagtggatcccacccgaatctgcattgcgggagacagttctgggggcaatttagcaacagcggtcactcaacaggtgcagaatgatgctgaaataaaacataaaatcaagatgcaagtcttactttaccctggcttacagataacagattcttatttgccatctcaccgagaaaatgagcatggtatagttttgaccagggatgtagccataaaactcgtgagcttatatttcaccaaggatgaagcacttccctgggcaatgagaagaaaccaacacatgcctctggagtcaagacatctgtttaagtttgttaactggagtattcttcttcctgagaagtatagaaaagactatgtatatactgaaccaattcttggaggacttagttattcattgccaggacttacagacagcagagcattacccttgttggccaatgattctcagttacagaatttgccactaacctatattcttacttgtcaacatgatctcttaagagatgatggacttatgtatgttacaagacttcgaaatgttggagtccaagttgttcatgaacatattgaggatggaattcatggagctttatcattcatgacttcaccattttatttacgtctaggtcttaggataagagatatgtatgtaagttggctggataagaatttataaatatgtgatgtgtatgtatagcccttacatagtggattgtaatttgtgatattttgtggttttggagcaaagaacaatgtcatttgagttatctaaatctacatttgcaacatttgtagcagttaatgtgtgtccttgaagagttattaaattttctgacttgcagaccctg

SEQ ID NO: 109019 - DNA, 4848 bp, Homo sapiens
  Payload ID: 1416
  Gene Symbol: AADACL2
  Gene Name: arylacetamide deacetylase-like 2
  ENST ID: ENST00000445270
  CDS Start-End: 121-282
ttaagatgatcatatcacctgagagagttcccaagtctacaattgctctactagttactattcagtgtttgtgaaaaattttaatctcagtactgtgaagaagctggaaaaagggatattatggggctaaaagctctctgtttggggctgctttgtgttctttttgtctctcatttttacacacccatgccagacaacattgaagaaagctggaaaataatggccttggatgccatcgctaaaacttgtacatttacgaacagagggcttttgacttcctgaatagatggacggcaaacacgcttgatgctgttgttgtaggcgtggactataggctggctcctcaacaccactttcctgctcagtttgaagatggccttgctgcagtcaaattttttcttttggaaaaaattcttacaaaatatggagtggatcccacccgaatctgcattgcgggagacagttctgggggcaatttagcaacagcggtcactcaacaggtgcagaatgatgctgaaataaaacataaaatcaagatgcaagtcttactttaccctggcttacagataacagattcttatttgccatctcaccgagaaaatgagcatggtatagttttgaccagggatgtagccataaaactcgtgagcttatatttcaccaaggatgaagcacttccctgggcaatgagaagaaaccaacacatgcctctggagtcaagacatctgtttaagtttgttaactggagtattcttcttcctgagaagtatagaaaagactatgtatatactgaaccaattcttggaggacttagttattcattgccaggacttacagacagcagagcattacccttgttggccaatgattctcagttacagaatttgccactaacctatattcttacttgtcaacatgatctcttaagagatgatggacttatgtatgttacaagacttcgaaatgttggagtccaagttgttcatgaacatattgaggatggaattcatggagctttatcattcatgacttcaccattttatttacgtctaggtcttaggataagagatatgtatgtaagttggctggataagaatttataaatatgtgatgtgtatgtatagcccttacatagtggattgtaatttgtgatattttgtggttttggagcaaagaacaatgtcatttgagttatctaaatctacatttgcaacatttgtagcagttaatgtgtgtccttgaagagttattaaattttctgacttgcagaccctgaatatgtaaaatgtatgtaatcctgcctattttctccttacttataatttattataattatgttggttctaataagaaccaatgcttattaaagttgagaaataagagtggttattggcaaattaagcaagatactttccagataggcacagaaattgttgtagtgagtgggaagaggaaaaaacatggaacaaacttgctgctaaaaatatatggaaaccactggactaaataaaccctaaggaccctatattagtttcctgtgactattgtagcaaattactacaaattcagtcgctttaaacaacagatatttattcttttacagttctggggtcctaaagcatgaaattagtattaactaggcccaaaccaagtcacaggcaagagacatgactcccttggagactctctagaaggtgctctttgcctcttttaacctctggtggctgccagtattctttgactattcttagatcagtttaatcttgaaggccagcatcttccaatctctttctgcttcatcttcacattgccttcttctctgcctgtgtctaatctccctatgggcttctcttagaaaaacacatgtgtttacatttaggagggtccacctgaatagtctaggataatctctgcatctcacgatcctcaatttaattgtatttgcagatttccccacccttttctatataaagtaaccttcagagattaggatgtagttatcttttgggaggccatttttaaaaatattttttaaaggaggcagcagatcaatattataattcaagaatctgatctaaatatgcattcaataatgaagaacatttgagtatggactagaaaagcttctccaaaaaactttcaaatatatcatctcaaattacctaaagaataaatcacttctgtagcccttttgttgagtggaatcataaacaaaaaactgaaaatttattgctatgaaaacagatccatggtacaatgttataaattttgagtattaagcatagtcagttgaatccaactaagaagttaaaaatgtagtaagaaatgtgtatatgtatgagtatgtgcatgtgtgtgggaaaaatctaccatccaattgacccaaaaacaacttactcagttgggaccagacatttttctcaattctccatgattcagaaggcaattaagaattacaatttcaacagtccacaaacaaaataagatttttttaatgtagagagaaattaattatgttcaaagagccctttttctttcactcaatttcagtaccccaaagctaaaaacgcaaacatgactatgacaaatgaaaataagtatcatgggaatctgtttttttcctctgagaaataaaatctaaatggagatttgatactatatgctatactacatacactaagaatattgtatttttcataattctgatttaatctcctgtaaacttgatatattttaaaatttgtaatttgtttttcatgatactgaatctggttccagttctttttcatcatttaatatactggctacccgttctaattaggaaaacaagtcctagaaatctcttcattttgacagcaagtgctgatttgtaagaaaatcattaaaaatgcagctctctaggaagcacattttgttgattgtcctattgtctgaacattttcacagtgattcctgactaaaaatccttttaattttgtaagcactacactagtgtgtcatgtcactagtatgtactttcaagcctttaaacagaaaggatggctcacagctagataataactaagtttgttttcgttttgaaaaagtttgtatcttgcagagcagaaaagcacttctttttttgctacataagtatgtggtagaaatgtatgctaaggtaggccagtcaatccttttttatttattttgtaaatttggtcccagaatatttctggaaggaaccacaggtagactagcttccattgcagtcccttacctcactaacttcttttgtggctttatccaggcactgttactgtttgtatgctaaagggttcatttcactgggtcttactttcaaagtttgttccattttgtgtggtggcatgagcattgtgatcaagccattaagtttggaaacaactgaatgaaagtcgtctgttataatgtattttactttatttttaaatttcattttaaattgacaataattgtacatattcatgggatacatagtgacgtttcaatacatatcatgtatagtgattatatcagggtaatcggcacatcatctcaaacatttatcatttctttgtgttgggaatttcaatatcttttttttagctgtttgagattatgtaatatattattgttaactatagtcatcctacagtggtatagaaactacctagctgtaatgatgtatcttttaacaaatctaatttatttcttgacagtataggggaagacttgattacaccccatggcattacagctaaaaattccaacgttttcagtctctttgtagctatgttatccagacattgatttgtatttacatctcatcttcctttctaagagaaacagtgatgcagaacctgagagtcaaatttaatattctctaggtaccaaggcaagggtttatgttacagtttgtgtactagtccaagtcccaagttgtgacgatacagctccataacctacctttataccacccagggaaagtatacagaagaaattcttgacttcatctatccgaatttctacaagtcatctgttatttttctgataatctgcctgtgtctcctggaaacataaggtgtaggtttctgacacatatatctaacatgtaaagaagtaacaatttccaaaatacctccaaacagcgccacatcctaaaggaaatttctaggtttttctgctgaaatatccattccagcattgtgtttgtttgctagagctgctataacaaagtatcacaaactgagtgccttaaataaacaaaaggaatttattactttgtggttcagaaggctagaagttggagatcaaggtgtcatcacaccatggtccctctgaaggcaccaaggatggatctgtttcaggactcctggcctgtagcagcataactccaatcttcacatgatattctcccgttgtatgtgttcttccccaattttccctttttataaagatagcagtcagattagattagggcctatcctaataatttcattttaacctgactgtctttgtaaagaccctatctgcaaataaaatcacatgtaaagtattggggcttaggactccaacatatagatatgttttatatatatggtgagatatatatatatttttttatatatggtgagatatatatttatatatggtgagatatatatatatatggtgagatatatatttatatatatggtgagatatatacatattgtgatatatatatatatatatatatatatatatatatatatgaatttggtggaacacaaaagaacacctagcaagtatcatatgttccaatttcttaaaagtaaataaaggccttgtgccattggtggtgttctgaaa

SEQ ID NO: 109020 - DNA, 1487 bp, Homo sapiens; identical to SEQ ID NO: 109018
  Payload ID: 1416
  Gene Symbol: AADACL2
  Gene Name: arylacetamide deacetylase-like 2
  Uniprot ID: Q6P093
  ENST ID: ENST00000570799
  CDS Start-End: 110-1315

SEQ ID NO: 109021 - DNA, 3007 bp, Homo sapiens
  Payload ID: 1416
  Gene Symbol: AADACL2
  Gene Name: arylacetamide deacetylase-like 2
  ENST ID: ENST00000576369
  CDS Start-End: 121-282
ttaagatgatcatatcacctgagagagttcccaagtctacaattgctctactagttactattcagtgtttgtgaaaaattttaatctcagtactgtgaagaagctggaaaaagggatattatggggctaaaagctctctgtttggggctgctttgtgttctttttgtctctcatttttacacacccatgccagacaacattgaagaaagctggaaaataatggccttggatgccatcgctaaaacttgtacatttacgaacagagggcttttgacttcctgaatagatggacggcaaacacgcttgatgctgttgttgtaggcgtggactataggctggctcctcaacaccactttcctgctcagtttgaagatggccttgctgcagtcaaattttttcttttggaaaaaattcttacaaaatatggagtggatcccacccgaatctgcattgcgggagacagttctgggggcaatttagcaacagcggtcactcaacaggtgcagaatgatgctgaaataaaacataaaatcaagatgcaagtcttactttaccctggcttacagataacagattcttatttgccatctcaccgagaaaatgagcatggtatagttttgaccagggatgtagccataaaactcgtgagcttatatttcaccaaggatgaagcacttccctgggcaatgagaagaaaccaacacatgcctctggagtcaagacatctgtttaagtttgttaactggagtattcttcttcctgagaagtatagaaaagactatgtatatactgaaccaattcttggaggacttagttattcattgccaggacttacagacagcagagcattacccttgttggccaatgattctcagttacagaatttgccactaacctatattcttacttgtcaacatgatctcttaagagatgatggacttatgtatgttacaagacttcgaaatgttggagtccaagttgttcatgaacatattgaggatggaattcatggagctttatcattcatgacttcaccattttatttacgtctaggtcttaggataagagatatgtatgtaagttggctggataagaatttataaatatgtgatgtgtatgtatagcccttacatagtggattgtaatttgtgatattttgtggttttggagcaaagaacaatgtcatttgagttatctaaatctacatttgcaacatttgtagcagttaatgtgtgtccttgaagagttattaaattttctgacttgcagaccctgaatatgtaaaatgtatgtaatcctgcctattttctccttacttataatttattataattatgttggttctaataagaaccaatgcttattaaagttgagaaataagagtggttattggcaaattaagcaagatactttccagataggcacagaaattgttgtagtgagtgggaagaggaaaaaacatggaacaaacttgctgctaaaaatatatggaaaccactggactaaataaaccctaaggaccctatattagtttcctgtgactattgtagcaaattactacaaattcagtcgctttaaacaacagatatttattcttttacagttctggggtcctaaagcatgaaattagtattaactaggcccaaaccaagtcacaggcaagagacatgactcccttggagactctctagaaggtgctctttgcctcttttaacctctggtggctgccagtattctttgactattcttagatcagtttaatcttgaaggccagcatcttccaatctctttctgcttcatcttcacattgccttcttctctgcctgtgtctaatctccctatgggcttctcttagaaaaacacatgtgtttacatttaggagggtccacctgaatagtctaggataatctctgcatctcacgatcctcaatttaattgtatttgcagatttccccacccttttctatataaagtaaccttcagagattaggatgtagttatcttttgggaggccatttttaaaaatattttttaaaggaggcagcagatcaatattataattcaagaatctgatctaaatatgcattcaataatgaagaacatttgagtatggactagaaaagcttctccaaaaaactttcaaatatatcatctcaaattacctaaagaataaatcacttctgtagcccttttgttgagtggaatcataaacaaaaaactgaaaatttattgctatgaaaacagatccatggtacaatgttataaattttgagtattaagcatagtcagttgaatccaactaagaagttaaaaatgtagtaagaaatgtgtatatgtatgagtatgtgcatgtgtgtgggaaaaatctaccatccaattgacccaaaaacaacttactcagttgggaccagacatttttctcaattctccatgattcagaaggcaattaagaattacaatttcaacagtccacaaacaaaataagatttttttaatgtagagagaaattaattatgttcaaagagccctttttctttcactcaatttcagtaccccaaagctaaaaacgcaaacatgactatgacaaatgaaaataagtatcatgggaatctgtttttttcctctgagaaataaaatctaaatggagatttgatactatatgctatactacatacactaagaatattgtatttttcataattctgatttaatctcctgtaaacttgatatattttaaaatttgtaatttgtttttcatgatactgaatctggttccagttctttttcatcatttaatatactggctacccgttctaattaggaaaacaagtcctagaaatctcttcattttgacagcaagtgctgatttgtaagaaaatcattaaaaatgcagctctctaggaagcacattttgttgattgtcctattgtctgaacattttcacagtgattcctgactaaaaatccttttaattttgtaagcactacactagtgtgtcatgtcacta

SEQ ID NO: 109022 - DNA, 3662 bp, Homo sapiens
  Payload ID: 1417
  Gene Symbol: AADACL3
  Gene Name: arylacetamide deacetylase-like 3
  Uniprot ID: Q5VUY0
  ENST ID: ENST00000359318
  CDS Start-End: 35-1258
gcttcctctcagcccgctctgagctggaagcagcatgtgggacctggccctgatcttcctcgcagcagcctgcgtgttctcactaggggtcactctgtgggtcatttgcagccattttttcactgtgcacatccctgcagcggttggccaccctgtgaaactgagagtcctccattgcatcttccagctgctgttgacttgggggatgatatttgagaagctcagaatctgttctatgccccaatttttctgtttcatgcaagatctgcctccgctaaagtatgaccccgatgttgtggtcacggatttccgctttgggacaatccctgtgaagctgtaccaacccaaggcatccacctgcaccctgaagcctggcatcgtgtactaccacggtggcgggggcgtcatggggagtttgaaaacccaccatggcatatgctctcgtttgtgcaaggagagtgactccgtggttctggcagttggttaccgcaagttacctaagcataagtttccagtgccagtaagagactgcttggtggccaccatccacttcctgaagtccctggatgcatatggagtggatccagcccgggttgtggtctgcggtgacagtttcggaggggcaatagccgcagtggtttgtcaacaacttgtggacaggccagatctgccccggatccgggctcagatcctgatctatgccattctccaagccctggatttacaaaccccttcgtttcaacagaggaaaaacatcccactgctcacctggagtttcatctgctactttttttttcaaaacctggatttcagctcctcctggcaagaggtcatcatgaaaggtgcccatttgcctgctgaagtctgggaaaagtacagaaagtggttgggcccagaaaacatccctgagaggtttaaggagaggggttaccaactgaagccccatgagcccatgaatgaagctgcttacttggaagtaagtgttgtcctggatgtgatgtgctcgcccctgattgcagaagatgacatagtgtctcagctcccggaaacctgcatcgtgagctgtgagtatgatgctctccgggacaattcactgttgtacaagaaaaggctggaagacctgggagtgcccgtgacctggcaccatatggaggatggtttccatggagtgctcaggaccattgacatgagcttcttgcactttccctgctccatgagaattctgagtgcattagttcaatttgtaaagggactgtgaccatctttcttctctgctggtactgcggtgtggattccactggcatccagcctcccacagggctctctgttgctgatttaggtggtgcatagtggggctagggagggggtagaggttgctgtcacctttctggtccaggttctagaaccacacaatgcatgctcctgatgtccagaggacgtggtagaaaagacaggtttggaggtgggagtgtggctgtctctattctctgttgggaaaacctgggctgacaatattcagtggccatttgtgggagtgaatcagccggtaagagctgttctcagcctccctaaggggcagttcaggctcccagattgatccagactgtgtgtgactttcgtccatttgacttgactttggaatagcacaagggcatcatgtacttcacgaggctttcccaatgtggctcagaggcaggagctctgatgctctgggctgctgtgaggtggtggtggtggtagagaaactggcttcacccacctactcttctgtgaacagtagtgacttttcccgctgtttctcagcctctgggatcagagtcttcactgtctgggctggaaactttaagatagaatggatagagcttccacagtggttggcatctagtggtggatgaagacagcctgcagctgcccgacttggggagctctggagctcctggaatcaaagcctgtcttccaaccagaagccccaaggcaatgttctaagaatttgagaagagaagttgggagggaagtggggtcctgagttagagacccatgaaggctgagtctaaccagataaccctgtccacagtgcaaagtcaagacagccaaaggaacagaagatgtatttgtgaaaactatttcttttttaagacatggaaccaactcaaattggcctctattagaaagacaatagattggcttaggtagggatgcatgctaggcatacatcaggcaaggtttgatccaggaactcacacagtgccatcagctgtcctgtcttctctgctctgctcttctctcctctgtgttaatgccaccttctcctcttcatacggtggcactgagcagcttcatgcctaccttcctccagggtcaagttcattatcatggacttgcctcatgctcagcagtcccagaaaaaagcctaattgcaacttgatggctttgttggctttctgagcaatgtgtccagttgccacagtgaagggaatggaataatctaactcaccattcccaagtcctatgccatcctgagagtggggggtggagtcaattcaccttggtgcttggactaagcatgaggtggtgagtgacaacgttcctaattgaagggtagggtaaatggttgttgggtggacaccaacacttattctactacagaagctaaattgaaccctcaggcagggtacgtgaaagtggcaagagatgtcaagaccactgggcaagttggccagttgttccttaggaatgaaaattcttttgaaaggaatggccagggtcctctgctggccccacttggtcttctggaggctctgatcttggttggttagtggtctttacaggccaaggtcaaggccattgcacaaaaaaccctgtgcatgcccttaacttgctttcagttgaatatttgggctgaactatgaggcagagaggaatcccattgggtggctccttgctgcattcgcagttgaccagcatggggtttgttggagaaataggaaccatcccctgaaaacacacactatggtagccactcaactgttgaaaggcactggagtccaatgggtgaggccgcctctgagacaagcctctgagttgaggctgggagaggctccctccttggagtgttgctttttttgtttcacccctgcctctggagatgggtagaggaacatgagctgaccttctgggaagtgaggttggtgaggagttgctgaggcactgcagggccatgcccagtagagaggaatgtataacattttaagaggctgagagcaccccttgttgggcgcatgcccatggcagcttccttctgccgatcatgggagaaatcaagcactttcacctaatggctagatgattgattttgggatgaaattctccactcctctcctttaccacatcaccactatccttcctgcaatacatccacgagactcactgagtggaaaagggataggaatgaatgttcacccagggccagctacatgctaggcactgtactggaccatttaaatttgccacctcttatgttcctcacattaatcttacagagtaggtacagacatacctatggatattgcagattcagttccagaccacagcaataaagcaagtcacatgaattttttgctttccttagtgcatgtaaaagttacatttccactatattatag

SEQ ID NO: 109023 - DNA, 1575 bp, Homo sapiens
  Payload ID: 1418
  Gene Symbol: AADACL4
  Gene Name: arylacetamide deacetylase-like 4
  Uniprot ID: Q5VUY2
  ENST ID: ENST00000376221
  CDS Start-End: 1-1224
atggctgtcccctggctagtgctactcttggcattgcccatctttttcctgggggtctttgtctgggctgtctttgagcacttcctcaccacggatatccctgctaccttgcagcatcctgccaagttgagattcctgcattgcatattcctctacctggtcactttggggaatatatttgagaagctgggaatttgctccatgcccaaatttattcgttttttacatgatagcgtgagaattaaaaaggaccctgaacttgtggtgaccgacctgcgttttgggacgatacccgtgaggctgttccagccgaaggcagcatcctccagaccccggcgaggcatcatcttctaccatggaggggccacagtatttgggagcctggattgttaccatggcctgtgcaattatctggcccgggagactgaatctgtacttctgatgattgggtaccgcaagcttcctgaccaccattcccctgcccttttccaagactgcatgaatgcctccattcacttcctgaaggccctggaaacctatggggtggacccctccagggttgtggtctgtggagaaagcgtcggaggtgcagcggtggccgccatcacccaggccttggtgggcagatcagatcttccccggatccgggctcaggttctgatttatccagttgtccaggcattctgtttgcagttgccatcctttcagcagaaccaaaatgtcccattactttcccggaagttcatggtgacttctctgtgtaactatctggccattgacctctcctggcgtgacgccatcttgaacggcacttgtgtacccccagacgtctggaggaagtacgagaagtggctcagccctgacaacatccccaagaaatttaagaacagaggctaccaaccctggtctcccggcccttttaatgaagctgcctatctagaagccaaacatatgctggatgtagaaaattcacccctgatagcagatgatgaggtcatcgctcagcttcctgaggccttcctggtgagctgtgagaatgacatactccgtgatgacagcttgctctataagaagcgcttggaggaccagggggtccgcgtgacatggtaccacctgtatgatggttttcacggatccattatcttttttgataagaaggctctctctttcccatgttccctgaagattgtgaatgctgtagtcagttatataaagggcatatgatagtaaccctggggccccgaggaggaaggggcaagtatggactctaccagaaaccgggtgctttagtgagttctattttattgactaaagaggtgctacatcaatgcttggggcagctgggaagggtgagaagtaagctaacagtcttgcttagtattcaagaaaatccaaactgtgtctgtttccttccagcactaacaatgtccattgctggatctagcgacattctctaacattcccatttaggtgaaataaatatcaaaaggagaaaaaaatgcctttaaaaatttctcaaagccccaacatataagatctgtgcagaataaatgccaacaactggtcataccgtca

SEQ ID NO: 109024 - DNA, 1700 bp, Homo sapiens
  Payload ID: 1419
  Gene Symbol: AFMID
  Gene Name: arylformamidase
  Uniprot ID: Q63HM1
  ENST ID: ENST00000327898
  CDS Start-End: 10-936
gtagacgccatgatggatgtgtctggtgtgggtttcccaagcaaggttccttggaagaagatgtctgcagaggagctggagaatcagtactgtcccagccgatgggttgtccgactgggagcagaggaagccttgaggacctactcacagataggaattgaagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaagtaaggatgagtctgccttcatggtccacccgctgacggcacagggagtggccgtggtaatagtggcttacggcatcgcccccaaaggcaccctggaccacatggtagaccaggtgacccgcagcgttgcgtttgtccagaagcggtatccaagcaacaagggaatttacctgtgtggacactcagccggggcccacctggctgccatgatgctcctggccgactggaccaagcatggggtcacgcccaacctcagaggctttttcctggtgagtggggtctttgacctggagcccatcgtgtatacttcacagaacgttgctctccagctgaccctggaggacgctcagaggaatagcccccagctgaaggtggcccaggcacagccggtggaccccacctgccgtgtgctggtggtcgtgggccagttcgactcccccgaattccaccgacagtcctgggagttttaccaggtactcccagtgcagaccctgtgtcaaggagagtggaaagcctcatttgaagagctccacgatgtggaccactttgaaattgttgagaatctgacccagaaggacaacgtgctcacccagattatcttgaaaacaatcttccagtagttctgacgatacttggagcctggtccacgtgcatcccaccttgggaagcctctccaaagagctttcggagctgacactgacagcttcagtttcccccagcacccaggagagccttgctgtgtctgtctgcccggcaagagtccattctcactgctgggacactcatgaaaatctccacgtcctccctcttcccagcctggatggagctccagggctggggaacgtccgcaagtcaatgctcagagatgcccggagctgcctcttagactcgtctggcccatctacctgctgacagagcatgacaaagatgacgctcaaaagtaatgccattacttcttttttttttttttttttttttttttttgagatggagtcttactctgtcacccaggctggagtgcagtggcgtgatcttggctcactgcaacctccacctcccgggttcaagcaattctcctgcctcagcctcctgagcagctgggactacaggcgcctgccatcatgcctggctaatttttgtatttttagtagagacggggtttcaacatattggccaggctggtctcaaactcctaaccttgtgattcgcccgccttggcctcccaaagtgctgggattccaggcgtgagccactgcgcccggccagaatggcattatatttaaatagttcataaagaagcacaaaagaatattatttcataacatgtaaaaattatataaaacgtaaatttccatgttgataaataaagttgtattggaacacg

SEQ ID NO: 109025 - DNA, 1730 bp, Homo sapiens
  Payload ID: 1419
  Gene Symbol: AFMID
  Gene Name: arylformamidase
  Uniprot ID: Q63HM1
  ENST ID: ENST00000409257
  CDS Start-End: 55-966
cggggctctggccatataaacagagggacgcacgcccatgcggctgtagacgccatgatggatgtgtctggtgtgggtttcccaagcaaggttccttggaagaagatgtctgcagaggagctggagaatcagtactgtcccagccgatgggttgtccgactgggagcagaggaagccttgaggacctactcacagataggaattgaagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaagtaaggatgagtctgccttcatggtccacccgctgacggcacagggagtggccgtggtaatagtggcttacggcatcgcccccaaaggcaccctggaccacatggtagaccaggtgacccgcagcgttgcgtttgtccagaagcggtatccaagcaacaagggaatttacctgtgtggacactcagccggggcccacctggctgccatgatgctcctggccgactggaccaagcatggggtcacgcccaacctcagaggctttttcctggtgagtggggtctttgacctggagcccatcgtgtatacttcacagaacgttgctctccagctgaccctggaggacgctcagaggaatagcccccagctgaaggtggcccaggcacagccggtggaccccacctgccgtgtgctggtggtcgtgggccagttcgactcccccgaattccaccgacagtcctgggagttttaccagaccctgtgtcaaggagagtggaaagcctcatttgaagagctccacgatgtggaccactttgaaattgttgagaatctgacccagaaggacaacgtgctcacccagattatcttgaaaacaatcttccagtagttctgacgatacttggagcctggtccacgtgcatcccaccttgggaagcctctccaaagagctttcggagctgacactgacagcttcagtttcccccagcacccaggagagccttgctgtgtctgtctgcccggcaagagtccattctcactgctgggacactcatgaaaatctccacgtcctccctcttcccagcctggatggagctccagggctggggaacgtccgcaagtcaatgctcagagatgcccggagctgcctcttagactcgtctggcccatctacctgctgacagagcatgacaaagatgacgctcaaaagtaatgccattacttcttttttttttttttttttttttttttttgagatggagtcttactctgtcacccaggctggagtgcagtggcgtgatcttggctcactgcaacctccacctcccgggttcaagcaattctcctgcctcagcctcctgagcagctgggactacaggcgcctgccatcatgcctggctaatttttgtatttttagtagagacggggtttcaacatattggccaggctggtctcaaactcctaaccttgtgattcgcccgccttggcctcccaaagtgctgggattccaggcgtgagccactgcgcccggccagaatggcattatatttaaatagttcataaagaagcacaaaagaatattatttcataacatgtaaaaattatataaaacgtaaatttccatgttgataaataaagttgtattggaacacg

SEQ ID NO: 109026 - DNA, 647 bp, Homo sapiens
  Payload ID: 1419
  Gene Symbol: AFMID
  Gene Name: arylformamidase
  ENST ID: ENST00000588800
  CDS Start-End: 10-291
gtagacgccatgatggatgtgtctggtgtgggtttcccaagcaaggttccttggaagaagatgtctgcagaggagctggagaatcagtactgtcccagccgatgggttgtccgactgggagcagaggaagccttgaggacctactcacagataggaattgaagccttgcctttcttcctgttctttcacggaggatactggcagagcggaagaccctgtgtcaaggagagtggaaagcctcatttgaagagctccacgatgtggaccactttgaaattgttgagaatctgacccagaaggacaacgtgctcacccagattatcttgaaaacaatcttccagtagttctgacgatacttggagcctggtccacgtgcatcccaccttgggaagcctctccaaagagctttcggagctgacactgacagcttcagtttcccccagcacccaggagagccttgctgtgtctgtctgcccggcaagagtccattctcactgctgggacactcatgaaaatctccacgtcctccctcttcccagcctggatggagctccagggctggggaacgtccgcaagtcaatgctcagagatgcccggagctgcctcttagactcgtctggcccatctacctgctgacagagcatgac

SEQ ID NO: 109027 - DNA, 778 bp, Homo sapiens
  Payload ID: 1419
  Gene Symbol: AFMID
  Gene Name: arylformamidase
  ENST ID: ENST00000588199
  CDS Start-End: 10-345
gtagacgccatgatggatgtgtctggtgtgggtttcccaagcaaggttccttggaagaagatgtctgcagaggagctggagaatcagtactgtcccagccgatgggttgtccgactgggagcagaggaagccttgaggacctactcacagataggaattgaagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaaggctttttcctggtgagtggggtctttgacctggagcccatcgtgtatacttcacagaacgttgctctccagctgaccctaccctgtgtcaaggagagtggaaagcctcatttgaagagctccacgatgtggaccactttgaaattgttgagaatctgacccagaaggacaacgtgctcacccagattatcttgaaaacaatcttccagtagttctgacgatacttggagcctggtccacgtgcatcccaccttgggaagcctctccaaagagctttcggagctgacactgacagcttcagtttcccccagcacccaggagagccttgctgtgtctgtctgcccggcaagagtccattctcactgctgggacactcatgaaaatctccacgtcctccctcttcccagcctggatggagctccagggctggggaacgtccgcaagtcaatgctcagagatgcc

SEQ ID NO: 109028 - DNA, 550 bp, Homo sapiens
  Payload ID: 1419
  Gene Symbol: AFMID
  Gene Name: arylformamidase
  ENST ID: ENST00000586731
  CDS Start-End: 22-135
agcaaggttccttggaagaagatgtctgcagaggagctggagaatcagtactgtcccagccgatgggttgtccgactgggagcagaggaagccttgaggacctactcacagataggaattgaagtccatttataggcttgagaactcctgtgtgaattaaatcacgaccttctgatgaagccactccgatgagcctgtgaggcacattgtcttcacactgtgctggggcagggttgttggcaaacccccatggatggcagccggcaatggcctcacagtgacaaatgcgtctgccttttgacccagaattctacccctgagagtgcgtcctacagatgcttgcaagtggtatggtaatggatgtacaaagctattcacagcaggggtgtttgtggtagcatggcctgggagacagcccagatggctttcagcaaaggattggtggcaggtctgcagccctggggcttatcagacaccaaccctgctggcaccttgatcttggacttccagtttgcagaactgtgagaaaataaaatttccattaagtttc

SEQ ID NO: 109029 - DNA, 631 bp, Homo sapiens
  Payload ID: 1419
  Gene Symbol: AFMID
  Gene Name: arylformamidase
  ENST ID: ENST00000591256
  CDS Start-End: 14-631
ggctgtagacgccatgatggatgtgtctggtgtgggtttcccaagcaaggttccttggaagaagatgtctgcagaggagctggagaatcagtactgtcccagccgatgggttgtccgactgggagcagaggaagccttgaggacctactcacagataggaattgaagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaagtaaggatgagtctgccttcatggtccacccgctgacggcacagggagtggccgtggtaatagtggcttacggcatcgcccccaaaggcaccctggaccacatggtagaccaggtgacccgcagcgttgcgtttgtccagaagcggtatccaagcaacaagtgggtgttgccagtagattttcttcctgttggacctcagtgggtgggaggacagtgcaatcagtacctaggatacagccaagctgcccctctggcctgtggagcagaaagcaaattgggactcttcgaagggggcctgatgttgtgggga

SEQ ID NO: 109030 - DNA, 569 bp, Homo sapiens
  Payload ID: 1419
  Gene Symbol: AFMID
  Gene Name: arylformamidase
  ENST ID: ENST00000586542
  CDS Start-End: 8-569
agacgccatgatggatgtgtctggtgtgggtttcccaagcaaggttccttggaagaagatgtctgcagaggagctggagaatcagtactgtcccagccgatgggttgtccgactgggagcagaggaagccttgaggacctactcacagataggaattgaagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaaggcaccctggaccacatggtagaccaggtgacccgcagcgttgcgtttgtccagaagcggtatccaagcaacaagtgggtgttgccagtagattttcttcctgttggacctcagtgggtgggaggacagtgcaatcagtacctaggatacagccaagctgcccctctggcctgtggagcagaaagcaaattgggactcttcgaagggggcctgatgttgtggggaaactgcgtgcaaatccagctctctgctctg

SEQ ID NO: 109031 - DNA, 578 bp, Homo sapiens
  Payload ID: 1419
  Gene Symbol: AFMID
  Gene Name: arylformamidase
  ENST ID: ENST00000589256
  CDS Start-End: 10-183
gtagacgccatgatggatgtgtctggtgtgggtttcccaagcaaggttccttggaagaagatgtctgcagaggagctggagaatcagtactgtcccagccgatgggttgtccgactgggagcagaggaagccttgaggacctactcacagataggaattgaaggcttgagaactcctgtgtgaattaaatcacgaccttctgatgaagccactccgatgagcctgtgaggcacattgtcttcacactgtgctggggcagggttgttggcaaacccccatggatggcagccggcaatggcctcacagtgacaaatgcgtctgccttttgacccagaattctacccctgagagtgcgtcctacagatgcttgcaagtggtatggtaatggatgtacaaagctattcacagcaggggtgtttgtggtagcatggcctgggagacagcccagatggctttcagcaaaggattggtggcaggtctgcagccctggggcttatcagacaccaaccctgctggcaccttgatcttggacttccagtttgcagaactgtgagaaaataaaatttccattaagtttc

SEQ ID NO: 109032 - DNA, 582 bp, Homo sapiens
  Payload ID: 1419
  Gene Symbol: AFMID
  Gene Name: arylformamidase
  ENST ID: ENST00000591952
  CDS Start-End: 10-264
gtagacgccatgatggatgtgtctggtgtgggtttcccaagcaaggttccttggaagaagatgtctgcagaggagctggagaatcagtactgtcccagccgatgggttgtccgactgggagcagaggaagccttgaggacctactcacagataggaattgaagattatcttgaaaacaatcttccagtagttctgacgatacttggagcctggtccacgtgcatcccaccttgggaagcctctccaaagagctttcggagctgacactgacagcttcagtttcccccagcacccaggagagccttgctgtgtctgtctgcccggcaagagtccattctcactgctgggacactcatgaaaatctccacgtcctccctcttcccagcctggatggagctccagggctggggaacgtccgcaagtcaatgctcagagatgcccggagctgcctcttagactcgtctggcccatctacctgctgacagagcatgacaaagatgacgctcaaaagtaatgccattacttcttttttttttttttttttttttttttttgagatggagtcttactctgtcacccagg

SEQ ID NO: 109033 - DNA, 577 bp, Homo sapiens
  Payload ID: 1419
  Gene Symbol: AFMID
  Gene Name: arylformamidase
  ENST ID: ENST00000589107
  CDS Start-End: 10-192
gtagacgccatgatggatgtgtctggtgtgggtttcccaagcaaggttccttggaagaagatgtctgcagaggagctggagaatcagtactgtcccagccgatgggttgtccgactgggagcagaggaagccttgaggacctactcacagataggaattgaagaaatctggacttgggaacctgtaaactagtgaagtcttaaggtccatttccatctctaccctgtatctgcaaagtgctgtaccacgatctgaacacctggtaatgcatccgtgctgggatggggagcaggccccgaggaggaagtgtagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaagtaaggatgagtctgccttcatggtccacccgctgacggcacagggagtggccgtggtaatagtggcttacggcatcgcccccaaaggcaccctggaccacatggtagacca

SEQ ID NO: 109034 - DNA, 6558 bp, Homo sapiens
  Payload ID: 1420
  Gene Symbol: ARNT2
  Gene Name: aryl-hydrocarbon receptor nuclear translocator 2
  Uniprot ID: Q9HBZ2
  ENST ID: ENST00000303329
  CDS Start-End: 166-2319
cggccgcggcggcggggagagcggagggagcgccgcccgcccgcgccgtcctttgtgtggcggcggcggcgcctgggcctgaccgggtccccggggctgagcgccgggctccgcgccgcccctcccgcgcccctgccaagcgggcgcctatcctctccgagcaagatggcaaccccggcggcggtcaaccctccggaaatggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagagagaatcatagtgaaatcgaaaggcgcagacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggccggatcttggacctgaagactgggacggtcaagaaagaagggcagcagtcatccatgaggatgtgcatgggctcgcggcggtctttcatctgcaggatgaggtgtggaaatgctcctttggaccaccttcctctaaacagaataaccaccatgaggaaaaggttcaggaatggccttggccctgtgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccggtcagactgaagtgttccaggacatgctgcccatgccaggagatccaacccaggggactggcaactataacatcgaagactttgccgacctgggcatgtttccaccgttttctgagtagctgcggccagagtgaggctcctgctgtacagtgccacccatactgtgatgtcgatgcccatgtgaatgaggcccaccctcgccctgcttgccctgccgcaggccccccaccagaagccatctcccccgctgtgtgtccccaggcgcatcattgctccactctcccctgcagccgcggctgctcggccactgaccaggggccctggcagacattaggggatcagttgtatttattgtattttatctgtgtgtgctcaggaggtgagcctagtgggtccttaagtttggttgtgaataatctcttgatagacaatttatacccatgaaagttcagccaatgcccagagtgaccaagcagcaccagcaggcctgcccaggatgctgaaagcagatttcttcttgatttcacttctgatggatgcatggggctctgggggaatgctgggaaaatgggcaagcagagtgcacagccctcgttctgccagctggagccaagaagcacagagacacagaggcgcctgcccctcagctccgctggtctgtctgtgcatccactgtgccgtgggacatatgtaatttgtgcagtgtgacatggacttgctgtcctaatggatgtgttgtgccttgtgtctgtcatgtgtggccagcgtgattgtatagaatccagagtatgtagagagccaaaatgtgtggccctgtccccaagctcagcaccaccggccatgaccagaggttgctcggcccagggtctgggagctgggctaacaggctgacacttcggcagggtcaccaggaggcacagctaggggcatgctcacatgggtaggtcagttctttggtccaagcctctggtgcagattcaagctcctcctcttagaggaagcagctccttcctcccacaggagccccaagggagcactcaccctcctcccaattggatctgaatagctgtgttcctgatcccacataagcatgtctcatccttgccccactggtgagaggaggaccttgtgcctgcccagagcctgcaggacagcacgccttgaggtcagaggcctggcccttctttacagatgtagatagcagggtaggacgcccaggccttctcacatgggcaccatgaaacactttcttccaggccacctgagccttcgttcttcagcccgactggaggaacagcagctctgggaggcacagagtgcaggtctcaggggcagaagacatgggttccagttctggttctgccacacacccaccggccttgaatttctctggtggtctcaagacaagaacaagagctgactctagaatcttctgcctggctgacctctgagcccatgatccctggcttgctgtgcttctcttggatttgaggagagtttatgaatccatccccctgttttcagggacctctgccttctcccacaccccttacactagtgaggactccttcggcctcttgtgtttccttccttttgtgaccattacgccccctccctgtttcttatcaccagcccatcagcccactgactcccatatggtagaaaaggtaccgtggctgctgcagggcacatggagggacctaccctctgggaaagcccttgtgtccctcccagagtccttcaggtaggccctcgcagatgctgcttgctcagaaacaacccgtgcatccctgcccatggattctgcaggacctagaagagtggcattggttctaggaacctgagagtggagtgaggccagcatgcaggaaggagtttggagagagtgtttgctgtgatccattgaaagctccacattaaaccccagccctgtctggccagggagatccatgtgctcaatgttgctgggggacctacaaaagtcaaacattgctcagtaaaatgcctttggctggtcgccagctgtgcatgactgcagttcctagactctaacttaaccccaactttgcagtttctagagctttttgtctgtaatggtgattgggtctccactgtagatgcatgcagtgttcactccaacctcagaggctttcttgcttctggggaaatggcaggtggttgaaaccctgcacatcctcccagggccagccccagaatgggcctttctctgcctgccctgcccttggggccacctctgcctccagcaggcttgagcttgccccaggccttgggcataattatttccccccaaaaaaggcacaaaaataggttttggatcaaagaagtgtttctcagtgaaatgaaaacagtctttttatagcctttagcttgtgagtttggaagtttggggggtcttatgtttgttttgcctcttctgtttcttggaggagagttgaggcttttcttaggtgcatacacagacccaggtgaacacgctgactgtgaacctgccctgtatccggagctgtgctgggcactgaggggatgcaacaaaattaggagaggatccttgctcccaacgtctacttctcctacctcaacaggggtccagggtgcagtgaactcagttcttggcccttgggtgaggattcatggatgaatgaaagctagacctgatggggaggcattatgactaaataggcccagcctccttcccttccagctctgtcctaggagcataggcgggaaatctgagtagagtctgactgcagtttttgcttatgatttgtaaaagccgtcatggggtcaataagaaaataggggtgatggagggggagaagcccaggactgggagaatcgcacatgccccaggggttttcaccaaggattttcaagacaaactggagtaagaattaaagccccagaggatttaattatcctggtttgcaaaagagcctcccatgccagtaccgcccagccttggaggccggaatgctcatggcccctgtggtctgcttgtccttcagcccatgcccagcagatacctctctgactggagacgggctcaaagctggattagaaaggggagaggcacttgtgactttgtttgactctgtgactcacttcctcgctcacaccttgtttgaactactggactttcaactggctttccttaggtcaggcaagcagacagctccccactgaagaggtctgtacagtgacaacccgggccggcagcaaggacacagatgcagccacagtaaggctccatcaggactgggtcagtgatggcaacaggatggccaaggatggctctagaacactctgtccatgcgtcactccccccagttttatttttagctttggcttcagggagtgacagccatcacaaatagccacattctgctctactctccaacataccagattctacactgttgttatttcatgagacgtgaatgttgcagagagtggggggattctggttgttaaggaacttacactggggagctttactcttccgtgtcaacaatgtgactacatgttctccagattagccacacatgcaaacatcagtgtccttctagctttagccgagaaagaaaccagtcccagggaatgaatggtggtctccccactcccggcagcactttaggcagcccataagctatgcgagaatgtgaacgctcaccttgctccgtcacggttctgacctaccacataaacaggaagaagccagtgaccggaacagctctaggaataacaagtcagaatagaagtgtcctttatattaccagaaaatatgggcttggcctaagtcgctgtctcctaacctgccggggtcattccccaccaaacaccccatactaaggagccatgagccacctggacattcaccttttctttgaccatctggagtctggggcaacttaaggaggcaccacacagtggtgcaggcacatttccaagcgtaggtgtccctggcttttgtggccaaagctagtgttatggtcaacaacaggccagggtctgtggggcactgaccttgaaagtggcaaaatggaggtttcacaggctgtgcgggagcaggacggcttgcttcatctaacaatctcagtttcctttaaaaaaagaaagaaaggaaaagatttcataagcaggtgtcagtggacagtttaagtacttaaccatttctctttcttcttatggatgtgaactgtgctgtggataaatcatttgtatttcttgaatgttctctatgactaacagttattaagtcggttgtgtatatgtgtaactaatgtaactgccttttaaaatttcattacaataaaaatgactttgctctgaacaacaaa

SEQ ID NO: 109035 - DNA, 585 bp, Homo sapiens
  Payload ID: 1420
  Gene Symbol: ARNT2
  Gene Name: aryl-hydrocarbon receptor nuclear translocator 2
  ENST ID: ENST00000525103
  CDS Start-End: 196-585
gacattttctcagcagaatacaaatgcagctacatttcctcccagaggtttctgacatttcttctacacggataacagattctcctaagaaggtgttggtcacaaggaagaaagatctttgtttaatccctctgaaaaggccggatcttggacctgaagactgggacggtcaagaaagaagggcagcagtcatccatgaggatgtgcatgggctcgcggcggtctttcatctgcaggatgaggtgtggaaatgctcctttggaccaccttcctctaaacagaataaccaccatgaggaaaaggttcaggaatggccttggccctgtgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagt

SEQ ID NO: 109036 - DNA, 6690 bp, Homo sapiens
  Payload ID: 1420
  Gene Symbol: ARNT2
  Gene Name: aryl-hydrocarbon receptor nuclear translocator 2
  Uniprot ID: Q9HBZ2
  ENST ID: ENST00000533983
  CDS Start-End: 340-2460
atctgtgatgacattttctcagcagaatacaaatgcagctacatttcctcccagaggtttctgacatttcttctacacggataacagattctcctaagaaggtgttggtcacaaggaagaaagatctttgtttaatccctctgaaaagtgtaggaggatcaggtgaccaaggttttttagaattttccctttttgggatctgacgccgacacactattttgaggcagtgacatcatctctttcctctggcgtgccctccttgcggctccatcattcaggccttgtcatctctcacctggactgctgtgaccttcattcattcccaggagaagtccagaaatggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagagagaatcatagtgaaatcgaaaggcgcagacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggccggatcttggacctgaagactgggacggtcaagaaagaagggcagcagtcatccatgaggatgtgcatgggctcgcggcggtctttcatctgcaggatgaggtgtggaaatgctcctttggaccaccttcctctaaacagaataaccaccatgaggaaaaggttcaggaatggccttggccctgtgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccggtcagactgaagtgttccaggacatgctgcccatgccaggagatccaacccaggggactggcaactataacatcgaagactttgccgacctgggcatgtttccaccgttttctgagtagctgcggccagagtgaggctcctgctgtacagtgccacccatactgtgatgtcgatgcccatgtgaatgaggcccaccctcgccctgcttgccctgccgcaggccccccaccagaagccatctcccccgctgtgtgtccccaggcgcatcattgctccactctcccctgcagccgcggctgctcggccactgaccaggggccctggcagacattaggggatcagttgtatttattgtattttatctgtgtgtgctcaggaggtgagcctagtgggtccttaagtttggttgtgaataatctcttgatagacaatttatacccatgaaagttcagccaatgcccagagtgaccaagcagcaccagcaggcctgcccaggatgctgaaagcagatttcttcttgatttcacttctgatggatgcatggggctctgggggaatgctgggaaaatgggcaagcagagtgcacagccctcgttctgccagctggagccaagaagcacagagacacagaggcgcctgcccctcagctccgctggtctgtctgtgcatccactgtgccgtgggacatatgtaatttgtgcagtgtgacatggacttgctgtcctaatggatgtgttgtgccttgtgtctgtcatgtgtggccagcgtgattgtatagaatccagagtatgtagagagccaaaatgtgtggccctgtccccaagctcagcaccaccggccatgaccagaggttgctcggcccagggtctgggagctgggctaacaggctgacacttcggcagggtcaccaggaggcacagctaggggcatgctcacatgggtaggtcagttctttggtccaagcctctggtgcagattcaagctcctcctcttagaggaagcagctccttcctcccacaggagccccaagggagcactcaccctcctcccaattggatctgaatagctgtgttcctgatcccacataagcatgtctcatccttgccccactggtgagaggaggaccttgtgcctgcccagagcctgcaggacagcacgccttgaggtcagaggcctggcccttctttacagatgtagatagcagggtaggacgcccaggccttctcacatgggcaccatgaaacactttcttccaggccacctgagccttcgttcttcagcccgactggaggaacagcagctctgggaggcacagagtgcaggtctcaggggcagaagacatgggttccagttctggttctgccacacacccaccggccttgaatttctctggtggtctcaagacaagaacaagagctgactctagaatcttctgcctggctgacctctgagcccatgatccctggcttgctgtgcttctcttggatttgaggagagtttatgaatccatccccctgttttcagggacctctgccttctcccacaccccttacactagtgaggactccttcggcctcttgtgtttccttccttttgtgaccattacgccccctccctgtttcttatcaccagcccatcagcccactgactcccatatggtagaaaaggtaccgtggctgctgcagggcacatggagggacctaccctctgggaaagcccttgtgtccctcccagagtccttcaggtaggccctcgcagatgctgcttgctcagaaacaacccgtgcatccctgcccatggattctgcaggacctagaagagtggcattggttctaggaacctgagagtggagtgaggccagcatgcaggaaggagtttggagagagtgtttgctgtgatccattgaaagctccacattaaaccccagccctgtctggccagggagatccatgtgctcaatgttgctgggggacctacaaaagtcaaacattgctcagtaaaatgcctttggctggtcgccagctgtgcatgactgcagttcctagactctaacttaaccccaactttgcagtttctagagctttttgtctgtaatggtgattgggtctccactgtagatgcatgcagtgttcactccaacctcagaggctttcttgcttctggggaaatggcaggtggttgaaaccctgcacatcctcccagggccagccccagaatgggcctttctctgcctgccctgcccttggggccacctctgcctccagcaggcttgagcttgccccaggccttgggcataattatttccccccaaaaaaggcacaaaaataggttttggatcaaagaagtgtttctcagtgaaatgaaaacagtctttttatagcctttagcttgtgagtttggaagtttggggggtcttatgtttgttttgcctcttctgtttcttggaggagagttgaggcttttcttaggtgcatacacagacccaggtgaacacgctgactgtgaacctgccctgtatccggagctgtgctgggcactgaggggatgcaacaaaattaggagaggatccttgctcccaacgtctacttctcctacctcaacaggggtccagggtgcagtgaactcagttcttggcccttgggtgaggattcatggatgaatgaaagctagacctgatggggaggcattatgactaaataggcccagcctccttcccttccagctctgtcctaggagcataggcgggaaatctgagtagagtctgactgcagtttttgcttatgatttgtaaaagccgtcatggggtcaataagaaaataggggtgatggagggggagaagcccaggactgggagaatcgcacatgccccaggggttttcaccaaggattttcaagacaaactggagtaagaattaaagccccagaggatttaattatcctggtttgcaaaagagcctcccatgccagtaccgcccagccttggaggccggaatgctcatggcccctgtggtctgcttgtccttcagcccatgcccagcagatacctctctgactggagacgggctcaaagctggattagaaaggggagaggcacttgtgactttgtttgactctgtgactcacttcctcgctcacaccttgtttgaactactggactttcaactggctttccttaggtcaggcaagcagacagctccccactgaagaggtctgtacagtgacaacccgggccggcagcaaggacacagatgcagccacagtaaggctccatcaggactgggtcagtgatggcaacaggatggccaaggatggctctagaacactctgtccatgcgtcactccccccagttttatttttagctttggcttcagggagtgacagccatcacaaatagccacattctgctctactctccaacataccagattctacactgttgttatttcatgagacgtgaatgttgcagagagtggggggattctggttgttaaggaacttacactggggagctttactcttccgtgtcaacaatgtgactacatgttctccagattagccacacatgcaaacatcagtgtccttctagctttagccgagaaagaaaccagtcccagggaatgaatggtggtctccccactcccggcagcactttaggcagcccataagctatgcgagaatgtgaacgctcaccttgctccgtcacggttctgacctaccacataaacaggaagaagccagtgaccggaacagctctaggaataacaagtcagaatagaagtgtcctttatattaccagaaaatatgggcttggcctaagtcgctgtctcctaacctgccggggtcattccccaccaaacaccccatactaaggagccatgagccacctggacattcaccttttctttgaccatctggagtctggggcaacttaaggaggcaccacacagtggtgcaggcacatttccaagcgtaggtgtccctggcttttgtggccaaagctagtgttatggtcaacaacaggccagggtctgtggggcactgaccttgaaagtggcaaaatggaggtttcacaggctgtgcgggagcaggacggcttgcttcatctaacaatctcagtttcctttaaaaaaagaaagaaaggaaaagatttcataagcaggtgtcagtggacagtttaagtacttaaccatttctctttcttcttatggatgtgaactgtgctgtggataaatcatttgtatttcttgaatgttctctatgactaacagttattaagtcggttgtgtatatgtgtaactaatgtaactgccttttaaaatttcattacaataaaaatgactttgctctg

SEQ ID NO: 109037 - DNA, 2458 bp, Homo sapiens
  Payload ID: 1420
  Gene Symbol: ARNT2
  Gene Name: aryl-hydrocarbon receptor nuclear translocator 2
  Uniprot ID: Q9HBZ2
  ENST ID: ENST00000527771
  CDS Start-End: 143-2263
tgacattttctcagcagaatacaaatgcagctacatttcctcccagaggtttctgacatttcttctacacggataacagattctcctaagaaggtgttggtcacaaggaagaaagatctttgtttaatccctctgaaaagaaatggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagagagaatcatagtgaaatcgaaaggcgcagacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggccggatcttggacctgaagactgggacggtcaagaaagaagggcagcagtcatccatgaggatgtgcatgggctcgcggcggtctttcatctgcaggatgaggtgtggaaatgctcctttggaccaccttcctctaaacagaataaccaccatgaggaaaaggttcaggaatggccttggccctgtgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccggtcagactgaagtgttccaggacatgctgcccatgccaggagatccaacccaggggactggcaactataacatcgaagactttgccgacctgggcatgtttccaccgttttctgagtagctgcggccagagtgaggctcctgctgtacagtgccacccatactgtgatgtcgatgcccatgtgaatgaggcccaccctcgccctgcttgccctgccgcaggccccccaccagaagccatctcccccgctgtgtgtccccaggcgcatcattgctccactctcccctgcagccgcggctgctcggccactgacca

SEQ ID NO: 109038 - DNA, 2932 bp, Homo sapiens
  Payload ID: 1420
  Gene Symbol: ARNT2
  Gene Name: aryl-hydrocarbon receptor nuclear translocator 2
  ENST ID: ENST00000622346
  CDS Start-End: 116-2266
ctttgtgtggcggcggcggcgcctgggcctgaccgggtccccggggctgagcgccgggctccgcgccgcccctcccgcgcccctgccaagcgggcgcctatcctctccgagcaagatggcaaccccggcggcggtcaaccctccggaaatggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagagagaatcatagtgaaatcgaaaggcgcagacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggccggatcttggacctgaagactgggacggtcaagaaagaagggcagcagtcatccatgaggatgtgcatgggctcgcggcggtctttcatctgcaggatgaggtgtggaaatgctcctttggaccaccttcctctaaacagaataaccaccatgaggaaaaggttcaggaatggccttggccctgtgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccggtcagactgaagtgttccaggacatgctgcccatgccaggagatccaaggaatgaatggtggtctccccactcccggcagcactttaggcagcccataagctatgcgagaatgtgaacgctcaccttgctccgtcacggttctgacctaccacataaacaggaagaagccagtgaccggaacagctctaggaataacaagtcagaatagaagtgtcctttatattaccagaaaatatgggcttggcctaagtcgctgtctcctaacctgccggggtcattccccaccaaacaccccatactaaggagccatgagccacctggacattcaccttttctttgaccatctggagtctggggcaacttaaggaggcaccacacagtggtgcaggcacatttccaagcgtaggtgtccctggcttttgtggccaaagctagtgttatggtcaacaacaggccagggtctgtggggcactgaccttgaaagtggcaaaatggaggtttcacaggctgtgcgggagcaggacggcttgcttcatctaacaatctcagtttcctttaaaaaaagaaagaaaggaaaagatttcataagcaggtgtcagtggacagtttaagtacttaaccatttctctttcttcttatggatgtgaactgtgctgtggataaatcatttgtatttcttgaatgttctctatgactaacagttattaagtcggttgtgtatatgtgtaactaatgtaactgccttttaaaatttcattacaataaaaatgactttgctctg

SEQ ID NO: 109039 - DNA, 6409 bp, Homo sapiens
  Payload ID: 1420
  Gene Symbol: ARNT2
  Gene Name: aryl-hydrocarbon receptor nuclear translocator 2
  ENST ID: ENST00000610490
  CDS Start-End: 27-1727
gcgggcgcctatcctctccgagcaagatggcaaccccggcggcggtcaaccctccggaaatggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagagagaatcatagtgaaatcgaaaggcgcagacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggccggatcttggacctgaagactgggacggtcaagaaagaagggcagcagtcatccatgaggatgtgcatgggctcgcggcggtctttcatctgcaggatgaggtgtggaaatgctcctttggaccaccttcctctaaacagaataaccaccatgaggaaaaggttcaggaatggccttggccctgtgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccggtcagactgaagtgttccaggacatgctgcccatgccaggagatccaacccaggggactggcaactataacatcgaagactttgccgacctgggcatgtttccaccgttttctgagtagctgcggccagagtgaggctcctgctgtacagtgccacccatactgtgatgtcgatgcccatgtgaatgaggcccaccctcgccctgcttgccctgccgcaggccccccaccagaagccatctcccccgctgtgtgtccccaggcgcatcattgctccactctcccctgcagccgcggctgctcggccactgaccaggggccctggcagacattaggggatcagttgtatttattgtattttatctgtgtgtgctcaggaggtgagcctagtgggtccttaagtttggttgtgaataatctcttgatagacaatttatacccatgaaagttcagccaatgcccagagtgaccaagcagcaccagcaggcctgcccaggatgctgaaagcagatttcttcttgatttcacttctgatggatgcatggggctctgggggaatgctgggaaaatgggcaagcagagtgcacagccctcgttctgccagctggagccaagaagcacagagacacagaggcgcctgcccctcagctccgctggtctgtctgtgcatccactgtgccgtgggacatatgtaatttgtgcagtgtgacatggacttgctgtcctaatggatgtgttgtgccttgtgtctgtcatgtgtggccagcgtgattgtatagaatccagagtatgtagagagccaaaatgtgtggccctgtccccaagctcagcaccaccggccatgaccagaggttgctcggcccagggtctgggagctgggctaacaggctgacacttcggcagggtcaccaggaggcacagctaggggcatgctcacatgggtaggtcagttctttggtccaagcctctggtgcagattcaagctcctcctcttagaggaagcagctccttcctcccacaggagccccaagggagcactcaccctcctcccaattggatctgaatagctgtgttcctgatcccacataagcatgtctcatccttgccccactggtgagaggaggaccttgtgcctgcccagagcctgcaggacagcacgccttgaggtcagaggcctggcccttctttacagatgtagatagcagggtaggacgcccaggccttctcacatgggcaccatgaaacactttcttccaggccacctgagccttcgttcttcagcccgactggaggaacagcagctctgggaggcacagagtgcaggtctcaggggcagaagacatgggttccagttctggttctgccacacacccaccggccttgaatttctctggtggtctcaagacaagaacaagagctgactctagaatcttctgcctggctgacctctgagcccatgatccctggcttgctgtgcttctcttggatttgaggagagtttatgaatccatccccctgttttcagggacctctgccttctcccacaccccttacactagtgaggactccttcggcctcttgtgtttccttccttttgtgaccattacgccccctccctgtttcttatcaccagcccatcagcccactgactcccatatggtagaaaaggtaccgtggctgctgcagggcacatggagggacctaccctctgggaaagcccttgtgtccctcccagagtccttcaggtaggccctcgcagatgctgcttgctcagaaacaacccgtgcatccctgcccatggattctgcaggacctagaagagtggcattggttctaggaacctgagagtggagtgaggccagcatgcaggaaggagtttggagagagtgtttgctgtgatccattgaaagctccacattaaaccccagccctgtctggccagggagatccatgtgctcaatgttgctgggggacctacaaaagtcaaacattgctcagtaaaatgcctttggctggtcgccagctgtgcatgactgcagttcctagactctaacttaaccccaactttgcagtttctagagctttttgtctgtaatggtgattgggtctccactgtagatgcatgcagtgttcactccaacctcagaggctttcttgcttctggggaaatggcaggtggttgaaaccctgcacatcctcccagggccagccccagaatgggcctttctctgcctgccctgcccttggggccacctctgcctccagcaggcttgagcttgccccaggccttgggcataattatttccccccaaaaaaggcacaaaaataggttttggatcaaagaagtgtttctcagtgaaatgaaaacagtctttttatagcctttagcttgtgagtttggaagtttggggggtcttatgtttgttttgcctcttctgtttcttggaggagagttgaggcttttcttaggtgcatacacagacccaggtgaacacgctgactgtgaacctgccctgtatccggagctgtgctgggcactgaggggatgcaacaaaattaggagaggatccttgctcccaacgtctacttctcctacctcaacaggggtccagggtgcagtgaactcagttcttggcccttgggtgaggattcatggatgaatgaaagctagacctgatggggaggcattatgactaaataggcccagcctccttcccttccagctctgtcctaggagcataggcgggaaatctgagtagagtctgactgcagtttttgcttatgatttgtaaaagccgtcatggggtcaataagaaaataggggtgatggagggggagaagcccaggactgggagaatcgcacatgccccaggggttttcaccaaggattttcaagacaaactggagtaagaattaaagccccagaggatttaattatcctggtttgcaaaagagcctcccatgccagtaccgcccagccttggaggccggaatgctcatggcccctgtggtctgcttgtccttcagcccatgcccagcagatacctctctgactggagacgggctcaaagctggattagaaaggggagaggcacttgtgactttgtttgactctgtgactcacttcctcgctcacaccttgtttgaactactggactttcaactggctttccttaggtcaggcaagcagacagctccccactgaagaggtctgtacagtgacaacccgggccggcagcaaggacacagatgcagccacagtaaggctccatcaggactgggtcagtgatggcaacaggatggccaaggatggctctagaacactctgtccatgcgtcactccccccagttttatttttagctttggcttcagggagtgacagccatcacaaatagccacattctgctctactctccaacataccagattctacactgttgttatttcatgagacgtgaatgttgcagagagtggggggattctggttgttaaggaacttacactggggagctttactcttccgtgtcaacaatgtgactacatgttctccagattagccacacatgcaaacatcagtgtccttctagctttagccgagaaagaaaccagtcccagggaatgaatggtggtctccccactcccggcagcactttaggcagcccataagctatgcgagaatgtgaacgctcaccttgctccgtcacggttctgacctaccacataaacaggaagaagccagtgaccggaacagctctaggaataacaagtcagaatagaagtgtcctttatattaccagaaaatatgggcttggcctaagtcgctgtctcctaacctgccggggtcattccccaccaaacaccccatactaaggagccatgagccacctggacattcaccttttctttgaccatctggagtctggggcaacttaaggaggcaccacacagtggtgcaggcacatttccaagcgtaggtgtccctggcttttgtggccaaagctagtgttatggtcaacaacaggccagggtctgtggggcactgaccttgaaagtggcaaaatggaggtttcacaggctgtgcgggagcaggacggcttgcttcatctaacaatctcagtttcctttaaaaaaagaaagaaaggaaaagatttcataagcaggtgtcagtggacagtttaagtacttaaccatttctctttcttcttatggatgtgaactgtgctgtggataaatcatttgtatttcttgaatgttctctatgactaacagttattaagtcggttgtgtatatgtgtaactaatgtaactgccttttaaaatttcattacaataaaaatgactttgctctg

SEQ ID NO: 109040 - DNA, 5661 bp, Homo sapiens
  Payload ID: 1421
  Gene Symbol: AHRR
  Gene Name: aryl-hydrocarbon receptor repressor
  Uniprot ID: A9YTQ3
  ENST ID: ENST00000316418
  CDS Start-End: 45-2204
ggcacgtggactccctttaatccagtgactgtcaggtcgatcatatgccgaggacgatgatcccgccgggggagtgcacgtacgcgggccggaagcggaggaggcccctgcagaaacagaggcccgccgtgggggcagagaagtccaacccctccaagcgacaccgggaccgcctcaacgccgagttggaccacctggccagcctgctgccgttcccgcctgacatcatctccaagctggacaagctttctgtcctgcgcctcagtgtcagttacctccgggtgaagagcttcttccaagtcgtgcaggagcagagctcacggcagcctgcggccggcgccccctcgcccggagacagctgtcctcttgcagggtctgccgtgctggagggaaggctgctgttggagtctcttaatggctttgctctggtcgtgagtgcagaagggacgatattttatgcatcagcaacgatcgtggactatctgggcttccatcagacggatgtaatgcaccagaacatttatgactacatccacgtggacgaccgccaggacttctgccggcagctccactgggccatggaccctccccaggtggtgtttgggcagcccccgcccttggagacaggagatgatgctatcctggggaggctgctcagggcccaggagtggggcacaggcacgcccaccgagtactcggccttcctgacccgctgcttcatctgccgtgtgcgctgcctgctggacagcacctcgggcttcctggcccgggggtcacaggcttggcagctgcggctctgctgtcccgagccactcatgacgatgcagtttcaaggaaaactaaaattcctgtttggacagaagaagaaggcgccgtcaggagccatgctcccgccgcggctgtcgctgttctgcattgcggcacccgttctcctcccctccgcagcggagatgaaaatgaggagcgcgctcctgagggcaaaacccagagcagacaccgcagccaccgcggatgcaaaagtaaaagccaccaccagtctgtgcgaatcggaactgcatggaaaacccaattactcagcaggaaggagcagcagagagagcggcgttttggtgctcagggaacagactgacgctggccgatgggcacaggttcccgccagggccccatgcctgtgcctccggggtggccctgaccttgtccttgaccccaaggggggctcaggggacagggaggaggagcagcacaggatgctgagcagggcctctggagtgacagggcggagggagactccaggacccacaaagcccctgccctggacagcgggaaagcacagtgaggatggtgccaggccgaggctgcagcccagcaagaatgacccgccctccctgcgccccatgccccgcggctcctgcctgccctgcccgtgtgtccagggcactttcaggaactcgcccatctctcacccgccgagcccgtcccccagtgcctactccagccggaccagcagacccatgcgggatgtcggtgaggaccaggtgcaccctcccctctgccactttccccagaggagcctgcagcaccagctccctcagcctggagctcagcgttttgccacgaggggctatcccatggaggacatgaagctgcaaggtgtaccgatgcctccgggggacctgtgtggtccgacgctgctgctagatgtgtccatcaagatggagaaggactctgggtgtgagggtgctgcagacggctgtgtgcccagccaggtgtggctgggggccagtgacaggagccacccagccaccttccctaccaggatgcacctgaaaacagagccagactctcggcaacaggtgtacatctcgcacctggggcacggcgtgcggggggctcagccccatgggagggccactgctgggcgcagcagggagctgacccctttccaccctgcacactgtgcctgcctggagcccacagacggccttccccagtcggagcctccccaccagctctgtgcacggggccgaggtgaacagtcctgcacctgcagagctgctgaggccgcccctgtggtcaagcgggagcccttggactcaccccagtgggctactcacagccagggaatggtgcccgggatgttgcccaaaagtgccttggccacgctggtcccgccccaagcttcggggtgcacattcctgccatagcgcagtgaccaccatccaagctcagatctgtgtgtctacgctcagatgcgtcggtggctgggctgccctgctcctggtcaggccggagcccgtcctaagacacacgctttgcagagctgtgcatgcgcagtctgctagtgtgtgtgtgcagcatacgcaggagcctatcctgaattttgtaaaatatcccaacagttcttaaatgaaaactggccttaagtctattcaagcatgacagcatttctctttgaggaattaaaatctttaggaaagtgatcatggctggacagcttcatgccccagaggcagcgagcacccgtcccatggctgccaagtccacagtcggggatgaagcagtcgggtgatgctcccaagtccgcagtcggggatgaagcggtcgggtgatgctcccaagtccgcagtcggggatgaagcggtcgggtgacacacctagctcagccctcccaggccacctgcagctcccagcctgtgctgtgcaggcagggtcagcccatcgccacagtgcactgtagaggccagcacacggcaaattagaaatacaacacgcggagaaaggggtccgtgagcccactcatagaggaatctagaacgttccaggcagcagaggctggcagcgtgggtcccacactgccccacaccgtgcggcaggtgctccatggcgccatgacagagtctgaggccagacctggactggaattgacagcataacccctgttccttctggacatctcccgagttctcagtgggtctctgcggacggttcttcctaatctgcctcttggtacatcacgtaatacagagttcacagactccgggtttggaagtacagagaaacacacaacgtagagagaagacacaggaaactgcgctgcctgtgggggtttctctctggctggctgtacagttcactcaaatgagggttcccattgccatcctaggagaataattagggacaagacagacaagtattaatagcattaaaacagttgtaaaggcgatattttctgagagtaggaaatttggatacaaaagcataagtcagaaagtgaaggtcaccaatccaccaacccgagaacctacagctgatggtgcatttcaggcttcttccacggtctggcctggaaccccacccggctggtgcaggcatcagatcagggtgtagaagtcaccccaagcaagaggaagccaggcagtgaggccctggggtgtggctgcagctgggcccacctgtgcgggggtgggaaggccccatcctcagggagagggcatcggcgccctgacgtcagctccactgggagtggcaggagctgtgggagcccatgggtgagggacccaccaccccgctgcactgtgcattgtgcctcccgtgtggacgccctctctgttgttggcccgcgggtgagggacccaccacccctagggacccaccaccccgccgcactgtgcattctgcctcctgtgtggacgccctctctgttgtcagtggctttgaggtgtcagtgcttacttagatgctggtttaatgctggacccatttgttaaacgcaccttcactttgtcaaaacccaggtttggttggcaggactgggtcttctgcccaatgccaggtgcctgcgcctctcagtggcctggttcttggacagtttgcccccatgtggcagggatagggataaggatctcctctcagtactggaagagaacagccaaccatctgagcccagagtcacagatccatcgtggccccctatgacccccaagccctaccgagggggcactcactctctgcttagccagggggcgtctttcaaaaggtgacctccatgctgtgctgtcgtgggtgtgagacgtgctcatggccttccactgccatctctcccttatctgatgcctaaagtcacgatggggacagagctacccaggggccagccatggggtgaccagccacctgagggtcagtcacctgtggagagcaggcacctgtgaagaccaggcacctgaggactggcgcctacttcccactttggccctacactggcacagagcccctctttattcatttctcatgctgagcatggcacacttctggcctctgggcatttatggatttaagaccaggatggtatttcagaagcttcccacttccttcctattctaaccgagtgcccagctcctttgctgatcatggaaagacccttaataattaggcctgcaggccaggcgcagtggctcatgcctataatcccagcactttaggaggtcaaggtaggaggatcgcttaagcccaggagttcaagaccagcctgggcaacacaggaagaatgtgtctctacaaaaaataattaaaaatcagatctgctgtatccctgaaaaagtctcaatcaacatgcatgttccactcttggagttccctgttctgagggccagccacgtcctgtgtcctggagcttagccctcagcagctcccttcagcctgggcgccgcctgggtcccaaacgtggcagctgctcttccagtctcggggccgaggagggcagggagctcagtgactgagagtcttgtgtatcacatgtcttgagtgtcctggagccaacggctgtcactgggaaaaacaccaggccccaaagatcgaatcagagacgtggctgcgtgtttgcgattgtagccaggcccttcagtgtcatcaaaggagcactggggcctccttaagcacagacggcagcccctgcccaggaggcttcttcaccacgtcctgccctgcagcctcccagacctttagatgcgcccctgcccaaggccctcctggtgacaggtgccagattgagtggtgggttgctgccaggcaggccacgctgtgttgacgctgcactcagcacgtgggtgttggctctgccggttttgtggtgtggggaccctacaggaggctgcggccctgagagcctgggatcagcgaggtgtccgacatcccttcctcaacggcaacaaaaactccccaagtcagcactttggttattttatagccacaaccctcttggaaaacagtggggaagactatggaacatagaaagtgtggatgtatcacttctctctaaaatgtcattgttagcactaattacaggttcatgtttttctgtgtatgtagcttttccctatatagctgaaaaagtattaaagtcaaatataaggtgggaatgggatggaagggaggagatcaatacaacttatatttttgcagtttctactggaagaaaaaagttttcaatacctagaccaacttgttgaatttttaaaacttatgcactataaatgcaactttctctactgctttctcagtgcctttaggaagctttcaaatttttttgtactgtggtttgtattaaatttgcaatattgatgtaaaatacatgacatgctagtacatgtttaacaaaaatttaaa

SEQ ID NO: 109041 - DNA, 2173 bp, Homo sapiens
  Payload ID: 1421
  Gene Symbol: AHRR
  Gene Name: aryl-hydrocarbon receptor repressor
  Uniprot ID: A9YTQ3
  ENST ID: ENST00000505113
  CDS Start-End: 45-2150
ggcacgtggactccctttaatccagtgactgtcaggtcgatcatatgccgaggacgatgatcccgccgggggagtgcacgtacgcgggccggaagcggaggaggcccctgcagaaacagaggcccgccgtgggggcagagaagtccaacccctccaagcgacaccgggaccgcctcaacgccgagttggaccacctggccagcctgctgccgttcccgcctgacatcatctccaagctggacaagctttctgtcctgcgcctcagtgtcagttacctccgggtgaagagcttcttccaagtcgtgcaggagcagagctcacggcagcctgcggccggcgccccctcgcccggagacagctgtcctcttgcagggtctgccgtgctggagggaaggctgctgttggagtctcttaatggctttgctctggtcgtgagtgcagaagggacgatattttatgcatcagcaacgatcgtggactatctgggcttccatcagacggatgtaatgcaccagaacatttatgactacatccacgtggacgaccgccaggacttctgccggcagctccactgggccatggaccctccccaggtggtgtttgggcagcccccgcccttggagacaggagatgatgctatcctggggaggctgctcagggcccaggagtggggcacaggcacgcccaccgagtactcggccttcctgacccgctgcttcatctgccgtgtgcgctgcctgctggacagcacctcgggcttcctgacgatgcagtttcaaggaaaactaaaattcctgtttggacagaagaagaaggcgccgtcaggagccatgctcccgccgcggctgtcgctgttctgcattgcggcacccgttctcctcccctccgcagcggagatgaaaatgaggagcgcgctcctgagggcaaaacccagagcagacaccgcagccaccgcggatgcaaaagtaaaagccaccaccagtctgtgcgaatcggaactgcatggaaaacccaattactcagcaggaaggagcagcagagagagcggcgttttggtgctcagggaacagactgacgctggccgatgggcacaggttcccgccagggccccatgcctgtgcctccggggtggccctgaccttgtccttgaccccaaggggggctcaggggacagggaggaggagcagcacaggatgctgagcagggcctctggagtgacagggcggagggagactccaggacccacaaagcccctgccctggacagcgggaaagcacagtgaggatggtgccaggccgaggctgcagcccagcaagaatgacccgccctccctgcgccccatgccccgcggctcctgcctgccctgcccgtgtgtccagggcactttcaggaactcgcccatctctcacccgccgagcccgtcccccagtgcctactccagccggaccagcagacccatgcgggatgtcggtgaggaccaggtgcaccctcccctctgccactttccccagaggagcctgcagcaccagctccctcagcctggagctcagcgttttgccacgaggggctatcccatggaggacatgaagctgcaaggtgtaccgatgcctccgggggacctgtgtggtccgacgctgctgctagatgtgtccatcaagatggagaaggactctgggtgtgagggtgctgcagacggctgtgtgcccagccaggtgtggctgggggccagtgacaggagccacccagccaccttccctaccaggatgcacctgaaaacagagccagactctcggcaacaggtgtacatctcgcacctggggcacggcgtgcggggggctcagccccatgggagggccactgctgggcgcagcagggagctgacccctttccaccctgcacactgtgcctgcctggagcccacagacggccttccccagtcggagcctccccaccagctctgtgcacggggccgaggtgaacagtcctgcacctgcagagctgctgaggccgcccctgtggtcaagcgggagcccttggactcaccccagtgggctactcacagccagggaatggtgcccgggatgttgcccaaaagtgccttggccacgctggtcccgccccaagcttcggggtgcacattcctgccatagcgcagtgaccaccatccaagctc

SEQ ID NO: 109042 - DNA, 1912 bp, Homo sapiens
  Payload ID: 1421
  Gene Symbol: AHRR
  Gene Name: aryl-hydrocarbon receptor repressor
  ENST ID: ENST00000512529
  CDS Start-End: 210-1853
gactccctttaatccagtgactgtcaggtcgatcatatgccgaggacgatgatcccgccgggggagtgcacgtacgcgggccggaagcggaggaggcccctgcagaaacatctcttaatggctttgctctggtcgtgagtgcagaagggacgatattttatgcatcagcaacgatcgtggactatctgggcttccatcagacggatgtaatgcaccagaacatttatgactacatccacgtggacgaccgccaggacttctgccggcagctccactgggccatggaccctccccaggtggtgtttgggcagcccccgcccttggagacaggagatgatgctatcctggggaggctgctcagggcccaggagtggggcacaggcacgcccaccgagtactcggccttcctgacccgctgcttcatctgccgtgtgcgctgcctgctggacagcacctcgggcttcctgacgatgcagtttcaaggaaaactaaaattcctgtttggacagaagaagaaggcgccgtcaggagccatgctcccgccgcggctgtcgctgttctgcattgcggcacccgttctcctcccctccgcagcggagatgaaaatgaggagcgcgctcctgagggcaaaacccagagcagacaccgcagccaccgcggatgcaaaagtaaaagccaccaccagtctgtgcgaatcggaactgcatggaaaacccaattactcagcaggaaggagcagcagagagagcggcgttttggtgctcagggaacagactgacgctggccgatgggcacaggttcccgccagggccccatgcctgtgcctccggggtggccctgaccttgtccttgaccccaaggggggctcaggggacagggaggaggagcagcacaggatgctgagcagggcctctggagtgacagggcggagggagactccaggacccacaaagcccctgccctggacagcgggaaagcacagtgaggatggtgccaggccgaggctgcagcccagcaagaatgacccgccctccctgcgccccatgccccgcggctcctgcctgccctgcccgtgtgtccagggcactttcaggaactcgcccatctctcacccgccgagcccgtcccccagtgcctactccagccggaccagcagacccatgcgggatgtcggtgaggaccaggtgcaccctcccctctgccactttccccagaggagcctgcagcaccagctccctcagcctggagctcagcgttttgccacgaggggctatcccatggaggacatgaagctgcaaggtgtaccgatgcctccgggggacctgtgtggtccgacgctgctgctagatgtgtccatcaagatggagaaggactctgggtgtgagggtgctgcagacggctgtgtgcccagccaggtgtggctgggggccagtgacaggagccacccagccaccttccctaccaggatgcacctgaaaacagagccagactctcggcaacaggtgtacatctcgcacctggggcacggcgtgcggggggctcagccccatgggagggccactgctgggcgcagcagggagctgacccctttccaccctgcacactgtgcctgcctggagcccacagacggccttccccagtcggagcctccccaccagctctgtgcacggggccgaggtgaacagtcctgcacctgcagagctgctgaggccgcccctgtggtcaagcgggagcccttggactcaccccagtgggctactcacagccagggaatggtgcccgggatgttgcccaaaagtgccttggccacgctggtcccgccccaagcttcggggtgcacattcctgccatagcgcagtgaccaccatccaagctcagatctgtgtgtctacgctcagatgcgtcggtggct

SEQ ID NO: 109043 - DNA, 646 bp, Homo sapiens
  Payload ID: 1421
  Gene Symbol: AHRR
  Gene Name: aryl-hydrocarbon receptor repressor
  ENST ID: ENST00000511487
  CDS Start-End: 1-646
ctcctcccctccgcagcggagatgaaaatgaggagcgcgctcctgagggcaaaacccagagcagacaccgcagccaccgcggatgcaaaggacagggaggaggagcagcacaggatgctgagcagggcctctggagtgacagggcggagggagactccaggacccacaaagcccctgccctggacagcgggaaagcacagtgaggatggtgccaggccgaggctgcagcccagcaagaatgacccgccctccctgcgccccatgccccgcggctcctgcctgccctgcccgtgtgtccagggcactttcaggaactcgcccatctctcacccgccgagcccgtcccccagtgcctactccagccggaccagcagacccatgcgggatgtcggtgaggaccaggtgcaccctcccctctgccactttccccagaggagcctgcagcaccagctccctcagcctggagctcagcgttttgccacgaggggctatcccatggaggacatgaagctgcaaggtgtaccgatgcctccgggggacctgtgtggtccgacgctgctgctagatgtgtccatcaagatggagaaggactctgggtgtgagggtgctgcagacggctgtgtgcccagccaggtgtggctggggg

SEQ ID NO: 109044 - DNA, 2350 bp, Homo sapiens
  Payload ID: 1421
  Gene Symbol: AHRR
  Gene Name: aryl-hydrocarbon receptor repressor
  ENST ID: ENST00000506456
  CDS Start-End: 401-2074
acgcacacgcagccacccacccacacaggcgcacatacgctggcaccgctgaacagccaaaatatacacgatggttcttcttatggttcaggaggtggaaagttgaaaccatagcaagaaacgtggcctatccaccgcagcgactaaaagataaagagggaaaaggacaaacattggccagaaggtgcagcggctggagcgttcgcgccttaactggaagaggagccgccccgcctgggaggccgctctggcgcccggctggtgccgggcaggaggcccttgcggacccagcggcctcctcgtcggcaacgcccaccccgcggttcagccacggagcggatgccgtgtgcaggcacggaacgggcgaggctgttgcgctgcaggtgcccccacggtcgcgatgcggggcagggggatgccgacggatgtaatgcaccagaacatttatgactacatccacgtggacgaccgccaggacttctgccggcagctccactgggccatggaccctccccaggtggtgtttgggcagcccccgcccttggagacaggagatgatgctatcctggggaggctgctcagggcccaggagtggggcacaggcacgcccaccgagtactcggccttcctgacccgctgcttcatctgccgtgtgcgctgcctgctggacagcacctcgggcttcctgacgatgcagtttcaaggaaaactaaaattcctgtttggacagaagaagaaggcgccgtcaggagccatgctcccgccgcggctgtcgctgttctgcattgcggcacccgttctcctcccctccgcagcggagatgaaaatgaggagcgcgctcctgagggcaaaacccagagcagacaccgcagccaccgcggatgcaaaagtaaaagccaccaccagtctgtgcgaatcggaactgcatggaaaacccaattactcagcaggaaggagcagcagagagagcggcgttttggtgctcagggaacagactgacgctggccgatgggcacaggttcccgccagggccccatgcctgtgcctccggggtggccctgaccttgtccttgaccccaaggggggctcaggggacagggaggaggagcagcacaggatgctgagcagggcctctggagtgacagggcggagggagactccaggacccacaaagcccctgccctggacagcgggaaagcacagtgaggatggtgccaggccgaggctgcagcccagcaagaatgacccgccctccctgcgccccatgccccgcggctcctgcctgccctgcccgtgtgtccagggcactttcaggaactcgcccatctctcacccgccgagcccgtcccccagtgcctactccagccggaccagcagacccatgcgggatgtcggtgaggaccaggtgcaccctcccctctgccactttccccagaggagcctgcagcaccagctccctcagcctggagctcagcgttttgccacgaggggctatcccatggaggacatgaagctgcaaggtgtaccgatgcctccgggggacctgtgtggtccgacgctgctgctagatgtgtccatcaagatggagaaggactctgggtgtgagggtgctgcagacggctgtgtgcccagccaggtgtggctgggggccagtgacaggagccacccagccaccttccctaccaggatgcacctgaaaacagagccagactctcggcaacaggtgtacatctcgcacctggggcacggcgtgcggggggctcagccccatgggagggccactgctgggcgcagcagggagctgacccctttccaccctgcacactgtgcctgcctggagcccacagacggccttccccagtcggagcctccccaccagctctgtgcacggggccgaggtgaacagtcctgcacctgcagagctgctgaggccgcccctgtggtcaagcgggagcccttggactcaccccagtgggctactcacagccagggaatggtgcccgggatgttgcccaaaagtgccttggccacgctggtcccgccccaagcttcggggtgcacattcctgccatagcgcagtgaccaccatccaagctcagatctgtgtgtctacgctcagatgcgtcggtggctgggctgccctgctcctggtcaggccggagcccgtcctaagacacacgctttgcagagctgtgcatgcgcagtctgctagtgtgtgtgtgcagcatacgcaggagcctatcctgaattttgtaaaatatcccaacagttcttaaatgaaaactggccttaagtctattcaagcatgacagcatttctctttgaggaattaaaatctttaggaaagtga

SEQ ID NO: 109045 - DNA, 576 bp, Homo sapiens
  Payload ID: 1421
  Gene Symbol: AHRR
  Gene Name: aryl-hydrocarbon receptor repressor
  ENST ID: ENST00000510400
  CDS Start-End: 104-576
gtgtgcgcgcgttctccaaacgccacccccacggggcctcacagccgccccggcctggcaaccgtcacccattttacgaacgaggacatcaaggccgaggacgatgatcccgccgggggagtgcacgtacgcgggccggaagcggaggaggcccctgcagaaacagaggcccgccgtgggggcagagaagtccaacccctccaagcgacaccgggaccgcctcaacgccgagttggaccacctggccagcctgctgccgttcccgcctgacatcatctccaagctggacaagctttctgtcctgcgcctcagtgtcagttacctccgggtgaagagcttcttccaagtcgtgcaggagcagagctcacggcagcctgcggccggcgccccctcgcccggagacagctgtcctcttgcagggtctgccgtgctggagggaaggctgctgttggagtctcttaatggctttgctctggtcgtgagtgcagaagggacgatattttatgcatcagcaacgatcgtggactatctgggcttccatcagacggatgtaatgcaccagaacatttatgacta

SEQ ID NO: 109046 - DNA, 435 bp, Homo sapiens
  Payload ID: 1421
  Gene Symbol: AHRR
  Gene Name: aryl-hydrocarbon receptor repressor
  ENST ID: ENST00000504625
  CDS Start-End: 192-435
ccttggctgcgccccgccccgcccgttcctggcttcctcgatggcttcctcctcaggacgccggtctcccgccacggcgccctgagccaggctccagagcaggcggcttctctgggggaggccgggacccgcctgacaccgaggggaggcccaggcgtgacccggccccggtggctcctcggccgaggacgatgatcccgccgggggagtgcacgtacgcgggccggaagcggaggaggcccctgcagaaacagaggcccgccgtgggggcagagaagtccaacccctccaagcgacaccgggaccgcctcaacgccgagttggaccacctggccagcctgctgccgttcccgcctgacatcatctccaagctggacaagctttctgtcctgcgcctcagtgtcagttacctccgggtgaagagcttcttccaag

SEQ ID NO: 109047 - DNA, 462 bp, Homo sapiens
  Payload ID: 1421
  Gene Symbol: AHRR
  Gene Name: aryl-hydrocarbon receptor repressor
  ENST ID: ENST00000515206
  CDS Start-End: 34-453
attttacgaacgaggacatcaaggccgaggacgatgatcccgccgggggagtgcacgtacgcgggccggaagcggaggaggcccctgcagaaacagaggcccgccgtgggggcagagaagtccaacccctccaagcgacaccgggaccgcctcaacgccgagttggaccacctggccagcctgctgccgttcccgcctgacatcatctccaagctggacaagctttctgtcctgcgcctcagtgtcagttacctccgggtgaagagcttcttccaaggacaggggttggcagtggcagatgccgaagatgtggatgaccacacgggcgaacgaaggcccatgtcgttcaggaggccccgagcattggacacccaggccctgagacgtactcagttcggtctgcatctgttgatggtgaatattgcaggactgatagccactgaccgcctgtagtgatgtgtg

SEQ ID NO: 109048 - DNA, 563 bp, Homo sapiens
  Payload ID: 1421
  Gene Symbol: AHRR
  Gene Name: aryl-hydrocarbon receptor repressor
  ENST ID: ENST00000514523
  CDS Start-End: 527-563
tcctggccagggcgcgctgccccgcgggtgtgcctgagcctccgcgccccgcaggccctgggccgaggacgatgatcccgccgggggagtgcacgtacgcgggccggaagcggaggaggcccctgcagaaacagtaaagaggcccgccgtgggggcagagaagtccaacccctccaagcgacaccgggaccgcctcaacgccgagttggaccacctggccagcctgctgccgttcccgcctgacatcatctccaagctggacaagctttctgtcctgcgcctcagtgtcagttacctccgggtgaagagcttcttccaagtcgtgcaggagcagagctcacggcagcctgcggccggcgccccctcgcccggagacagctgtcctcttgcagggtctgccgtgctggagggaaggctgctgttggagtctcttaatggctttgctctggtcgtgagtgcagaagggacgatattttatgcatcagcaacgatcgtggactatctgggcttccatcagacggatgtaatgcaccagaacatttatgactacatccacgtggacg

SEQ ID NO: 109049 - DNA, 2050 bp, Homo sapiens
  Payload ID: 1422
  Gene Symbol: ARSA
  Gene Name: arylsulfatase A
  ENST ID: ENST00000216124
  CDS Start-End: 394-1923
acaggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccggtactgtcgggccccggccctctggagcttcaggaggcggccgtcagggtcggggagtatttgggtccggggtctcagggaagggcggcgcctgggtctgcggtatcggaaagagcctgctggagccaagtagccctccctctcttgggacagacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcagatgtgacaa

SEQ ID NO: 109050 - DNA, 1895 bp, Homo sapiens
  Payload ID: 1422
  Gene Symbol: ARSA
  Gene Name: arylsulfatase A
  ENST ID: ENST00000356098
  CDS Start-End: 239-1768
aggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccgacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcagatgtgacaa

SEQ ID NO: 109051 - DNA, 1824 bp, Homo sapiens
  Payload ID: 1422
  Gene Symbol: ARSA
  Gene Name: arylsulfatase A
  ENST ID: ENST00000395619
  CDS Start-End: 183-1712
cggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaagacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagac

SEQ ID NO: 109052 - DNA, 1918 bp, Homo sapiens
  Payload ID: 1422
  Gene Symbol: ARSA
  Gene Name: arylsulfatase A
  ENST ID: ENST00000395621
  CDS Start-End: 272-1801
gccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccggtactgtcgggccccggccctctggagcttcaggaggcggccgtcaggacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgca

SEQ ID NO: 109053 - DNA, 1650 bp, Homo sapiens
  Payload ID: 1422
  Gene Symbol: ARSA
  Gene Name: arylsulfatase A
  Uniprot ID: P15289
  ENST ID: ENST00000453344
  CDS Start-End: 263-1534
cacaggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccgggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgc

SEQ ID NO: 109054 - DNA, 576 bp, Homo sapiens
  Payload ID: 1422
  Gene Symbol: ARSA
  Gene Name: arylsulfatase A
  ENST ID: ENST00000608497
  CDS Start-End: 1-209
acccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctgacggagtctcgctctgtcgcccaggctagagtgcagtggtaccatctccgctcactgcaacctccgcctcccgggttccagggattctcctgcctcagcctccctagtagctggaactacagtgctgggcaaaggtcccttgatcttggagttgcagcctctttctctccaaggagggcggtgaccagcctgagccagtcaatccagtgattggttcaggagtagcctgtgaccaggagtcctggtagtgaacgactggggcagccctgggggtgaggaccttgcgcagccgtcacaggccctgattggacactgggcagctgctaacccagtgtctccagctgcctacctggagagctccaagcgtaagaaaataaaccctgcctgttgaagcca

SEQ ID NO: 109055 - DNA, 5327 bp, Homo sapiens
  Payload ID: 1423
  Gene Symbol: ARSB
  Gene Name: arylsulfatase B
  Uniprot ID: P15848
  ENST ID: ENST00000264914
  CDS Start-End: 538-2139
ctgccacaggctgggctcttgtgctagaaatgacttgctagctagacatcatggttcaggatctgagtcagaggtttaaccatttataagcttttttcttatgaaaaattggcactaattataatgtctaactgtcagagttgttgcaggctttacaggagacgcgggctgtgaagatgctttgtaaattgtgaagcgttattaaagaacacatcttttttttttaggaaaccacagtgcaaatttaattgccggggaagataacgggccttggtgccctccaagcgtcagctgagtttccaagaagccgggcagcgggcgcccgcgggttcgtctctggctcctcctccgccacagcagccgggggcccgggtcggaggcggcgggggccgagcgcccggcctcgcaagcccacggcccgctgggggtgccgtcccgcgccggggcggagcaggccccggcagcccagttcctcattctatcagcggtacaaggggctggtggcgccacaggcgctgggaccgcgggcggacaaggatgggtccgcgcggcgcggcgagcttgccccgaggccccggacctcggcggctgctcctccccgtcgtcctcccgctgctgctgctgctgttgttggcgccgccgggctcgggcgccggggccagccggccgccccacctggtcttcttgctggcagacgacctaggctggaacgacgtcggcttccacggctcccgcatccgcacgccgcacctggacgcgctggcggccggcggggtgctcctggacaactactacacgcagccgctgtgcacgccgtcgcggagccagctgctcactggccgctaccagatccgtacaggtttacagcaccaaataatctggccctgtcagcccagctgtgttcctctggatgaaaaactcctgccccagctcctaaaagaagcaggttatactacccatatggtcggaaaatggcacctgggaatgtaccggaaagaatgccttccaacccgccgaggatttgatacctactttggatatctcctgggtagtgaagattattattcccatgaacgctgtacattaattgacgctctgaatgtcacacgatgtgctcttgattttcgagatggcgaagaagttgcaacaggatataaaaatatgtattcaacaaacatattcaccaaaagggctatagccctcataactaaccatccaccagagaagcctctgtttctctaccttgctctccagtctgtgcatgagccccttcaggtccctgaggaatacttgaagccatatgactttatccaagacaagaacaggcatcactatgcaggaatggtgtcccttatggatgaagcagtaggaaatgtcactgcagctttaaaaagcagtgggctctggaacaacacggtgttcatcttttctacagataacggagggcagactttggcagggggtaataactggccccttcgaggaagaaaatggagcctgtgggaaggaggcgtccgaggggtgggctttgtggcaagccccttgctgaagcagaagggcgtgaagaaccgggagctcatccacatctctgactggctgccaacactcgtgaagctggccaggggacacaccaatggcacaaagcctctggatggcttcgacgtgtggaaaaccatcagtgaaggaagcccatcccccagaattgagctgctgcataatattgacccgaacttcgtggactcttcaccgtgtcccaggaacagcatggctccagcaaaggatgactcttctcttccagaatattcagcctttaacacatctgtccatgctgcaattagacatggaaattggaaactcctcacgggctacccaggctgtggttactggttccctccaccgtctcaatacaatgtttctgagataccctcatcagacccaccaaccaagaccctctggctctttgatattgatcgggaccctgaagaaagacatgacctgtccagagaatatcctcacatcgtcacaaagctcctgtcccgcctacagttctaccataaacactcagtccccgtgtacttccctgcacaggacccccgctgtgatcccaaggccactggggtgtggggcccttggatgtaggatttcagggaggctagaaaacctttcaattggaagttggacctcaggccttttctcacgactcttgtctcatttgttatcccaacctgggttcacttggcccttctcttgctcttaaaccacaccgaggtgtctaatttcaacccctaatgcatttaagaagctgataaaatctgcaacactcctgctgttggctggagcatgtgtctagaggtgggggtggctgggtttatccccctttcctaagccttgggacagctgggaacttaacttgaaataggaagttctcactgaatcctggaggctggaacagctggctcttttagactcacaagtcagacgttcgattcccctctgccaatagccagttttattggagtgaatcacatttcttacgcaaatgaagggagcagacagtgattaatggttctgttggccaaggcttctccctgtcggtgaaggatcatgttcaggcactccaagtgaaccacccctcttggttcaccccttactcacttatctcatcacagagcataaggcccattttgttgttcaggtcaacagcaaaatgcctgcaccatgactgtggcttttaaaataaagaaatgtgtttttatcgtaatttatttccccccagccattgctcactctgtctagacttcctgccacttccaattcttctgtggcttttcctgcctttccttttgacctcagtagtcctatccctgggaaggccactttgcttctctacctgagcacccctgatttctggaacgctgctgagccctgccttacttttgcccctagggctgaagctagaggcctccccgtaataggcggtggagttgctctgtgaggatgttcatggtagacactaagagggctgggtgggagatgcttggctctgtggcatctgttcagcgaggcttttcctatattgcatggagttagtcattgtgattgtagctttatttcataatatattaagacttgcactgctatttactagcagtgagaagaaacctcaggaaaggatatgaaaaagcaagtggccagtgtctgggatactgggccttggtaaagcagaggagggcacacccacagtcctcttattctctgttttactgcttgttttgaggttctggggtctggcaaagaggatgcagtttgacacctgcagccctttctcaatcccactaatgtcttactaatgtggaacagtccatattagctccagagagtgtcaaacccagagaaatgtgtgcaaaaatgatactcttttctgcattagccccaccattgtgttcaccaatgcttggaacactgcctgaaggcactcattttttaatttttattttatttttaattttttatatctttatgagacgatctcactctgtcaccaggttggagtacagtggtacaatcacaactcaccgtagcctcaaactcctgggctcaagtgattctcccacctcaggcacccaaatagctggaactacaggcatataccgccacacccagctaattttattttttgaaaagacaaggttccctatgttgcccagctggtcttaaactcctgggctccagcaattatcccagcttgggctccaaaagtgctgggattacaggcatgagtcaccatgcctggcctcattttttaaaacaaatgaataaatggacaaatgagtaaatgagaaagtctcacaccatgaaagatgctagtccaatgagctgaatacagaggtaatataaatgtcttccagctgttgcttttctgttctcaagctgcccctcctggggtaggagcataatctacatcactgggcagtcacaggacactctatagcaaggttgtagcgtcctctccagtggggggagaaaaggaactgtgcctaccaaaggtactctcttgtcagcaatttccatttctatactttatgggacactagaaactaaaagcaacaaataatctgatataagtccttgtatagtcatccttcaattcagtagcaatattttctggtcactactaacctgtattgtattaaaatgagactattggaaggaaatggtgctaaaactaataacatctcttaccaacctttacccaactcctgggttggcaaacagctgaccaaactgccatcacctcccacttggaagtgtatggccgacagcatgaaatagctgagcccagatgttccttctgcatcctccgaatcccagggctgggtgtaggtagccgttggaggccatcgctacagggcacctatctgttatcgctgctgtcctcccaacagctgtctccagttctagttccttggttttcaggcacagtgggggatgttctgcacccagtggacttcaaaagagttttgaagacttaattttttgtaaaacaagtacttgagattttggtttatccataatagaatgtatttcattagattctctgattctatataagaatgtgaaaagattgatatattgttgttagaaataatgttatttctttccaattttttttttttttttttttgagatggagtctcgctctgtcacccaggctggagtgcagtggtgtgatctcggctcactgcagcctctaactcccaggttcaagctattctcctgcctcagcctcccaagtagctggattacaggcatacaccaccacgcctggctatgttttgtatttttcgtagagatagggtttcaccatgttggccaggctggtctcaaactcctgacctcaagtgatccacccacttcagcttcccaaagcactgggattacaggtgtgagccactgtgcccggcaaatttttttacctttacagaaggttttgcttatttaattgtgagctcatttttctttgttacttttgtccccccagatttgggggacaaaataaaattaatcttttaaaatgtgtcagccatatgtatggggcttccatttggggtgaggagaaagttctggaactagatagtggtcatggttatacaacatcataaatgcaattactgccactgaattgtatgttttaaagtggttaaaatgttaagttttatgttttattacaatttttaaatgtgtcaaccaactttatagtacataaattatatctcagtaaagctgttaaataaataaatatagtaaaaattttagaactaaaaaaa

SEQ ID NO: 109056 - DNA, 2316 bp, Homo sapiens
  Payload ID: 1423
  Gene Symbol: ARSB
  Gene Name: arylsulfatase B
  Uniprot ID: P15848
  ENST ID: ENST00000396151
  CDS Start-End: 500-1741
agatatttcaggctaactagatactgtgtgcttcttagtgtcactgcttagtgggggagccagctctgagtggggtcatatccggacaagcgaatgagctatttattcaatgaccacgcaacactccaaatcctcccagggcaacttgaaagtaaccgcaccttccaaagggcaccgtgcaatcagactgaaaccacagtgcaaatttaattgccggggaagataacgggccttggtgccctccaagcgtcagctgagtttccaagaagccgggcagcgggcgcccgcgggttcgtctctggctcctcctccgccacagcagccgggggcccgggtcggaggcggcgggggccgagcgcccggcctcgcaagcccacggcccgctgggggtgccgtcccgcgccggggcggagcaggccccggcagcccagttcctcattctatcagcggtacaaggggctggtggcgccacaggcgctgggaccgcgggcggacaaggatgggtccgcgcggcgcggcgagcttgccccgaggccccggacctcggcggctgctcctccccgtcgtcctcccgctgctgctgctgctgttgttggcgccgccgggctcgggcgccggggccagccggccgccccacctggtcttcttgctggcagacgacctaggctggaacgacgtcggcttccacggctcccgcatccgcacgccgcacctggacgcgctggcggccggcggggtgctcctggacaactactacacgcagccgctgtgcacgccgtcgcggagccagctgctcactggccgctaccagatccgtacaggtttacagcaccaaataatctggccctgtcagcccagctgtgttcctctggatgaaaaactcctgccccagctcctaaaagaagcaggttatactacccatatggtcggaaaatggcacctgggaatgtaccggaaagaatgccttccaacccgccgaggatttgatacctactttggatatctcctgggtagtgaagattattattcccatgaacgctgtacattaattgacgctctgaatgtcacacgatgtgctcttgattttcgagatggcgaagaagttgcaacaggatataaaaatatgtattcaacaaacatattcaccaaaagggctatagccctcataactaaccatccaccagagaagcctctgtttctctaccttgctctccagtctgtgcatgagccccttcaggtccctgaggaatacttgaagccatatgactttatccaagacaagaacaggcatcactatgcaggaatggtgtcccttatggatgaagcagtaggaaatgtcactgcagctttaaaaagcagtgggctctggaacaacacggtgttcatcttttctacagataacggagggcagactttggcagggggtaataactggccccttcgaggaagaaaatggagcctgtgggaaggaggcgtccgaggggtgggctttgtggcaagccccttgctgaagcagaagggcgtgaagaaccgggagctcatccacatctctgactggctgccaacactcgtgaagctggccaggggacacaccaatggcacaaagcctctggatggcttcgacgtgtggaaaaccatcagtgaaggaagcccatcccccagaattgagctgctgcataatattgacccgaacttcgtggactcttcaccgtactggcctgagtgctcgctgctgttgtagctaccaccaactttctactgaagatgataacccagggcataagaaatgacttcagacccaaggttctgaaagggcccctcaaggcctcgggtggctcctgcagaagtggcagaagaggcgggaactaggaacctggcatcataggaaaagtgccttctccaagaaagaaggggccccaggaggctgtcttacttagatcaaccataaactaccacagatgggtcatttcttatattatttcaaaatatctttgaagatgagaattcatttgtgtccttcatagaccaaagttctttgtgttaccttttcccaaaagtaaattcctttccctttattcattccttgtggaaataaaatgcaagccctttatacttgtcttacagtaatatggcacatgtagcttacttttgagcatcccagtgaataatgtttggaacttttcttattacctaatagcatatagagaagagtgaagtcagctaaaaacagaaattttgaaaagccatcttcaggaaaatgtaggcccagatgctttcctccaccttttttgacaggctgccacatacagtttcaca

SEQ ID NO: 109057 - DNA, 573 bp, Homo sapiens
  Payload ID: 1423
  Gene Symbol: ARSB
  Gene Name: arylsulfatase B
  ENST ID: ENST00000521117
  CDS Start-End: 437-573
ataaatgaatgtgaaaggctatttagacctctgccttttcaccgtcctcccacctgccacaggctgggctcttgtgctagaaatgacttgctagctagacatcatggttcaggatctgagtcagaggaaaccacagtgcaaatttaattgccggggaagataacgggccttggtgccctccaagcgtcagctgagtttccaagaagccgggcagcgggcgcccgcgggttcgtctctggctcctcctccgccacagcagccgggggcccgggtcggaggcggcgggggccgagcgcccggcctcgcaagcccacggcccgctgggggtgccgtcccgcgccggggcggagcaggccccggcagcccagttcctcattctatcagcggtacaaggggctggtggcgccacaggcgctgggaccgcgggcggacaaggatgggtccgcgcggcgcggcgagcttgccccgaggccccggacctcggcggctgctcctccccgtcgtcctcccgctgctgctgctgctgttgttggcgccgccgggctcgggcgccggggccagccggccgcccca

SEQ ID NO: 109058 - DNA, 1772 bp, Homo sapiens
  Payload ID: 1423
  Gene Symbol: ARSB
  Gene Name: arylsulfatase B
  Uniprot ID: P15848
  ENST ID: ENST00000565165
  CDS Start-End: 500-1741
agatatttcaggctaactagatactgtgtgcttcttagtgtcactgcttagtgggggagccagctctgagtggggtcatatccggacaagcgaatgagctatttattcaatgaccacgcaacactccaaatcctcccagggcaacttgaaagtaaccgcaccttccaaagggcaccgtgcaatcagactgaaaccacagtgcaaatttaattgccggggaagataacgggccttggtgccctccaagcgtcagctgagtttccaagaagccgggcagcgggcgcccgcgggttcgtctctggctcctcctccgccacagcagccgggggcccgggtcggaggcggcgggggccgagcgcccggcctcgcaagcccacggcccgctgggggtgccgtcccgcgccggggcggagcaggccccggcagcccagttcctcattctatcagcggtacaaggggctggtggcgccacaggcgctgggaccgcgggcggacaaggatgggtccgcgcggcgcggcgagcttgccccgaggccccggacctcggcggctgctcctccccgtcgtcctcccgctgctgctgctgctgttgttggcgccgccgggctcgggcgccggggccagccggccgccccacctggtcttcttgctggcagacgacctaggctggaacgacgtcggcttccacggctcccgcatccgcacgccgcacctggacgcgctggcggccggcggggtgctcctggacaactactacacgcagccgctgtgcacgccgtcgcggagccagctgctcactggccgctaccagatccgtacaggtttacagcaccaaataatctggccctgtcagcccagctgtgttcctctggatgaaaaactcctgccccagctcctaaaagaagcaggttatactacccatatggtcggaaaatggcacctgggaatgtaccggaaagaatgccttccaacccgccgaggatttgatacctactttggatatctcctgggtagtgaagattattattcccatgaacgctgtacattaattgacgctctgaatgtcacacgatgtgctcttgattttcgagatggcgaagaagttgcaacaggatataaaaatatgtattcaacaaacatattcaccaaaagggctatagccctcataactaaccatccaccagagaagcctctgtttctctaccttgctctccagtctgtgcatgagccccttcaggtccctgaggaatacttgaagccatatgactttatccaagacaagaacaggcatcactatgcaggaatggtgtcccttatggatgaagcagtaggaaatgtcactgcagctttaaaaagcagtgggctctggaacaacacggtgttcatcttttctacagataacggagggcagactttggcagggggtaataactggccccttcgaggaagaaaatggagcctgtgggaaggaggcgtccgaggggtgggctttgtggcaagccccttgctgaagcagaagggcgtgaagaaccgggagctcatccacatctctgactggctgccaacactcgtgaagctggccaggggacacaccaatggcacaaagcctctggatggcttcgacgtgtggaaaaccatcagtgaaggaagcccatcccccagaattgagctgctgcataatattgacccgaacttcgtggactcttcaccgtactggcctgagtgctcgctgctgttgtagctaccaccaactttctactgaagatgataac

SEQ ID NO: 109059 - DNA, 5159 bp, Homo sapiens
  Payload ID: 1424
  Gene Symbol: ARSD
  Gene Name: arylsulfatase D
  Uniprot ID: P51689
  ENST ID: ENST00000381154
  CDS Start-End: 77-1858
ggaagccttggcactagcggcgcccgggcgcggagtgcgcagggcaaggtcctgcgctctgggccagcgctcggccatgcgatccgccgcgcggaggggacgcgccgcgcccgccgccagggactctttgccggtgctactgtttttatgcttgcttctgaagacgtgtgaacctaaaactgcaaatgcctttaaaccaaatatcctactgatcatggcggatgatctaggcactggggatctcggttgctacgggaacaatacactgagaacgccgaatattgaccagcttgcagaggaaggtgtgaggctcactcagcacctggcggccgccccgctctgcaccccaagccgagctgcattcctcacagggagacattccttcagatcaggcatggacgccagcaatggataccgggcccttcagtggaacgcaggctcaggtggactccctgagaacgaaaccacttttgcaagaatcttgcagcagcatggctatgcaaccggcctcataggaaaatggcaccagggtgtgaattgtgcatcccgcggggatcactgccaccaccccctgaaccacggatttgactatttctacggcatgcccttcacgctcacaaacgactgtgacccaggcaggccccccgaagtggacgccgccctgagggcgcagctctggggttacacccagttcctggcgctggggattctcaccctggctgccggccagacctgcggtttcttctctgtctccgcgagagcagtcaccggcatggccggcgtgggctgcctgtttttcatctcttggtactcctccttcgggtttgtgcgacgctggaactgtatcctgatgagaaaccatgacgtcacggagcaacccatggttctggagaaaacagcgagtcttatgctaaaggaagctgtttcctatattgaaagacacaagcatgggccatttctcctcttcctttctttgctgcatgtgcacattccccttgtgaccacgagtgcattcctggggaaaagtcagcatggcttatatggtgataatgtggaggagatggactggctcataggtaaggttcttaatgccatcgaagacaatggtttaaagaactcaacattcacgtatttcacctctgaccatggaggacatttagaggcaagagatggacacagccagttagggggatggaacggaatttacaaaggtgggaagggcatgggaggatgggaaggtgggatccgcgtgcccgggatcttccactggccgggggtgctcccggccggccgagtgattggagagcccacgagcctgatggacgtgttccctactgtggtccagctggtgggtggcgaggtgccccaggacagggtgattgatggccacagcctggtacccttgctgcagggagctgaggcacgctcggcacatgagttcctgtttcattactgtgggcagcatcttcacgcagcacgctggcaccagaaggacagtggaagcgtctggaaggttcattacacgaccccgcagttccaccccgagggagcgggggcctgctacggccgaggcgtctgcccatgctccggggagggcgtgacccatcacagaccccctttgctctttgacctctccagggacccctccgaggcacggcccctgacccccgactccgagcccctgtaccacgccgtgatagcaagggtaggtgccgcggtgtcggagcatcggcagaccctgagtcctgtgccccagcagttttccatgagcaacatcctgtggaagccgtggctgcagccgtgctgcggacatttcccgttctgttcatgccacgaggatggggatggcaccccctgaatgccaggactgtgagagaggatccaggagagcctgactgcgttgcaaacaaaattctccaagcttggttctatcttcagcttccctttttgcaaggaacatgccctggactgagagtgggtccccactttctttctttctttctttcttttttgagacagagtgtcgctctgtccctcaggctggaatgcaatggcacgatctctgctcactgcaacctccgcctcccgggttcaagcgattttcctgcctcagcctcctgagtacccaggattacaggcaccaggcacctgccaccatgcctagctaatttttgtagttttagtagagacagggtttcaccatgttgcccaggctggtctcgcactcctgacctcaagtcatccacctgcctcagcctcccaaagtgctgggattacaggcacgagccactgcgcccatgtagggtttccctttcctgatttgtgaaataagactgtcccagtaggcacccactgatgcctcctcttcctcttctaaatctcagggttcgtcattgtgccaatgcccgatgttttcacccctccgtcttaaagcattgttgcaatttcatcacctagatgacataacagccttacaaaaggacagggaggagtgtctgttcctactctcacatagcggaggaaagttagagcctctcagtctctgtttatgaggactcattaatctcaaataattgatgcatttttcatacattagggtctctgtccatgtgtcttcctgatattgttatagaaatggcttcaggctgctggtaacagatgctgcggaaaaagaatgccttaaacaaagccaggcacggtgactcacacctgtaatcccagcactttgggaggctaaggtgggaggatcacttgagcctaggagttagacacctacccagcctgagcaacacagtgagacctcatctctacaaaaaacaaataattagctagatgtcgtggcgcacagctgtagtctcagctacttaggaggctgaggcgggaggattatttgagcctgggaggtcaaaactgcaatgagctaagattgcactactgcactccgggctgggagacagagtaagaccctgccttaaaaaaaaaaaaaaaaaaatgccttaaagaaaataataagagaagggtgtgttctcttccaagtaatgagccgatcaaggggaagcaacccaaggctagcaggctcttttcaattcccagctctgccactcttagcatggcagagagttggcctcattatgccagtatggctgccacagtgtcagacatcacattccaggcagtggaaaggagaaagaaccaaagggcatccctttctcttgaagcagtccctgtgaggggggattatctggaagccccaacccaatttctgcttccaaccattatccatagaaacaactggaagttgagaagtgcagtcttttaggtgggcacctggctgccctgtatgaaaccagaattaggttggtcagcaggaaaacaagaaaacacttactgtgttgactgaggtttttgacgcatcgctttattgtcaaattaaacaactctatctcattctgcactgaaacacgtactaccattgcctataattggaaaatgatcctcagaggcacagaagatgccctgatggaaagtttgccccttgggcaaagagacagccatgggaaccttcagacatagagagagaaggtggcttttctccctacattcctcaaatagctaagatttggccagtgtgttttctaagtcaattctagtgtgtttcatcctcacctcttccctctgtggctttgatgatggaagtgtagtcctaacctactgcacagctgggaccccctgcccctagatcccaatactggggatgggaggaccttgcactattcccctcagtccatctatcgaggtctttgcaggaagcatactgggaattgaaacgagagcctaaatgacatctaagaaaggcagtgttcaataccaggtattaggtgaggatgggattctaaggacatcagtgggaggcagggagccaccttcagacctcagcatggaagcttccaagatccagaggaagaggcaacagcactgagagtcataggtagaagaatcatcacagccctgctaaccaggcagctgatgcccctctcccctggctccctgtgtccaaatcctacaggggcatctgttggctgaactcaacctgaagccaaagagaagatgagtggagagaggcaacatttatagagctcaggtttctagggctggagagggatctggagggacacacaggagacacctggcataaccaaaaaatgattaaaaaaaaaaaaaaaaagaaacatctatggagcatgggacacggggagtggaggcagctaaaagccatctcatctttcaccgtattcaacaagcccattataacaagtctttcacgctcaaccattcaaacaatcccaacaatcccagcctaagaatttcctggcatttgatgaaaatggctgtgggttttgctatctttaagctccctgggaagcaggatataagcccagggctggcaggctctttctagctacctgctcttgcacatagagtttgcctcatggttgcaagaaggctgccatagctccagatggcacatagacattccaggcagcaggaaaaaggaaggagcacttaaccgaaggaggtcagggagttggttagtctccacctgaagaagagagccatgaaccagcttcagttgactaacgggctcctgtgagtgcatctttggacttttctggaggttgaaatctagatgtggtatgtgtcttaaagcagccaccaactcctcccattaccttccaagtgagcccaactacacgatggagcctcttccctgcccttggatctgggctgagcctctgacttgcgttgaccaacagaatgcagtgaaagtgatgccgatactaccctccctgccctagacttgggatacctggcagctatattcttccattcctcaggacttgcaaaaacgggtctcagcatgccttcccagagccatgaggtgtttctttgcccattcattgatctgagaagtgagtgtaaggagtttaaatcaacctctgttctgtgctagttaaggtaataaagttgctgcagtccagggggtaggtacctgtggacggctctgcgaataggacagttgcatttcttgggaatcaagtgcatccctaggctggcagtgcagcagaaatactgaataaaatgtgacaaatctccctgga

SEQ ID NO: 109060 - DNA, 580 bp, Homo sapiens
  Payload ID: 1424
  Gene Symbol: ARSD
  Gene Name: arylsulfatase D
  ENST ID: ENST00000458014
  CDS Start-End: 1-480
ccgggggtgctcccggccggccgagtgattggagagcccacgagcctgatggacgtgttccctactgtggtccagctggtgggtggcgaggtgccccaggacagggtgattgatggccacagcctggtacccttgctgcagggagctgaggcacgctcggcacatgagttcctgtttcattactgtgggcagcatcttcacgcagcacgctggcaccagaaggacagtggaagcgtctggaaggttcattacacgaccccgcagttccaccccgagggagcgggggcctgctacggccgaggcgtctgcccatgctccggggagggcgtgacccatcacagaccccctttgctctttgacctctccagggacccctccgaggcacggcccctgacccccgactccgagcccctgtaccacgccgtgatagcaagggggcatctgttggctgaactcaacctgaagccaaagagaagatgagtggagagaggcaacatttatagagctcaggtttctagggctggagagggatctggagggacacacaggagacacctggcataaccaaaaaatgattaaa

SEQ ID NO: 109061 - DNA, 567 bp, Homo sapiens
  Payload ID: 1424
  Gene Symbol: ARSD
  Gene Name: arylsulfatase D
  ENST ID: ENST00000559324
  CDS Start-End: 65-313
actagcggcgcccgggcgcggagtgcgcagggcaaggtcctgcgctctgggccagcgctcggccatgcgatccgccgcgcggaggggacgcgccgcgcccgccgccagggactctttgccggtgctactgtttttatgcttgcttctgaagacgtgtgaacctaaaactgcaaatgcctttaaaccaaatatcctactgatcatggcggatgatctaggcactggggatctcggttgctacgggaacaatacactgagagacaggttttcactatgttgccaaggcttgtctcgaactcctggcctcaagtgatccacccaccttagccccccaaagtgctgggatgacaggcgtgaaccaccgtgcccaaccaatatctggtgttgaagcggccagaacgccgaatattgaccagcttgcagaggaaggtgtgaggctcactcagcacctggcggccgccccgctctgcaccccaagccgagctgcattcctcacagggagacattccttcagatcaggcatggacgccagcaatggataccgggcccttcagtggaacgcaggct

SEQ ID NO: 109062 - DNA, 1853 bp, Homo sapiens
  Payload ID: 1425
  Gene Symbol: ARSE
  Gene Name: arylsulfatase E (chondrodysplasia punctata 1)
  Uniprot ID: P51690
  ENST ID: ENST00000381134
  CDS Start-End: 68-1837
ccttcctcttcttgatcggggattcaggaaggagcccaggagcagaggaagtagagagagagacaacatgttacatctgcaccattcttgtttgtgtttcaggagctggctgccagcgatgctcgctgtactgctaagtttggcaccatcagcttccagcgacatttccgcctcccgaccgaacatccttcttctgatggcggacgaccttggcattggggacattggctgctatggcaacaacaccatgaggactccgaatattgaccgccttgcagaggacggcgtgaagctgacccaacacatctctgccgcatctttgtgcaccccaagcagagccgccttcctcacgggcagataccctgtgcgatcagggatggtttccagcattggttaccgtgttcttcagtggaccggagcatctggaggtcttccaacaaatgagacaacttttgcaaaaatactgaaagagaaaggctatgccactggactcattggaaaatggcatctgggtctcaactgtgagtcagccagtgatcattgccaccaccctctccatcatggctttgaccatttctacggaatgcctttctccttgatgggtgattgcgcccgctgggaactctcagagaagcgtgtcaacctggaacaaaaactcaacttcctcttccaagtcctggccttggttgccctcacactggtagcagggaagctcacacacctgatacccgtctcgtggatgccggtcatctggtcagccctttcggccgtcctcctcctcgcaagctcctattttgtgggtgctctgattgtccatgccgattgctttctgatgagaaaccacaccatcacggagcagcccatgtgcttccaaagaacgacaccccttattctgcaggaggttgcgtcctttctcaaaaggaataagcatgggcctttcctcctctttgtttcctttctacacgttcacatccctcttatcactatggagaacttcctcgggaagagtctccacgggctgtatggggacaacgtagaggagatggactggatggtaggacggatccttgacactttggacgtggagggtttgagcaacagcaccctcatttattttacgtcggatcacggcggttccctagagaatcaacttggaaacacccagtatggtggctggaatggaatttataaaggtgggaagggcatgggaggatgggaaggtgggatccgcgtgcccgggatcttccgctggcccggggtgctcccggccggccgagtgattggcgagcccacgagtctgatggacgtgttccccaccgtggtccggctggcgggcggcgaggtgccccaggacagagtgattgacggccaagaccttctgcccttgctcctggggacagcccaacactcagaccacgagttcctgatgcattattgtgagaggtttctgcacgcagccaggtggcatcaacgggacagaggaacaatgtggaaagtccactttgtgacgcctgtgttccagccagagggagccggtgcctgctatggaagaaaggtctgcccgtgctttggggaaaaagtagtccaccacgatccacctttgctctttgacctctcaagagacccttctgagacccacatcctcacaccagcctcagagcccgtgttctatcaggtgatggaacgagtccagcaggcggtgtgggaacaccagcggacactcagcccagttcctctgcagctggacaggctgggcaacatctggagaccgtggctgcagccctgctgtggcccgttccccctctgctggtgccttagggaagatgacccacaataaatgtctgcagtgaaaa

SEQ ID NO: 109063 - DNA, 644 bp, Homo sapiens
  Payload ID: 1425
  Gene Symbol: ARSE
  Gene Name: arylsulfatase E (chondrodysplasia punctata 1)
  ENST ID: ENST00000438544
  CDS Start-End: 110-644
tcttcttgatcggggattcaggaaggagcccaggagcagaggtcaatttctgctgtcaatgtgattgtggacatctttatgtcttacaggaagtagagagagagacaacatgttacatctgcaccattcttgtttgtgtttcaggagctggctgccagcgatgctcgctgtactgctaagtttggcaccatcagcttccagcgacatttccgcctcccgaccgaacatccttcttctgatggcggacgaccttggcattggggacattggctgctatggcaacaacaccatgaggactccgaatattgaccgccttgcagaggacggcgtgaagctgacccaacacatctctgccgcatctttgtgcaccccaagcagagccgccttcctcacgggcagataccctgtgcgatcagggatggtttccagcattggttaccgtgttcttcagtggaccggagcatctggaggtcttccaacaaatgagacaacttttgcaaaaatactgaaagagaaaggctatgccactggactcattggaaaatggcatctgggtctcaactgtgagtcagccagtgatcattgccaccaccctctccatcatggctttgaccatttctacggaatgcctttctccttgatgg

SEQ ID NO: 109064 - DNA, 1990 bp, Homo sapiens
  Payload ID: 1425
  Gene Symbol: ARSE
  Gene Name: arylsulfatase E (chondrodysplasia punctata 1)
  ENST ID: ENST00000540563
  CDS Start-End: 156-1790
tgcttttcagagtgaatcagctacgcacatgcgtgagccagccgttcagtgccgccgagacagccagtgcgtgtctgttttggcaggaagaagacgtttcttccaaggagcagcctccccgctacatccagccagtgtcgcccttacacagctgcatgtcaggaagtagagagagagacaacatgttacatctgcaccattcttggactccgaatattgaccgccttgcagaggacggcgtgaagctgacccaacacatctctgccgcatctttgtgcaccccaagcagagccgccttcctcacgggcagataccctgtgcgatcagggatggtttccagcattggttaccgtgttcttcagtggaccggagcatctggaggtcttccaacaaatgagacaacttttgcaaaaatactgaaagagaaaggctatgccactggactcattggaaaatggcatctgggtctcaactgtgagtcagccagtgatcattgccaccaccctctccatcatggctttgaccatttctacggaatgcctttctccttgatgggtgattgcgcccgctgggaactctcagagaagcgtgtcaacctggaacaaaaactcaacttcctcttccaagtcctggccttggttgccctcacactggtagcagggaagctcacacacctgatacccgtctcgtggatgccggtcatctggtcagccctttcggccgtcctcctcctcgcaagctcctattttgtgggtgctctgattgtccatgccgattgctttctgatgagaaaccacaccatcacggagcagcccatgtgcttccaaagaacgacaccccttattctgcaggaggttgcgtcctttctcaaaaggaataagcatgggcctttcctcctctttgtttcctttctacacgttcacatccctcttatcactatggagaacttcctcgggaagagtctccacgggctgtatggggacaacgtagaggagatggactggatggtaggacggatccttgacactttggacgtggagggtttgagcaacagcaccctcatttattttacgtcggatcacggcggttccctagagaatcaacttggaaacacccagtatggtggctggaatggaatttataaaggtgggaagggcatgggaggatgggaaggtgggatccgcgtgcccgggatcttccgctggcccggggtgctcccggccggccgagtgattggcgagcccacgagtctgatggacgtgttccccaccgtggtccggctggcgggcggcgaggtgccccaggacagagtgattgacggccaagaccttctgcccttgctcctggggacagcccaacactcagaccacgagttcctgatgcattattgtgagaggtttctgcacgcagccaggtggcatcaacgggacagaggaacaatgtggaaagtccactttgtgacgcctgtgttccagccagagggagccggtgcctgctatggaagaaaggtctgcccgtgctttggggaaaaagtagtccaccacgatccacctttgctctttgacctctcaagagacccttctgagacccacatcctcacaccagcctcagagcccgtgttctatcaggtgatggaacgagtccagcaggcggtgtgggaacaccagcggacactcagcccagttcctctgcagctggacaggctgggcaacatctggagaccgtggctgcagccctgctgtggcccgttccccctctgctggtgccttagggaagatgacccacaataaatgtctgcagtgaaaagctggagccccgattcctaaattttgtcactcaaattgaaacaaaccagctggccatggtggttgtcatcccagcactttaggaggccaccacaggaggatcactcccgtgatcaaaaccaacctgggcaacatgatgaaactctagctctacaaaacaaaaataaaaaaaaaattagcctgca

SEQ ID NO: 109065 - DNA, 2506 bp, Homo sapiens
  Payload ID: 1425
  Gene Symbol: ARSE
  Gene Name: arylsulfatase E (chondrodysplasia punctata 1)
  ENST ID: ENST00000545496
  CDS Start-End: 462-2306
ttggtagacgtgggcgtggctttgagattcccccatgctgcgatgtggggggagtctgctctgtctgtcctaactctctctgatcttctgacttgggaaaaacaaactcgaagttaatcattcccagctcaaagccttgtgcaagtgctctctgccttcacgcttgcttcctttgggagagaaccttcctcttcttgatcggggattcaggaaggagcccaggagcagaggaagtagagagagagacaacatgttacatctgcaccattcttgagacagggtctcaccatgttgctcaagctggtcttaaacacctgggctcaggcaatgctcccaccttggcctcccaacgtgctcagataatgggcatgagccaccacgcctgaccgcttctggatctcttgatggtgctttctcagaatgcactgatagtgatttatcctgcatctggagaatgaagcatgagacccgtgattaatagatgtgctccaggctcccttgatttgatgttgccccaggcagcctcagaaggaattgtatttcattctctgcaaatcagtttgtgtttcaggagctggctgccagcgatgctcgctgtactgctaagtttggcaccatcagcttccagcgacatttccgcctcccgaccgaacatccttcttctgatggcggacgaccttggcattggggacattggctgctatggcaacaacaccatgaggactccgaatattgaccgccttgcagaggacggcgtgaagctgacccaacacatctctgccgcatctttgtgcaccccaagcagagccgccttcctcacgggcagataccctgtgcgatcagggatggtttccagcattggttaccgtgttcttcagtggaccggagcatctggaggtcttccaacaaatgagacaacttttgcaaaaatactgaaagagaaaggctatgccactggactcattggaaaatggcatctgggtctcaactgtgagtcagccagtgatcattgccaccaccctctccatcatggctttgaccatttctacggaatgcctttctccttgatgggtgattgcgcccgctgggaactctcagagaagcgtgtcaacctggaacaaaaactcaacttcctcttccaagtcctggccttggttgccctcacactggtagcagggaagctcacacacctgatacccgtctcgtggatgccggtcatctggtcagccctttcggccgtcctcctcctcgcaagctcctattttgtgggtgctctgattgtccatgccgattgctttctgatgagaaaccacaccatcacggagcagcccatgtgcttccaaagaacgacaccccttattctgcaggaggttgcgtcctttctcaaaaggaataagcatgggcctttcctcctctttgtttcctttctacacgttcacatccctcttatcactatggagaacttcctcgggaagagtctccacgggctgtatggggacaacgtagaggagatggactggatggtaggacggatccttgacactttggacgtggagggtttgagcaacagcaccctcatttattttacgtcggatcacggcggttccctagagaatcaacttggaaacacccagtatggtggctggaatggaatttataaaggtgggaagggcatgggaggatgggaaggtgggatccgcgtgcccgggatcttccgctggcccggggtgctcccggccggccgagtgattggcgagcccacgagtctgatggacgtgttccccaccgtggtccggctggcgggcggcgaggtgccccaggacagagtgattgacggccaagaccttctgcccttgctcctggggacagcccaacactcagaccacgagttcctgatgcattattgtgagaggtttctgcacgcagccaggtggcatcaacgggacagaggaacaatgtggaaagtccactttgtgacgcctgtgttccagccagagggagccggtgcctgctatggaagaaaggtctgcccgtgctttggggaaaaagtagtccaccacgatccacctttgctctttgacctctcaagagacccttctgagacccacatcctcacaccagcctcagagcccgtgttctatcaggtgatggaacgagtccagcaggcggtgtgggaacaccagcggacactcagcccagttcctctgcagctggacaggctgggcaacatctggagaccgtggctgcagccctgctgtggcccgttccccctctgctggtgccttagggaagatgacccacaataaatgtctgcagtgaaaagctggagccccgattcctaaattttgtcactcaaattgaaacaaaccagctggccatggtggttgtcatcccagcactttaggaggccaccacaggaggatcactcccgtgatcaaaaccaacctgggcaacatgatgaaactctagctctacaaaacaaaaataaaaaaaaaattagcctgca

SEQ ID NO: 109066 - DNA, 1991 bp, Homo sapiens
  Payload ID: 1426
  Gene Symbol: ARSF
  Gene Name: arylsulfatase F
  Uniprot ID: P54793
  ENST ID: ENST00000359361
  CDS Start-End: 69-1841
gttctgctcctagacattagagagataatacggctgatagacaacaagaaggtattccaagctgcacaatgaggcccaggagacccttggtcttcatgtctttggtgtgtgcactcttgaacacatgccaggcacacagggtgcatgacgacaagcctaatattgtcctaatcatggttgatgacctgggtattggagatctgggctgctacggcaatgacaccatgaggacgcctcacatcgaccgccttgccagggaaggcgtgcgactgactcagcacatctctgccgcctccctctgcagcccaagccggtccgcgttcttgacgggaagataccccatccgatcaggtatggtttctagtggtaatagacgtgtcatccaaaatcttgcagtccccgcaggcctccctcttaatgagacaacacttgcagccttgctaaagaagcaaggatacagcacggggcttataggcaaatggcaccaaggcttgaactgcgactcccgaagtgaccagtgccaccatccatataattatgggtttgactactactatggcatgccgttcactctcgttgacagctgctggccggacccctctcgtaacacggaattagcctttgagagtcagctctggctctgtgtgcagctagttgccattgccatcctcaccctaacctttgggaagctgagcggctgggtctctgttccctggctcctgatcttctccatgattctgtttattttcctcttgggctatgcttggttctccagccacacgtcccctttatactgggactgcctcctcatgcgggggcacgagatcacggagcagcccatgaaggctgaacgagctggatccattatggtgaaggaagcgatttcctttttagaaaggcacagtaaggaaactttccttctctttttctcctttcttcacgtgcacacacctctccccaccacggacgatttcactggcaccagcaagcatggcttgtatggggataatgtggaagagatggactccatggtgggcaagattcttgatgctatcgatgattttggcctaaggaacaacacccttgtctactttacatcagatcacggagggcatttggaagctaggcgagggcatgcccaacttggtggatggaatggaatatacaaaggtggaaaaggcatggggggctgggaaggtggaatccgcgtcccaggaattgtccgatggcctggaaaggtaccagctggacggttgattaaggaacctacaagtttaatggatattttaccaactgtcgcatcagtgtcaggaggaagtctccctcaggacagggtcattgacggccgagacctcatgcccttgctgcagggcaacgtcaggcactcggagcatgaatttcttttccactactgtggctcctacctgcacgccgtgcggtggatccccaaggacgacagtgggtcagtttggaaggctcactatgtgaccccggtattccagccaccagcttctggtggctgctatgtcacctcattatgcagatgtttcggagaacaggttacctaccacaacccccctctgctcttcgatctctccagggacccctcagagtccacacccctgacacctgccacagagcccctccatgattttgtgattaaaaaggtggccaacgccctgaaggaacaccaggaaaccatcgtgcctgtgacctaccaactctcagaactgaatcagggcaggacgtggctgaagccttgctgtggggtgttcccattttgtctgtgtgacaaggaagaggaagtctctcagcctcggggtcctaacgagaagagataattacaatcaggctaccagaggaagcctttggtcctaacgagaagagataattacaatcaggctaccaaaggaagcactaactttggtgctttcaagttggcaaggagtgcatttaatagtcaataaattcatctaccattccagattatt

SEQ ID NO: 109067 - DNA, 2164 bp, Homo sapiens
  Payload ID: 1426
  Gene Symbol: ARSF
  Gene Name: arylsulfatase F
  Uniprot ID: P54793
  ENST ID: ENST00000381127
  CDS Start-End: 222-1994
agtggagacaggctctcaccatgttgaccaggctggtctcgaactcccgacctcaagtgatccgccggcctcggcctcccaaagtgctgggattacaggcgtgaaccaccactcctggcccttctgttacttttccactgctgttgagatagaagtcactgttgggatccaacctttttgtttgtataaactgacaacaagaaggtattccaagctgcacaatgaggcccaggagacccttggtcttcatgtctttggtgtgtgcactcttgaacacatgccaggcacacagggtgcatgacgacaagcctaatattgtcctaatcatggttgatgacctgggtattggagatctgggctgctacggcaatgacaccatgaggacgcctcacatcgaccgccttgccagggaaggcgtgcgactgactcagcacatctctgccgcctccctctgcagcccaagccggtccgcgttcttgacgggaagataccccatccgatcaggtatggtttctagtggtaatagacgtgtcatccaaaatcttgcagtccccgcaggcctccctcttaatgagacaacacttgcagccttgctaaagaagcaaggatacagcacggggcttataggcaaatggcaccaaggcttgaactgcgactcccgaagtgaccagtgccaccatccatataattatgggtttgactactactatggcatgccgttcactctcgttgacagctgctggccggacccctctcgtaacacggaattagcctttgagagtcagctctggctctgtgtgcagctagttgccattgccatcctcaccctaacctttgggaagctgagcggctgggtctctgttccctggctcctgatcttctccatgattctgtttattttcctcttgggctatgcttggttctccagccacacgtcccctttatactgggactgcctcctcatgcgggggcacgagatcacggagcagcccatgaaggctgaacgagctggatccattatggtgaaggaagcgatttcctttttagaaaggcacagtaaggaaactttccttctctttttctcctttcttcacgtgcacacacctctccccaccacggacgatttcactggcaccagcaagcatggcttgtatggggataatgtggaagagatggactccatggtgggcaagattcttgatgctatcgatgattttggcctaaggaacaacacccttgtctactttacatcagatcacggagggcatttggaagctaggcgagggcatgcccaacttggtggatggaatggaatatacaaaggtggaaaaggcatggggggctgggaaggtggaatccgcgtcccaggaattgtccgatggcctggaaaggtaccagctggacggttgattaaggaacctacaagtttaatggatattttaccaactgtcgcatcagtgtcaggaggaagtctccctcaggacagggtcattgacggccgagacctcatgcccttgctgcagggcaacgtcaggcactcggagcatgaatttcttttccactactgtggctcctacctgcacgccgtgcggtggatccccaaggacgacagtgggtcagtttggaaggctcactatgtgaccccggtattccagccaccagcttctggtggctgctatgtcacctcattatgcagatgtttcggagaacaggttacctaccacaacccccctctgctcttcgatctctccagggacccctcagagtccacacccctgacacctgccacagagcccctccatgattttgtgattaaaaaggtggccaacgccctgaaggaacaccaggaaaccatcgtgcctgtgacctaccaactctcagaactgaatcagggcaggacgtggctgaagccttgctgtggggtgttcccattttgtctgtgtgacaaggaagaggaagtctctcagcctcggggtcctaacgagaagagataattacaatcaggctaccagaggaagcctttggtcctaacgagaagagataattacaatcaggctaccaaaggaagcactaactttggtgctttcaagttggcaaggagtgcatttaatagtcaataaattcatctaccattccagattattaaaggcccactggttgttcc

SEQ ID NO: 109068 - DNA, 1875 bp, Homo sapiens
  Payload ID: 1427
  Gene Symbol: ARSH
  Gene Name: arylsulfatase family, member H
  Uniprot ID: Q5FYA8
  ENST ID: ENST00000381130
  CDS Start-End: 1-1689
atgacaagaaacgccagacccaacattgtcctgctgatggcagatgaccttggagtgggggatttgtgctgctacggtaataactcagtgagcacacctaatattgaccgcctggcaagtgaaggagtgaggcttacccagcatctcgcagctgcttccatgtgcaccccaagtcgggctgccttcctgaccggccggtaccccatcagatcagggatggtgtctgcctacaacctgaaccgtgccttcacgtggcttggtgggtcaggtggtcttcccaccaatgaaacgacttttgccaagctgctgcagcaccgtggctaccgcacgggactcataggcaaatggcacctgggtttgagctgcgcctctcggaatgatcactgttaccacccgctcaaccatggttttcactacttttacggggtgccttttggacttttaagcgactgccaggcatccaagacaccagaactgcaccgctggctcaggatcaaactgtggatctccacggtagcccttgccctggttccttttctgcttctcattcccaagttcgcccgctggttctcagtgccatggaaggtcatctttgtctttgctctcctcgcctttctgtttttcacttcctggtactctagttatggatttactcgacgttggaattgcatccttatgaggaaccatgaaattatccagcagccaatgaaagaggagaaagtagcttccctcatgctgaaggaggcacttgctttcattgaaaggtacaaaagggaaccttttctcctctttttttccttcctgcacgtacatactccactcatctccaaaaagaagtttgttgggcgcagtaaatatggcaggtatggggacaatgtagaagaaatggattggatggtgggtaaaatcctggatgccctggaccaggagcgcctggccaaccacaccttggtgtacttcacctctgacaacgggggccacctggagcccctggacggggctgttcagctgggtggctggaacgggatctacaaaggtggcaaaggaatgggaggatgggaaggaggtatccgtgtgccagggatattccggtggccgtcagtcttggaggctgggagagtgatcaatgagcccaccagcttaatggacatctatccgacgctgtcttatataggcggagggatcttgtcccaggacagagtgattgacggccagaacctaatgcccctgctggaaggaagggcgtcccactccgaccacgagttcctcttccactactgtggggtctatctgcacacggtcaggtggcatcagaaggactgtgcaactgtgtggaaagctcattatgtgactcctaaattctaccctgaaggaacaggtgcctgctatgggagtggaatatgttcatgttcgggggatgtaacctaccacgacccaccactcctctttgacatctcaagagacccttcagaagcccttccactgaaccctgacaatgagccattatttgactccgtgatcaaaaagatggaggcagccataagagagcatcgtaggacactaacacctgtcccacagcagttctctgtgttcaacacaatttggaaaccatggctgcagccttgctgtgggaccttccccttctgtgggtgtgacaaggaagatgacatccttcccatggctccctgagaccatgcggaccacgtgttacccaccacaaacttactgttacaatggtcataggagcagagctcacctgactgattcattccatttgggataaaaactgatggcccaacccattgttttatcctcagaaatcagttctttcaagagctcggtgaaattaaagtgggcccatataacagtgaacct

SEQ ID NO: 109069 - DNA, 3161 bp, Homo sapiens
  Payload ID: 1428
  Gene Symbol: ARSI
  Gene Name: arylsulfatase family, member I
  Uniprot ID: Q5FYB1
  ENST ID: ENST00000328668
  CDS Start-End: 581-2290
ccctccacctggggctcggcccggcccggcagatgttacaactttttcgaattctctcccgccgtgtcccctcgacccgcccaacttgtgcctccctccccttcccctctggggtcctgcccacctccctgcagggagctgggctgttttaaggactccgggtggggcgagaggccgggaaagcagaggagagagaaattaggaggcgggagaaatccagggcaagaaggaagaggggagtcagaggatggtagagagcactttttggaagctgccacgccgcgtctcaggctggccgggctgagctggggaagagggagcaaaggcggcgcagggcctgcgcttaggcagcgggaggcagctcggcgcgggcctgacctccccagagcgccccgctgcggccgagcagatccggcccagccgtccggcagccagtcccggaccagacactggaccgtccccggggggcgctgaactccctcgcagcatccgagccggcgggccggtggtgcgccctgggcgcgcgaggtggtgaggccccaggagcccggcgcgccgggacgcgcgggccggcttggcgatgcacaccctcactggcttctccctggtcagcctgctcagcttcggctacctgtcctgggactgggccaagccgagcttcgtggccgacgggcccggggaggctggcgagcagccctcggccgctccgccccagcctccccacatcatcttcatcctcacggacgaccaaggctaccacgacgtgggctaccatggttcagatatcgagacccctacgctggacaggctggcggccaagggggtcaagttggagaattattacatccagcccatctgcacgccttcgcggagccagctcctcactggcaggtaccagatccacacaggactccagcattccatcatccgcccacagcagcccaactgcctgcccctggaccaggtgacactgccacagaagctgcaggaggcaggttattccacccatatggtgggcaagtggcacctgggcttctaccggaaggagtgtctgcccacccgtcggggcttcgacaccttcctgggctcgctcacgggcaatgtggactattacacctatgacaactgtgatggcccaggcgtgtgcggcttcgacctgcacgagggtgagaatgtggcctgggggctcagcggccagtactccactatgctttatgcccagcgcgccagccatatcctggccagccacagccctcagcgtcccctcttcctctatgtggccttccaggcagtacacacacccctgcagtcccctcgtgagtacctgtaccgctaccgcaccatgggcaatgtggcccggcggaagtacgcggccatggtgacctgcatggatgaggctgtgcgcaacatcacctgggccctcaagcgctacggtttctacaacaacagtgtcatcatcttctccagtgacaatggtggccagactttctcggggggcagcaactggccgctccgaggacgcaagggcacttattgggaaggtggcgtgcggggcctaggctttgtccacagtcccctgctcaagcgaaagcaacggacaagccgggcactgatgcacatcactgactggtacccgaccctggtgggtctggcaggtggtaccacctcagcagccgatgggctagatggctacgacgtgtggccggccatcagcgagggccgggcctcaccacgcacggagatcctgcacaacattgacccactctacaaccatgcccagcatggctccctggagggcggctttggcatctggaacaccgccgtgcaggctgccatccgcgtgggtgagtggaagctgctgacaggagaccccggctatggcgattggatcccaccgcagacactggccaccttcccgggtagctggtggaacctggaacgaatggccagtgtccgccaggccgtgtggctcttcaacatcagtgctgacccttatgaacgggaggacctggctggccagcggcctgatgtggtccgcaccctgctggctcgcctggccgaatataaccgcacagccatcccggtacgctacccagctgagaacccccgggctcatcctgactttaatgggggtgcttgggggccctgggccagtgatgaggaagaggaggaagaggaagggagggctcgaagcttctcccggggtcgtcgcaagaaaaaatgcaagatttgcaagcttcgatcctttttccgtaaactcaacaccaggctaatgtcccaacggatctgatggtggggagggagaaaactgtcctttagaggatcttccccactccggcttggccctgctgtttctcagggagaagcctgtcacatctccatctacagggagttggagggtgtagagtcccttggttgaacagggtagggagcctggataggagtgggtgggaataaaccagactgggatgcctgtgtctcagtcctgcctcctcacggacttgctctgtgacctcaggtgacccacatgagcttttagcctcagtttcctcatctgtaaaatgagctctaatgactttgtgactctttggtgtggccctggagcctggggccacggtggagttcctggccggccttgccacttgacaactcctttaaggcttcccccttaacacgggatccctgtggtggtgtttgggagttgcctggaggcaactccaagcctggcccccagctgaagcatggcaatctggctgctctctacagggacccccaagcgctgtgggtggagggcaggggtcgggggggttgaccttcttgggtcttcacatggcctaggccagtcctccggtcagactggtgtcaggcaccgtggtgcaaaattcctcttctggcccctccagtacccagagaaactggctgggccattaactgctgcagcaccaagggtggtagaaagagctgtgaagagcccccaaaccagtaccaggacacctgggttctcctgtgacctggggcacagttcttgccctctaggccttgatttccccacctgcaagtggggatgccagccctggctctgcctccttcatgaggctctggaagactggccaaggttgtggaggagcttgtgaacttgattaaagtgtcgtaacatggaa

SEQ ID NO: 109070 - DNA, 472 bp, Homo sapiens
  Payload ID: 1428
  Gene Symbol: ARSI
  Gene Name: arylsulfatase family, member I
  ENST ID: ENST00000509146
  CDS Start-End: 213-472
atgcagttctggaaaggtgaatcggttccttctgcctgtctgggttttgcaaccccgtggtgggacaattggccaggtgcatattcctcagaaggtaccagatccacacaggactccagcattccatcatccgcccacagcagcccaactgcctgcccctggaccaggtgacactgccacagaagctgcaggaggcaggttattccacccatatggtgggcaagtggcacctgggcttctaccggaaggagtgtctgcccacccgtcggggcttcgacaccttcctgggctcgctcacgggcaatgtggactattacacctatgacaactgtgatggcccaggcgtgtgcggcttcgacctgcacgagggtgagaatgtggcctgggggctcagcggccagtactccactatgctttatgcccagcgcgccagccatatcctggccagccacagccctcagcgtcccctctt

SEQ ID NO: 109071 - DNA, 1429 bp, Homo sapiens
  Payload ID: 1428
  Gene Symbol: ARSI
  Gene Name: arylsulfatase family, member I
  Uniprot ID: Q5FYB1
  ENST ID: ENST00000515301
  CDS Start-End: 149-1429
gggagggcctcctcatgcagttctggaaaggtaccagatccacacaggactccagcattccatcatccgcccacagcagcccaactgcctgcccctggaccaggtgacactgccacagaagctgcaggaggcaggttattccacccatatggtgggcaagtggcacctgggcttctaccggaaggagtgtctgcccacccgtcggggcttcgacaccttcctgggctcgctcacgggcaatgtggactattacacctatgacaactgtgatggcccaggcgtgtgcggcttcgacctgcacgagggtgagaatgtggcctgggggctcagcggccagtactccactatgctttatgcccagcgcgccagccatatcctggccagccacagccctcagcgtcccctcttcctctatgtggccttccaggcagtacacacacccctgcagtcccctcgtgagtacctgtaccgctaccgcaccatgggcaatgtggcccggcggaagtacgcggccatggtgacctgcatggatgaggctgtgcgcaacatcacctgggccctcaagcgctacggtttctacaacaacagtgtcatcatcttctccagtgacaatggtggccagactttctcggggggcagcaactggccgctccgaggacgcaagggcacttattgggaaggtggcgtgcggggcctaggctttgtccacagtcccctgctcaagcgaaagcaacggacaagccgggcactgatgcacatcactgactggtacccgaccctggtgggtctggcaggtggtaccacctcagcagccgatgggctagatggctacgacgtgtggccggccatcagcgagggccgggcctcaccacgcacggagatcctgcacaacattgacccactctacaaccatgcccagcatggctccctggagggcggctttggcatctggaacaccgccgtgcaggctgccatccgcgtgggtgagtggaagctgctgacaggagaccccggctatggcgattggatcccaccgcagacactggccaccttcccgggtagctggtggaacctggaacgaatggccagtgtccgccaggccgtgtggctcttcaacatcagtgctgacccttatgaacgggaggacctggctggccagcggcctgatgtggtccgcaccctgctggctcgcctggccgaatataaccgcacagccatcccggtacgctacccagctgagaacccccgggctcatcctgactttaatgggggtgcttgggggccctgggccagtgatgaggaagaggaggaagaggaagggagggctcgaagcttctcccggggtcgtcgcaagaaaaaatgcaagatttgcaagcttcgatcctttttccgtaaactcaacaccaggctaatgtcccaacggatctga

SEQ ID NO: 109072 - DNA, 4657 bp, Homo sapiens
  Payload ID: 1429
  Gene Symbol: ARSJ
  Gene Name: arylsulfatase family, member J
  Uniprot ID: Q5FYB0
  ENST ID: ENST00000315366
  CDS Start-End: 868-2667
ggcaaaagaactcggagtgccaaagctaaataagttagctgagaaaacgcacgcagtttgcagcgcctgcgccgggtgcgccaactacgcaaagaccaagcgggctccgcgcggaccggccgcggggctagggacccggctttggccttcaggctccctagcagcggggaaaaggaattgctgcccggagtttctgcggaggtggagggagatcaggaaacggcttcttcctcacttcgccgcctggtgagtgtcggggagattggcaaacgcctaggaaaggactggggaaaatagccctgggaaagtggagaaggtgatcaggaggccggtccactacggcagtttatctgtctgatcagagccagacgcgacgcgtccacttcgcagttctttccaggtgtggggaccgcaggacagacggccgatcccgccgccctccgtaccagcactcccaggagagtcagcctcgctccccaacgtcgagggcgctctggccacgaaaagttcctgtccactgtgattctcaattccttgcttggtttttttctccagagaacttttgggtggagatattaacttttttcttttttttttccttggtggaagctgctctagggaggggggaggaggaggagaaagtgaaatgtgctggagaagagcgagccctccttgttcttccggagtcccatccattaagccatcacttctggaagattaaagttgtcggacatggtgacagctgagaggagaggaggatttcttgccaggtggagagtcttcaccgtctgttgggtgcatgtgtgcgcccgcagcggcgcggggcgcgtggttctccgcgtggagtctcacctgggacctgagtgaatggctcccaggggctgtgcggggcatccgcctccgccttctccacaggcctgtgtctgtcctggaaagatgctagcaatgggggcgctggcaggattctggatcctctgcctcctcacttatggttacctgtcctggggccaggccttagaagaggaggaagaaggggccttactagctcaagctggagagaaactagagcccagcacaacttccacctcccagccccatctcattttcatcctagcggatgatcagggatttagagatgtgggttaccacggatctgagattaaaacacctactcttgacaagctcgctgccgaaggagttaaactggagaactactatgtccagcctatttgcacaccatccaggagtcagtttattactggaaagtatcagatacacaccggacttcaacattctatcataagacctacccaacccaactgtttacctctggacaatgccaccctacctcagaaactgaaggaggttggatattcaacgcatatggtcggaaaatggcacttgggtttttacagaaaagaatgcatgcccaccagaagaggatttgataccttttttggttcccttttgggaagtggggattactatacacactacaaatgtgacagtcctgggatgtgtggctatgacttgtatgaaaacgacaatgctgcctgggactatgacaatggcatatactccacacagatgtacactcagagagtacagcaaatcttagcttcccataaccccacaaagcctatatttttatatattgcctatcaagctgttcattcaccactgcaagctcctggcaggtatttcgaacactaccgatccattatcaacataaacaggaggagatatgctgccatgctttcctgcttagatgaagcaatcaacaacgtgacattggctctaaagacttatggtttctataacaacagcattatcatttactcttcagataatggtggccagcctacggcaggagggagtaactggcctctcagaggtagcaaaggaacatattgggaaggagggatccgggctgtaggctttgtgcatagcccacttctgaaaaacaagggaacagtgtgtaaggaacttgtgcacatcactgactggtaccccactctcatttcactggctgaaggacagattgatgaggacattcaactagatggctatgatatctgggagaccataagtgagggtcttcgctcaccccgagtagatattttgcataacattgaccccatatacaccaaggcaaaaaatggctcctgggcagcaggctatgggatctggaacactgcaatccagtcagccatcagagtgcagcactggaaattgcttacaggaaatcctggctacagcgactgggtcccccctcagtctttcagcaacctgggaccgaaccggtggcacaatgaacggatcaccttgtcaactggcaaaagtgtatggcttttcaacatcacagccgacccatatgagagggtggacctatctaacaggtatccaggaatcgtgaagaagctcctacggaggctctcacagttcaacaaaactgcagtgccggtcaggtatccccccaaagaccccagaagtaaccctaggctcaatggaggggtctggggaccatggtataaagaggaaaccaagaaaaagaagccaagcaaaaatcaggctgagaaaaagcaaaagaaaagcaaaaaaaagaagaagaaacagcagaaagcagtctcaggttcaacttgccattcaggtgttacttgtggataagcacaaatatttcctgtttggttaaactttaatcagttcttatctttcatctgtttcctaggtaaaccagcaaatttggctcgataatatcgctggcctaagcgtcaggcttgttttcatgctgtgccactccagagacttctgccacctggccgccacactgaaaactgtcctgctcagtgccaaggtgctactcttgcaagccacacttagagagagtggagatgtttatttctcttgctcctttagaaaacgtggtgagtcctgagttccactgctgtgcttcagtcaactgaccaaacactgctttgaattataggaggagaacaataacctaccatccgcaagcatgctaatttgatggaagttacagggtataccatccgcaagcatgctaatttgatggaagttacagggtagcatgattaaaactacctttgataaattacagtcaaagattgtgtcacctcaaaggccttgaagaatatattttcttggtgaatttttgtatgtctgtcatatgacacttgggttttttaattaattctattttatatatatatatatgtttcttttcctgtgaaaagctgtttttctcacatgtgaacagcttgcacctcattttaccatgcgtgagggaatggcaaataagaatgtttgagcacactgcccacaatgaatgtaactattttctaaacactttactagaagaacatttcagtataaaaaacctaatttatttttacagaaaaatattttgttgtttttataaaaagttatgcaaatgactttattttatttttatttcctgcataccattagaataattttatttcatttcttcaaattaccaagcactgtaatactataaattaatgtaatactgtgtgaattcagactataaaaaacatcattcagaaaactttataatcgtcattgttcaaccaagattttgaatgtaataagatgaatatattccttacaaattacttggaaattcaatgtttgtgcagagttgagacaactttattgtttctatcataaactatttatgtatcttaattattaaaatgatttactttatggcactagaaaatttactgtggcttttctgatctaacttctagctaaaattgtatcattggtcctaaaaaataaaaatctttactaataggcaattgaaggaatggtttgctaacaaccacagtaatataatatgattttacagatagatgcttccccttggctatgacatggagaaagattttcccataataataactaacatttatattaggttggtgcaaaactagttgcggtttttcccattaaaagtaataaacttactcttatacaaagtggacactgtggggagatacagagaaatggaagatacggatcctgcctggagtaggtaaccttgcttggaaaccccacatgcaaacgtcatgaggagaattaaaggagtattatcagtaatgaagtttatcatgggtcatcaatgagcatagattggtgtggatcctgtagaccctggtgttttctttgaagtgccctctcctaatgcagaggccttgaagcttacagtatacacttgaaaagtcacagatagctagaattatgatctttgaagttataactgtgatctgaaaatgtgtgtggtggtatgacagcataccattaaatacatttacatcacagctcaaaggactgtgatataatccatttatatcacaactcaaaggactgtgatataatccatttatatcacagctcacagtttctgaaaatgtataaaagaatctataatctagtactgaaattactaaattgggtaagatgatttaaatgattttaattttaacattttatttctagaatatatggctccattttattttatagtgtaaagttgtatttcctaaagtttgtgttttgtcgacagtatcttttaaatgagtcttaaaaataaaggcatattgttcatgtt

SEQ ID NO: 109073 - DNA, 2253 bp, Homo sapiens
  Payload ID: 1429
  Gene Symbol: ARSJ
  Gene Name: arylsulfatase family, member J
  ENST ID: ENST00000509829
  CDS Start-End: 451-852
agtttgcagcgcctgcgccgggtgcgccaactacgcaaagaccaagcgggctccgcgcggaccggccgcggggctagggacccggctttggccttcaggctccctagcagcggggaaaaggaattgctgcccggagtttctgcggaggtggagggagatcaggaaacggcttcttcctcacttcgccgcctgctgctctagggaggggggaggaggaggagaaagtgaaatgtgctggagaagagcgagccctccttgttcttccggagtcccatccattaagccatcacttctggaagattaaagttgtcggacatggtgacagctgagaggagaggaggatttcttgccaggtggagagtcttcaccgtctgttgggtgcatgtgtgcgcccgcagcggcgcggggcgcgtggttctccgcgtggagtctcacctgggacctgagtgaatggctcccaggggctgtgcggggcatccgcctccgccttctccacaggcctgtgtctgtcctggaaagatgctagcaatgggggcgctggcaggattctggatcctctgcctcctcacttatggttacctgtcctggggccaggccttagaagaggaggaagaaggggccttactagctcaagctggagagaaactagagcccagcacaacttccacctcccagccccatctcattttcatcctagcggatgatcagggatttagagatgtgggttaccacggatctgagattaaaacacctactcttgacaagctcgctgccgaaggagttaaactggagaactactatgtccagcctatttgcacaccatccaggagtcagtttattactggaaaatgaggaaactgaggatcagagggattaagtacttcccaaaaccatacaggtaataagcagtggagcaaattcaaacccaggtatcagatacacaccggacttcaacattctatcataagacctacccaacccaactgtttacctctggacaatgccaccctacctcagaaactgaaggaggttggatattcaacgcatatggtcggaaaatggcacttgggtttttacagaaaagaatgcatgcccaccagaagaggatttgataccttttttggttcccttttgggaagtggggattactatacacactacaaatgtgacagtcctgggatgtgtggctatgacttgtatgaaaacgacaatgctgcctgggactatgacaatggcatatactccacacagatgtacactcagagagtacagcaaatcttagcttcccataaccccacaaagcctatatttttatatattgcctatcaagctgttcattcaccactgcaagctcctggcaggtatttcgaacactaccgatccattatcaacataaacaggaggagatatgctgccatgctttcctgcttagatgaagcaatcaacaacgtgacattggctctaaagacttatggtttctataacaacagcattatcatttactcttcagataatggtggccagcctacggcaggagggagtaactggcctctcagaggtagcaaaggaacatattgggaaggagggatccgggctgtaggctttgtgcatagcccacttctgaaaaacaagggaacagtgtgtaaggaacttgtgcacatcactgactggtaccccactctcatttcactggctgaaggacagattgatgaggacattcaactagatggctatgatatctgggagaccataagtgagggtcttcgctcaccccgagtagatattttgcataacattgaccccatatacaccaaggcaaaaaatggctcctgggcagcaggctatgggatctggaacactgcaatccagtcagccatcagagtgcagcactggaaattgcttacaggaaatcctggctacagcgactgggtcccccctcagtctttcagcaacctgggaccgaaccggtggcacaatgaacggatcaccttgtcaactggcaaaagtgtatggcttttcaacatcacagccgacccatatgagagggtggacctatctaacaggtatccaggaatcgtgaagaagctcctacggaggctctcacagttcaacaaaactgcagtgccggtcaggtatccccccaaagaccccagaagtaaccctaggctcaatggaggggtctggggaccatggtataaagaggaaaccaagaaaaagaagccaagcaaaaatcaggctgagaaaaagcaaaag

SEQ ID NO: 109074 - DNA, 3354 bp, Homo sapiens
  Payload ID: 1430
  Gene Symbol: ARSK
  Gene Name: arylsulfatase family, member K
  Uniprot ID: Q6UWY0
  ENST ID: ENST00000380009
  CDS Start-End: 206-1816
aaaagcgggaatttctctgttgcgcatgtgcgcgctctccgcctgataggagttgtagttctgcgggtgaagctcggcgttactatcaagcaaccaaactgcaagctttgggagttgttcgctgtccctgccctgctctgctagggagagaacgccagagggaggcggctggcccggcggcaggctctcagaaccgctaccggcgatgctactgctgtgggtgtcggtggtcgcagccttggcgctggcggtactggcccccggagcaggggagcagaggcggagagcagccaaagcgcccaatgtggtgctggtcgtgagcgactccttcgatggaaggttaacatttcatccaggaagtcaggtagtgaaacttccttttatcaactttatgaagacacgtgggacttcctttctgaatgcctacacaaactctccaatttgttgcccatcacgcgcagcaatgtggagtggcctcttcactcacttaacagaatcttggaataattttaagggtctagatccaaattatacaacatggatggatgtcatggagaggcatggctaccgaacacagaaatttgggaaactggactatacttcaggacatcactccattagtaatcgtgtggaagcgtggacaagagatgttgctttcttactcagacaagaaggcaggcccatggttaatcttatccgtaacaggactaaagtcagagtgatggaaagggattggcagaatacagacaaagcagtaaactggttaagaaaggaagcaattaattacactgaaccatttgttatttacttgggattaaatttaccacacccttacccttcaccatcttctggagaaaattttggatcttcaacatttcacacatctctttattggcttgaaaaagtgtctcatgatgccatcaaaatcccaaagtggtcacctttgtcagaaatgcaccctgtagattattactcttcttatacaaaaaactgcactggaagatttacaaaaaaagaaattaagaatattagagcattttattatgctatgtgtgctgagacagatgccatgcttggtgaaattattttggcccttcatcaattagatcttcttcagaaaactattgtcatatactcctcagaccatggagagctggccatggaacatcgacagttttataaaatgagcatgtacgaggctagtgcacatgttccgcttttgatgatgggaccaggaattaaagccggcctacaagtatcaaatgtggtttctcttgtggatatttaccctaccatgcttgatattgctggaattcctctgcctcagaacctgagtggatactctttgttgccgttatcatcagaaacatttaagaatgaacataaagtcaaaaacctgcatccaccctggattctgagtgaattccatggatgtaatgtgaatgcctccacctacatgcttcgaactaaccactggaaatatatagcctattcggatggtgcatcaatattgcctcaactctttgatctttcctcggatccagatgaattaacaaatgttgctgtaaaatttccagaaattacttattctttggatcagaagcttcattccattataaactaccctaaagtttctgcttctgtccaccagtataataaagagcagtttatcaagtggaaacaaagtataggacagaattattcaaacgttatagcaaatcttaggtggcaccaagactggcagaaggaaccaaggaagtatgaaaatgcaattgatcagtggcttaaaacccatatgaatccaagagcagtttgaacaaaaagtttaaaaatagtgttctagagatacatataaatatattacaagatcataattatgtattttaaatgaaacagttttaataattaccaagttttggccgggcacagtggctcacacctgtaatcccaggactttgggaggctgaggaaagcagatcacaaggtcaagagattgagaccatcctggccaacatggtgaaaccctgtctctactaaaaatacaaaaattagctgggcgcggtggtgcacacctatagtctcagctactcagaggctgaggcaggaggatcgcttgaacccgggaggcagcagttgcagtgagctgagattgcgccactgtactccagcctggcaacagagtgagactgtgtcgcaaaaaaataaaaataaaataataataattaccaatttttcattattttgtaagaatgtagtgtattttaagataaaatgccaatgattataaaatcacatattttcaaaaatggttattatttaggcctttgtacaatttctaacaatttagtggaagtatcaaaagaattgaagcaaatactgtaacagttatgttcctttaaataatagagaatataaaatattgtaataatatgtatcataaaatagttgtatgtgagcatttgatggtgctcgatgagttacttgtatttgatgggattgtttggatgtatttaatgggagtatttggagtatttaacgggatgtaaaccctggatgtacctgattttgttactgttttattttaataggtaatatatatacagggtaaaagcttcaaatggtacaaaagggttaacagtgatcgtgaagtctctgtcctttccctcttccctgccatccagttccccctccaagaagcaagtaccgaaaccacctgcttacgcatttttagagattggccacaaatttataaacaaatgtatatattcctttccccctacacaaacggtaacatactgcacacattgttctgcatgttgcttctttttccttttttttttcacttaacagtagatatctagaggtgaaattactgagtcaagactatatttagcaaaattacactagatactacaaattacctctaaagaaggtatactaactgataatctcaccatcaatgcatgtcttcttatcctttgccaacctaacagataaaaatgttctatttttatttttctttttatgagtaacgtagagcatattttcatgtatttaacagccactggaatctgctttaccatggcctttcctatttctattctttgcctatttttctgttggttgttggtctttgttttgtattacaggtgtgctttagatattagctttttgtaagagatcctgcaaatatcttctttccagtttgtcattgtcatttgtcttttgactttgttctggtattttttgatatgtagaaatttttattttcatgtaagcaaatttatgaatctttgtacaccataagtatatacaattatgatttgtcaattaaaaatattagtacaaaattta

SEQ ID NO: 109075 - DNA, 1088 bp, Homo sapiens
  Payload ID: 1430
  Gene Symbol: ARSK
  Gene Name: arylsulfatase family, member K
  ENST ID: ENST00000504763
  CDS Start-End: 113-253
ccaaactgcaagctttgggagttgttcgctgtccctgccctgctctgctagggagagaacgccagagggaggcggctggcccggcggcaggctctcagaaccgctaccggcgatgctactgctgtgggtgtcggtggtcgcagccttggcgctggcggtactggcccccggagcaggggagcagaggcggagagcagccaaagcgcccaatgtggtgctggtcgtgagcgactccttcattcctgatgattaaaattacatagtctggatgtgcccatgggattttttgaaaatattacttaaagttatctttgtgatttaaacttagagaatgggcagtactggaaattgactagatggcattttattacagagtgctcttgtaatcaaaggcaaatgaaggaagcaggattgtgcagaggagaagctgaattttgttgccatcttatgaatgacagttctcaaactagtatggtgcttcagagctgctttccaataggagtgaggagaacagacctttccacctgcatgttggatggccactggttgtgggctgctcctagaatggggcatggtgttgggcaaagcagctgtcttcagcagaggcaattgttcattcctaaaagggaatccgaatgtggatcacaacatcccagaaacttccaaagatgactgagatatataggtttgttattttttttagtgtagtatgaatgcatagatttttctatatttgtgcttaaattttttgcattcacggccgggcgcggtggctcacgcctgtaatcccagcactttgggaggccgaggtgggcggatcacgaggtcaagagatcaagaccatcctggctaacacagtgaaaccccgtctctactaaaaatacaaaaaaattagccgggcgtggtttcgggcgcctgtagtcccagctactcgggaggctgaagcaggagaatggcgtgaacctgggaggcggagcttgcagtgacctgatatcgcaccactgcactccagcctgggcgacggagcgagagtccgtctcgaaaaaaaaataaaaataaaaataaaaaaatttttaaaaaataaaaaa

SEQ ID NO: 109076 - DNA, 1958 bp, Homo sapiens
  Payload ID: 1430
  Gene Symbol: ARSK
  Gene Name: arylsulfatase family, member K
  ENST ID: ENST00000513814
  CDS Start-End: 143-604
cgggtgaagctcggcgttactatcaagcaaccaaactgcaagctttgggagttgttcgctgtccctgccctgctctgctagggagagaacgccagagggaggcggctggcccggcggcaggctctcagaaccgctaccggcgatgctactgctgtgggtgtcggtggtcgcagccttggcgctggcggtactggcccccggagcaggggagcagaggcggagagcagccaaagcgcccaatgtggtgctggtcgtgagcgactccttcgatggaaggttaacatttcatccaggaagtcaggtagtgaaacttccttttatcaactttatgaagacacgtgggacttcctttctgaatgcctacacaaactctccaatttgttgcccatcacgcgcagcaatgtggagtggcctcttcactcacttaacagaatcttggaataattttaagggtctagatccaaattatacaacatggatggatgtcatggagaggcatggctaccgaacacagaaatttgggaaactggactatacttcaggacatcactccattaggcacagtgaacgtgggtcaactaatcaaagaagtgaaaaagtttgagaaagtaatcgtgtggaagcgtggacaagagatgttgctttcttactcagacaagaaggcaggcccatggttaatcttatccgtaacaggactaaagtcagagtgatggaaagggattggcagaatacagacaaagcagtaaactggttaagaaaggaagcaattaattacactgaaccatttgttatttacttgggattaaatttaccacacccttacccttcaccatcttctggagaaaattttggatcttcaacatttcacacatctctttattggcttgaaaaagtgtctcatgatgccatcaaaatcccaaagtggtcacctttgtcagaaatgcaccctgtagattattactcttcttatacaaaaaactgcactggaagatttacaaaaaaagaaattaagaatattagagcattttattatgctatgtgtgctgagacagatgccatgcttggtgaaattattttggcccttcatcaattagatcttcttcagaaaactattgtcatatactcctcagaccatggagagctggccatggaacatcgacagttttataaaatgagcatgtacgaggctagtgcacatgttccgcttttgatgatgggaccaggaattaaagccggcctacaagtatcaaatgtggtttctcttgtggatatttaccctaccatgcttgatattgctggaattcctctgcctcagaacctgagtggatactctttgttgccgttatcatcagaaacatttaagaatgaacataaagtcaaaaacctgcatccaccctggattctgagtgaattccatggatgtaatgtgaatgcctccacctacatgcttcgaactaaccactggaaatatatagcctattcggatggtgcatcaatattgcctcaactctttgatctttcctcggatccagatgaattaacaaatgttgctgtaaaatttccagaaattacttattctttggatcagaagcttcattccattataaactaccctaaagtttctgcttctgtccaccagtataataaagagcagtttatcaagtggaaacaaagtataggacagaattattcaaacgttatagcaaatcttaggtggcaccaagactggcagaaggaaccaaggaagtatgaaaatgcaattgatcagtggcttaaaacccatatgaatccaagagcagtttgaacaaaaagtttaaaaatagtgttctagagatacatataaatatattacaagatcataattatgtattttaaatgaaacagttttaataattaccaagttttggccgggcacagtggctcacacctgtaatcccaggactttgggaggctgagga

SEQ ID NO: 109077 - DNA, 1920 bp, Homo sapiens
  Payload ID: 1430
  Gene Symbol: ARSK
  Gene Name: arylsulfatase family, member K
  ENST ID: ENST00000504873
  CDS Start-End: 97-1284
gggagttgttcgctgtccctgccctgctctgctagggagagaacgccagagggaggcggctggcccggcggcaggctctcagaaccgctaccggcgatgctactgctgtgggtgtcggtggtcgcagccttggcgctggcggtactggcccccggagcaggggagcagaggcggagagcagccaaagcgcccaatgtggtgctggtcgtgagcgactccttcgatggaaggttaacatttcatccaggaagtcaggtagtgaaacttccttttatcaactttatgaagacacgtgggacttcctttctgaatgcctacacaaactctccaatttgttgcccatcacgcgcagcaatgtggagtggcctcttcactcacttaacagaatcttggaataattttaagggtctagatccaaattatacaacatggatggatgtcatggagaggcatggctaccgaacacagaaatttgggaaactggactatacttcaggacatcactccattagtaatcgtgtggaagcgtggacaagagatgttgctttcttactcagacaagaaggcaggcccatggttaatcttatccgtaacaggactaaagtcagagtgatggaaagggattggcagaatacagacaaagcagtaaactggttaagaaaggaagcaattaattacactgaaccatttgttatttacttgggattaaatttaccacacccttacccttcaccatcttctggagaaaattttggatcttcaacatttcacacatctctttattggcttgaaaaagtgtctcatgatgccatcaaaatcccaaagtggtcacctttgtcagaaatgcaccctgtagattattactcttcttatacaaaaaactgcactggaagatttacaaaaaaagaaattaagaatattagagcattttattatgctatgtgtgctgagacagatgccatgcttggtgaaattattttggcccttcatcaattagatcttcttcagaaaactattgtcatatactcctcagaccatggagagctggccatggaacatcgacagttttataaaatgagcatgtacgaggctagtgcacatgttccgcttttgatgatgggaccaggaattaaagccggcctacaagtatcaaatgtggtttctcttgtggatatttaccctaccatgcttgatgagaaaactgaggttgagataagtaaattacttgctgaagtccacatggccagtgggatattgctggaattcctctgcctcagaacctgagtggatactctttgttgccgttatcatcagaaacatttaagaatgaacataaagtcaaaaacctgcatccaccctggattctgagtgaattccatggatgtaatgtgaatgcctccacctacatgcttcgaactaaccactggaaatatatagcctattcggatggtgcatcaatattgcctcaactctttgatctttcctcggatccagatgaattaacaaatgttgctgtaaaatttccagaaattacttattctttggatcagaagcttcattccattataaactaccctaaagtttctgcttctgtccaccagtataataaagagcagtttatcaagtggaaacaaagtataggacagaattattcaaacgttatagcaaatcttaggtggcaccaagactggcagaaggaaccaaggaagtatgaaaatgcaattgatcagtggcttaaaacccatatgaatccaagagcagtttgaacaaaaagtttaaaaatagtgttctagagatacatataaatatattacaagatcataattatgtattttaaatgaaacagttttaataattaccaagttttggccgggcacagtggctcacacctgtaatcccaggactttgggaggctgagga

SEQ ID NO: 109078 - DNA, 572 bp, Homo sapiens
  Payload ID: 1430
  Gene Symbol: ARSK
  Gene Name: arylsulfatase family, member K
  ENST ID: ENST00000512106
  CDS Start-End: 1-279
agagcagccaaagcgcccaatgtggtgctggtcgtgagcgactccttcgatggaaggttaacatttcatccaggaagtcaggtagtgaaacttccttttatcaactttatgaagacacgtgggacttcctttctgaatgcctacacaaactctccaatttgttgcccatcacgcgcagtaatcgtgtggaagcgtggacaagagatgttgctttcttactcagacaagaaggcaggcccatggttaatcttatccgtaacaggactaaagtcagagtgatggaaagggattggcagaatacagacaaagcagtaaactggttaagaaaggaagcaattaattacactgaaccatttgttatttacttgggattaaatttaccacacccttacccttcaccatcttctggagaaaattttggatcttcaacatttcacacatctctttattggcttgaaaaagtgtctcatgatgccatcaaaatcccaaagtggtcacctttgtcagaaatgcaccctgtagattattactcttcttatacaaaaaactgcactggaagatttacaaaaaaa

SEQ ID NO: 109079 - DNA, 4642 bp, Homo sapiens
  Payload ID: 1431
  Gene Symbol: ARSG
  Gene Name: arylsulfatase G
  Uniprot ID: Q96EG1
  ENST ID: ENST00000448504
  CDS Start-End: 797-2374
ggctgcgcccaggccggcgggcccagcagctgcgaaccgccggcgcaccacctgtttccgcgcccggggacttccccggcggggctcagaagtgtgggatcggtcgcttggcttcccctggcgtcagcgacccagggtaacctcctccactgctgcgtgccgtgcaggcctgcctgtgtgagagccacgtgtgccgcgctctgggcacagccttggaaagtcaggaccgcgacggcagcagagcagaaaccttacagaaacatgaagccctcaaccatctgctactcagttattcggggctgacggcggcttctagaacatccaggtgttctgcagatgcgagaactcatcctgtagtcaccagatggagtcccaaacagccaagcagatgtaaggcctgtgctgtggctctgaggccctgaatacagaagggtcactttcttagtggccaaagagcagttgttgacattgatgtctaattattgaacacgaccagtcattttactgagctgcggtgaggaaacactgaccatagaagatcaagccaaatgagggattgcaaatttcctgattcttttgaattaggattccagatgggggcctcatttctacagcccccaacattcctatagccgttatcactgccatcaccactgccaccagcatcttcttgcagattccacccctgctccccagagacttcctgctttgaaagtgagcagaaaggaagctctcagaaaaatctctagtggtggctgccgtcgctccagacaatcggaatcctgccttcaccaccatgggctggctttttctaaaggttttgttggcgggagtgagtttctcaggatttctttatcctcttgtggatttttgcatcagtgggaaaacaagaggacagaagccaaactttgtgattattttggccgatgacatggggtggggtgacctgggagcaaactgggcagaaacaaaggacactgccaaccttgataagatggcttcggagggaatgaggtttgtggatttccatgcagctgcctccacctgctcaccctcccgggcttccttgctcaccggccggcttggccttcgcaatggagtcacacgcaactttgcagtcacttctgtgggaggccttccgctcaacgagaccaccttggcagaggtgctgcagcaggcgggttacgtcactgggataataggcaaatggcatcttggacaccacggctcttatcaccccaacttccgtggttttgattactactttggaatcccatatagccatgatatgggctgtactgatactccaggctacaaccaccctccttgtccagcgtgtccacagggtgatggaccatcaaggaaccttcaaagagactgttacactgacgtggccctccctctttatgaaaacctcaacattgtggagcagccggtgaacttgagcagccttgcccagaagtatgctgagaaagcaacccagttcatccagcgtgcaagcaccagcgggaggcccttcctgctctatgtggctctggcccacatgcacgtgcccttacctgtgactcagctaccagcagcgccacggggcagaagcctgtatggtgcagggctctgggagatggacagtctggtgggccagatcaaggacaaagttgaccacacagtgaaggaaaacacattcctctggtttacaggagacaatggcccgtgggctcagaagtgtgagctagcgggcagtgtgggtcccttcactggattttggcaaactcgtcaagggggaagtccagccaagcagacgacctgggaaggagggcaccgggtcccagcactggcttactggcctggcagagttccagttaatgtcaccagcactgccttgttaagcgtgctggacatttttccaactgtggtagccctggcccaggccagcttacctcaaggacggcgctttgatggtgtggacgtctccgaggtgctctttggccggtcacagcctgggcacagggtgctgttccaccccaacagcggggcagctggagagtttggagccctgcagactgtccgcctggagcgttacaaggccttctacattaccggtggagccagggcgtgtgatgggagcacggggcctgagctgcagcataagtttcctctgattttcaacctggaagacgataccgcagaagctgtgcccctagaaagaggtggtgcggagtaccaggctgtgctgcccgaggtcagaaaggttcttgcagacgtcctccaagacattgccaacgacaacatctccagcgcagattacactcaggacccttcagtaactccctgctgtaatccctaccaaattgcctgccgctgtcaagccgcataacagaccaatttttattccacgaggaggagtacctggaaattaggcaagtttgcttccaaatttcatttttaccctctttacaaacacacgctttagtttagtcttggagtttagttttggagttagccttgcatatcccttctgtatcctgtccctcctccacgccgacccgagagcagctgagctgcgctggctctgggcagggagtgtgccttaatgggaagcacacgggctttggagtcaggcacaggtgccagctccagcttttgaacttgggcaattgtttaacctaacctgcaagttgattttgagggttaaataaaggcatacatgaaaatgcctggcaaattacctgacacagagcagacattcaatacattttagtttccttgtttctctggttcccagtttctctggtcattttggtgtaaatccattctaattagtatttagggcagagcttctctctcttttctctttttttccttccacaaaccagtgtactcactggtctccatctttaatatgcaaacaaatcacctgggatcttgtgagaatccggattccgtctcagtagggctcgagtagatcctgaaatcctacatttctatcaaacaatgccttgaggagcacagatttagaccaaagttaggtcgttttccagatctcagagcagacgagtccatggataagtctgtggcccaatccccttcctctccttttaagggtgaaatgactgcatttaaaagaagttaaagagttcctcctgtcccctataaccacaaggaaacaaaaaaatatataaaaacctcaaaaatgcattgccatgattttattattagtgtccaaaatgggactcccaagtaataaatgatttattccagccacagccaaaaaagactttgcctggctaaaagagtctctctctaagtatgtaatatacaagaaatacaattcaaagagatgttcctataagtacattttttacacggcatatatttaaaaaggaggccccttttaatataaaattccggttatataccaatatggttaattagcatttacactatagtttgaacgtattttaaatagcatgatgtgtatacaatgtctcccgcgcccattggcaaccagggtcgtgggaagcttggtgaggagttaaccaggtcctgtggtttaagcagtggagcacccgggattcctgcccccctttctgctcacacaattgcactccattcttccgccttccttgttttctccaaaaccacctgataggggggatgtcctgatttctgaggtgtgcttctcatcatgactgcttcgttttgcccttctgatttccacggcacaagattatctaccaaaatcaaaacagaatggccttactcttctcaggaagaggctggtaggcaggtgcattatcaacaggtctgtgcccatgcagagtgagcagggagaggctgggcactgtggaatttttctgtctgaactcgctcatggccacagaatggtcacccagcttatttaggtgtagacaagtatgacacagttctagaaaatactgactataaaaatgtctctgtgtgtgtgtgtatgtatttatatgtatatgtatatatttttaaaaggctcatcttacttgtaaacatggactgctcaatcactattaaaaagtcagtttaggctgggcgcggtggctcacgcctgtaatcccagaactttgggaggctgaggtgggtggatcactaggtcaggagtttgagaccagcctggccaacatggtgaaaccccatcgctactaaaaaatacaaaaattagccgggcatggtggcgctcacctgtaatcccagctactcgggaggctgaggcaggagagaatcgcttgaaccggggaggtggaggctgcagtgagccgagatcgcaccactgcactccagcctgggcgatggagcaagactccatctcaaaaaaaaaaaagtcagtttaggctgggcgcagtggctcacacctgtaatcccagcactttaggaggctgaggggggtgatcacctgaggtcaggagtttgagaccagcctggccaacatggtgaaatcctgtctctactaaaaatacaaaatttagctgggcatggtagcatgcctgaaaccccagctacttgggaggctgaggcactagaatcacttgaacctaggaggtggaggttgcagtgagtggagatcacgccaacacattctagcctgagggacagagtgagactctatcatctc

SEQ ID NO: 109080 - DNA, 1733 bp, Homo sapiens
  Payload ID: 1431
  Gene Symbol: ARSG
  Gene Name: arylsulfatase G
  ENST ID: ENST00000452479
  CDS Start-End: 326-1411
gcgccggtcgcgcgcccgccagcctgccgcctgggctgggggtcacgaaaggtttgtggatttccatgcagctgcctccacctgctcaccctcccgggcttccttgctcaccggccggcttggccttcgcaatggagtcacacgcaactttgcagtcacttctgtgggaggccttccgctcaacgagaccaccttggcagaggtgctgcagcaggcgggttacgtcactgggataataggcaaatggcatcttggacaccacggctcttatcaccccaacttccgtggttttgattactactttggaatcccatatagccatgatatgggctgtactgatactccaggctacaaccaccctccttgtccagcgtgtccacagggtgatggaccatcaaggaaccttcaaagagactgttacactgacgtggccctccctctttatgaaaacctcaacattgtggagcagccggtgaacttgagcagccttgcccagaagtatgctgagaaagcaacccagttcatccagcgtgcaagcaccagcgggaggcccttcctgctctatgtggctctggcccacatgcacgtgcccttacctgtgactcagctaccagcagcgccacggggcagaagcctgtatggtgcagggctctgggagatggacagtctggtgggccagatcaaggacaaagttgaccacacagtgaaggaaaacacattcctctggtttacaggagacaatggcccgtgggctcagaagtgtgagctagcgggcagtgtgggtcccttcactggattttggcaaactcgtcaagggggaagtccagccaagcagacgacctgggaaggagggcaccgggtcccagcactggcttactggcctggcagagttccagttaatgtcaccagcactgccttgttaagcgtgctggacatttttccaactgtggtagccctggcccaggccagcttacctcaaggacggcgctttgatggtgtggacgtctccgaggtgctctttggccggtcacagcctgggcacagggtgctgttccaccccaacagcggggcagctggagagtttggagccctgcagactgtccgcctggagcgttacaaggccttctacattaccggtggagccagggcgtgtgatgggagcacggggcctgagctgcagcataagtttcctctgattttcaacctggaagacgataccgcagaagctgtgcccctagaaagaggtggtgcggagtaccaggctgtgctgcccgaggtcagaaaggttcttgcagacgtcctccaagacattgccaacgacaacatctccagcgcagattacactcaggacccttcagtaactccctgctgtaatccctaccaaattgcctgccgctgtcaagccgcataacagaccaatttttattccacgaggaggagtacctggaaattaggcaagtttgcttccaaatttcatttttaccctctttacaaacacacgctttagtttagtcttggagtttagttttggagttagccttgcatatcccttctgtatcctgtccctcctccacgccgacccgagagcagctgagctgcgctggctctgggcagggagtgtgccttaatgggaagcacacgggctttggagtcaggcacaggtgccagctccagcttttgaacttgggcaattgtttaacctaacctgcaagttgattttgagggttaaataa

SEQ ID NO: 109081 - DNA, 715 bp, Homo sapiens
  Payload ID: 1431
  Gene Symbol: ARSG
  Gene Name: arylsulfatase G
  ENST ID: ENST00000581639
  CDS Start-End: 630-715
gcgcgccgtcccacgtggacctgagccgcgccggtcgcgcgcccgccagcctgccgcctgggctgggggtcacgaaaggaaaccttacagaaacatgaagccctcaaccatctgctactcagttattcggggctgacggcggcttctagaacatccaggtgttctgcagatgcgagaactcatcctgtagtcaccagatggagtcccaaacagccaagcagatgtaaggcctgtgctgtggctctgaggccctgaatacagaagggtcactttcttagtggccaaagagcagttgttgacattgatgtctaattattgaacacgaccagtcattttactgagctgcggtgaggaaacactgaccatagaagatcaagccaaatgagggattgcaaatttcctgattcttttgaattaggattccagatgggggcctcatttctacagcccccaacattcctatagccgttatcactgccatcaccactgccaccagcatcttcttgcagattccacccctgctccccagagacttcctgctttgaaagtgagcagaaaggaagctctcagaaaaatctctagtggtggctgccgtcgctccagacaatcggaatcctgccttcaccaccatgggctggctttttctaaaggttttgttggcgggagtgagtttctcaggatttctttatcctcttgtggatttttgcatcagtgg

SEQ ID NO: 109082 - DNA, 2599 bp, Homo sapiens
  Payload ID: 1431
  Gene Symbol: ARSG
  Gene Name: arylsulfatase G
  Uniprot ID: Q96EG1
  ENST ID: ENST00000621439
  CDS Start-End: 626-2203
gccgtcccacgtggacctgagccgcgccggtcgcgcgcccgccagcctgccgcctgggctgggggtcacgaaaggaaaccttacagaaacatgaagccctcaaccatctgctactcagttattcggggctgacggcggcttctagaacatccaggtgttctgcagatgcgagaactcatcctgtagtcaccagatggagtcccaaacagccaagcagatgtaaggcctgtgctgtggctctgaggccctgaatacagaagggtcactttcttagtggccaaagagcagttgttgacattgatgtctaattattgaacacgaccagtcattttactgagctgcggtgaggaaacactgaccatagaagatcaagccaaatgagggattgcaaatttcctgattcttttgaattaggattccagatgggggcctcatttctacagcccccaacattcctatagccgttatcactgccatcaccactgccaccagcatcttcttgcagattccacccctgctccccagagacttcctgctttgaaagtgagcagaaaggaagctctcagaaaaatctctagtggtggctgccgtcgctccagacaatcggaatcctgccttcaccaccatgggctggctttttctaaaggttttgttggcgggagtgagtttctcaggatttctttatcctcttgtggatttttgcatcagtgggaaaacaagaggacagaagccaaactttgtgattattttggccgatgacatggggtggggtgacctgggagcaaactgggcagaaacaaaggacactgccaaccttgataagatggcttcggagggaatgaggtttgtggatttccatgcagctgcctccacctgctcaccctcccgggcttccttgctcaccggccggcttggccttcgcaatggagtcacacgcaactttgcagtcacttctgtgggaggccttccgctcaacgagaccaccttggcagaggtgctgcagcaggcgggttacgtcactgggataataggcaaatggcatcttggacaccacggctcttatcaccccaacttccgtggttttgattactactttggaatcccatatagccatgatatgggctgtactgatactccaggctacaaccaccctccttgtccagcgtgtccacagggtgatggaccatcaaggaaccttcaaagagactgttacactgacgtggccctccctctttatgaaaacctcaacattgtggagcagccggtgaacttgagcagccttgcccagaagtatgctgagaaagcaacccagttcatccagcgtgcaagcaccagcgggaggcccttcctgctctatgtggctctggcccacatgcacgtgcccttacctgtgactcagctaccagcagcgccacggggcagaagcctgtatggtgcagggctctgggagatggacagtctggtgggccagatcaaggacaaagttgaccacacagtgaaggaaaacacattcctctggtttacaggagacaatggcccgtgggctcagaagtgtgagctagcgggcagtgtgggtcccttcactggattttggcaaactcgtcaagggggaagtccagccaagcagacgacctgggaaggagggcaccgggtcccagcactggcttactggcctggcagagttccagttaatgtcaccagcactgccttgttaagcgtgctggacatttttccaactgtggtagccctggcccaggccagcttacctcaaggacggcgctttgatggtgtggacgtctccgaggtgctctttggccggtcacagcctgggcacagggtgctgttccaccccaacagcggggcagctggagagtttggagccctgcagactgtccgcctggagcgttacaaggccttctacattaccggtggagccagggcgtgtgatgggagcacggggcctgagctgcagcataagtttcctctgattttcaacctggaagacgataccgcagaagctgtgcccctagaaagaggtggtgcggagtaccaggctgtgctgcccgaggtcagaaaggttcttgcagacgtcctccaagacattgccaacgacaacatctccagcgcagattacactcaggacccttcagtaactccctgctgtaatccctaccaaattgcctgccgctgtcaagccgcataacagaccaatttttattccacgaggaggagtacctggaaattaggcaagtttgcttccaaatttcatttttaccctctttacaaacacacgctttagtttagtcttggagtttagttttggagttagccttgcatatcccttctgtatcctgtccctcctccacgccgacccgagagcagctgagctgcgctggctctgggcagggagtgtgccttaatgggaagcacacgggctttggagtcaggcacaggtgccagctccagcttttgaacttgggcaattgtttaacctaacctgcaagttgattttgagggttaaataaaggcatacatgaaaatgcctggcaaattacctgacacagagcagacattcaatacattttagtttccttgtttc

SEQ ID NO: 109083 - DNA, 11942 bp, Homo sapiens
  Payload ID: 1432
  Gene Symbol: ASH1L
  Gene Name: ash1 (absent, small, or homeotic)-like (Drosophila)
  Uniprot ID: Q9NR48
  ENST ID: ENST00000368346
  CDS Start-End: 641-9550
cgcgtacgggctggctggcgcgcggggcggccgaaggtggtggttggtgggagcagccagcgacgagcccgtagacactcgtacgcgtgcgggcgggcgtgcgcgctacgcggacggagtcgggcggagcgggggacggtgggaaagaacgcaaggaggaaggagtggaaggttgaggggggcgctaggcgcccttcgctccctccctctggaggagctgccgccgccaccgccgccactctgctgctgccgccgccgccgccgccgctcccgccgccattttgggttcgctttgcggaggggagacgatcccagtctcggttgcgggacccgcctcccctcagtttgccccctttagccttccacctttcccttctcctctctcgcatttccgccagtcagcttacccgctggccgcctcctgacaagcgggagggatccgccgtggacccagggaagcggaggagcctggcggccaccccctcttccccacttccctgcactctcatcgctctcggcctcggcctcggcctccgacacgagaaagatgctggtttcgagttttggagatccttgttttttatggaacacagttctgtaaaattttcataagattccttggcaataacatacgcttgtgatggaccctagaaatactgctatgttaggattgggttctgattccgaaggtttttcaagaaagagtccttctgccatcagtactggcacattggtcagtaagagagaagtagagctagaaaaaaacacaaaggaggaagaggaccttcgcaaacggaatcgagaaagaaacatcgaagctgggaaagatgatggtttgactgatgcacagcaacagttttcagtgaaagaaacaaacttttcagagggaaatttaaaattgaaaattggcctccaggctaagagaactaaaaaacctccaaagaacttggagaactatgtatgtcgacctgccataaaaacaactattaagcacccaaggaaagcacttaaaagtggaaagatgacggatgaaaagaatgaacactgtccttcaaaacgagacccttcaaagttgtacaagaaagcagatgatgttgcagccattgaatgccagtctgaagaagtcatccgtcttcattcacagggagaaaacaatcctttgtctaagaagctgtctccagtacactcagaaatggcagattatattaatgcaacgccatctactcttcttggtagccgggatcctgatttaaaggacagagcattacttaatggaggaactagtgtaacagaaaagttggcacagctgattgctacctgtcctccttccaagtcttccaagacaaaaccgaagaagttaggaactggcactacagcaggattggttagcaaggatttgatcaggaaagcaggtgttggctctgtagctggaataatacataaggacttaataaaaaagccaaccatcagcacagcagttggattggtaactaaagatcctgggaaaaagccagtgtttaatgcagcagtaggattggtcaataaggactctgtgaaaaaactgggaactggcactacagcggtattcattaataaaaacttaggcaaaaagccaggaactatcactacagtaggactgctaagcaaagattcaggaaagaagctaggaattggtattgttccaggtttagtgcataaagagtctggcaagaagttaggacttggcactgtggttggactggttaataaagatttgggaaagaaattgggttctactgttggcctagtggccaaggactgtgcaaagaagattgtagcaagttcagcaatgggattggttaataaggacattggaaagaaactaatgagttgtcctttggcaggtctgatcagtaaagatgccataaaccttaaagccgaagcactgctccccactcaggaaccgcttaaggcttcttgtagtacaaacatcaataatcaggaaagtcaggaactttctgaatccctgaaagatagtgccaccagcaaaacttttgaaaagaatgttgtacggcagaataaagaaagcatattggaaaagttctcagtacgaaaagaaatcattaatttggagaaagaaatgtttaatgaaggaacatgcattcagcaagacagtttctcatccagtgaaaagggatcttatgaaacctcaaagcatgaaaagcagcctcctgtatattgcacttctccggactttaaaatgggaggtgcttctgatgtatctaccgctaaatccccattcagtgcagtaggagaaagcaatctcccttccccatcacctactgtatctgttaatcctttaaccagaagtccccctgaaacttcttcacagttggctcctaatccattacttttaagttctactacagaactaatcgaagaaatttctgaatctgttggaaagaaccagtttacttctgaaagtacccacttgaacgttggtcataggtcagttggtcatagtataagtattgaatgtaaagggattgataaagaggtaaatgattcaaaaactacccatatagatattccaagaataagctcttcccttggaaaaaagccaagtttgacttctgaatccagcattcatactattactccttcagttgttaacttcactagtttatttagtaataagccttttttaaaactgggtgcagtatctgcatcagacaaacactgccaagttgctgaaagcctaagtactagtttgcagtccaaaccattaaaaaaaagaaaaggaagaaaacctcggtggactaaagtggtggcaagaagcacatgccggtctccaaaagggctagaattagaaagatcagagctttttaaaaacgtttcatgtagctcactatcaaatagtaattctgagccagccaagtttatgaaaaacattggacccccttcatttgtagatcatgacttccttaaacgccgattgccaaagttgagcaaatccacagctccatctcttgctctcttagctgatagtgaaaaaccatctcataagtcttttgctactcacaaactatcctccagtatgtgtgtctctagtgaccttttgtctgatatttataagcccaaaagaggaaggcctaaatctaaggagatgcctcaactggaagggccacctaaaaggactttaaaaatccctgcttctaaagtgttttctttacagtctaaggaagaacaagaacccccaattttacagccagaaattgaaatcccttccttcaaacaaggtctgtctgtgtctccttttccaaaaaagagaggcaggcctaagaggcaaatgaggtcaccagtcaagatgaagccacctgtactgtcagtggctccatttgttgccactgaaagtccaagcaagctagaatctgaaagtgacaaccatagaagtagcagtgatttctttgagagcgaggatcaacttcaggatccagatgacctagatgacagtcataggccaagtgtctgtagtatgagtgaccttgagatggaaccagataaaaaaattaccaagagaaacaatggacaattaatgaaaacaattatccgcaaaataaataaaatgaagactttaaagagaaagaaactgttgaatcagattctttcaagttctgtagaatcaagtaataaagggaaagtgcaatccaaactccataatacggtatcaagtcttgctgccacatttggctctaaattgggccaacagataaatgtcagcaagaaaggaaccatttatataggaaagagaagaggtcgcaaaccaaaaactgtcttaaatggtattctttctggtagtcctactagccttgctgttcttgagcaaacagctcaacaggcagctgggtcagcattaggacagattcttcccccattactgccttcatctgctagtagttctgagattcttccatcacctatttgctctcagtcttctgggactagtggaggtcagagccctgtaagtagtgatgcaggttttgttgaacccagttcagtgccatatttgcatttacactccagacagggcagtatgattcagactcttgcaatgaagaaggcctcaaaggggaggaggcggttatctcctcctactttgttgccaaattctccttcgcacttgagtgaactcacatctctaaaagaagctactccttccccaatcagtgagtctcatagtgatgagaccattcccagtgatagtggaattggaacagataataacagcacatcagacagggcagagaaattttgtgggcaaaaaaagaggaggcattcttttgagcatgtttctctgattccccctgaaacctctacagtgctaagcagtcttaaagaaaaacataaacacaaatgtaagcgcaggaatcatgattacctcagctatgacaagatgaaaaggcagaaacgaaaacggaaaaagaaatatccccagcttcgaaatagacaggatccagactttattgcagagctggaggaactaataagtcgcctaagtgaaattcggatcactcatcgaagtcatcattttatcccccgagatcttctgccaactatctttcgaatcaactttaatagtttctatacacatccttctttccccttagaccctttgcactacattcgaaaacctgacttaaaaaagaaaagagggagaccccctaagatgagggaggcaatggctgaaatgccttttatgcacagccttagttttcctctttctagtactggattctatccatcttatggtatgccttactctccttcaccccttacagctgctcccataggattaggttactatggaaggtatcctcccactctttatccacctcctccatctccttctttcaccacgccacttccacctccttcctatatgcatgctggtcatttacttctcaatcctgccaaataccataagaaaaagcataagctacttcgacaggaggcctttcttacaaccagcaggactcccctcctttccatgagtacctaccccagtgttcctcctgagatggcctatggttggatggttgagcacaaacacaggcaccgtcacaaacacagagaacaccgttcttctgaacaaccccaggtttctatggacactggctcttcccgatctgtcctggaatctttgaagcgctatagatttggaaaggatgctgttggagagcgatataagcataaggaaaagcaccgttgtcacatgtcctgccctcatctctctccttcaaaaagcttaataaacagagaggaacagtgggtccaccgagagccttcagaatctagtccattggccttgggattgcagacacctttacagattgactgttcagaaagttctccaagcttatcccttggaggattcactcccaactctgagccagccagcagtgatgaacatacaaaccttttcacaagtgcaataggcagctgcagagtttcaaaccctaactccagtggccggaagaaattaactgacagccctggactcttttctgcacaggacacttcactaaatcggcttcacagaaaggagtcactgccttctaacgaaagggcagtacagactttggcaggctcccagccaacctctgataaaccctcccagcggccatcagagagcacaaattgtagccctacccggaaaaggtcttcatctgagagtacttcttcaacagtaaacggagttccctctcgaagtccaagattagttgcttctggggatgactctgtggatagtctgctgcagcggatggtacaaaatgaggaccaagagcccatggagaaaagtattgatgctgtgattgcaactgcctctgcaccaccttcttccagtccaggccgtagccacagcaaggaccgaaccctgggaaaaccagacagccttttagtgcctgcagtcacaagtgactcttgcaataatagcatctcactcctatctgaaaagttgacaagcagctgttccccccatcatatcaagagaagtgtagtggaagctatgcaacgccaagctcggaaaatgtgcaattacgacaaaatcttggccacaaagaaaaacctagaccatgtcaataaaatcttaaaagccaaaaaacttcaaaggcaggccaggacagggaataactttgtgaaacgtaggccaggtcgacctcggaaatgtccccttcaggctgtcgtatcaatgcaagcattccaggctgctcagtttgtcaacccagaattgaacagagacgaggaaggagcagcactgcacctcagtcctgacacagttacagatgtaattgaggctgttgttcagagtgtaaatctgaacccagaacataaaaaggggttgaagagaaaaggttggctattggaagaacagaccagaaaaaagcagaagccattaccagaggaagaagagcaagagaataataaaagctttaatgaagcaccagttgagattcccagtccttctgaaaccccagctaaaccttctgaacctgaaagtaccttgcagcctgtgctttctctcatcccaagggaaaagaagcccccacgtcccccaaagaagaagtatcagaaagcagggctgtattctgacgtttacaaaactacagacccaaagagtcgattgatccaattaaagaaagagaagctggagtatactccaggagagcatgaatatggattatttccagcgcccattcatgttgtgttttttgtttcaggaaagtatctaagacaaaagagaattgacttccagcttccttatgatatcctttggcagtggaaacacaatcagctatacaaaaagccagatgtcccactatataagaaaattcgttcaaatgtctacgttgatgtcaaacccctttctggttacgaagctaccacctgtaactgtaagaagccagatgatgacaccaggaagggctgtgttgatgactgcctcaatagaatgatctttgctgagtgttcccccaacacttgcccatgtggcgagcaatgctgtaaccagaggatacagaggcatgaatgggtgcaatgtctagaacgatttcgagctgaggaaaaaggttggggaatcagaaccaaagagcccctaaaagctgggcagttcatcattgaatacctaggggaggtcgtcagtgaacaggagttcaggaacaggatgattgagcagtatcataatcacagtgaccactactgcctgaacctggatagtgggatggtgattgacagttaccgcatgggaaatgaggcccgattcatcaaccatagctgtgacccaaattgtgaaatgcagaaatggtctgttaatggagtataccggattggactctatgctcttaaagacatgccagctgggactgaactcacttatgattataactttcattccttcaatgtggaaaaacagcaactttgtaagtgtggctttgagaaatgtcgaggaatcatcggaggcaagagtcagcgtgtgaatggactcaccagcagcaaaaacagccagcccatggccacacacaaaaaatctggacggtcaaaagagaagagaaagtctaagcacaagctgaagaaaaggagaggccatctctctgaggaacccagtgaaaatatcaacaccccaactagattgaccccccaattacagatgaagccaatgtccaatcgtgaaaggaactttgtgttaaagcatcatgtattcttggtccgaaactgggagaagattcgtcaaaaacaggaggaagtaaagcacaccagtgataatattcactcagcatcattatatacccgttggaatgggatctgccgagatgatgggaatatcaagtctgatgtcttcatgacccagttctctgccctgcagacagctcgatctgttcgaacaagacggttggcagctgcagaggaaaatattgaagtggctcgggcagcccgcctagcccagatcttcaaagaaatttgtgatggtatcatctcttataaagattcttcccggcaagcactggcagctccacttttgaaccttcccccaaagaaaaagaatgctgattattatgagaagatctctgatcccctagatcttatcaccatagagaagcagatcctcactggttactataagacagtggaagcttttgatgctgacatgctcaaagtctttcggaatgctgagaagtactatgggcgtaaatccccagttgggagagatgtttgtcgtctacgaaaggcctattacaatgcccggcatgaggcatcagcccagattgatgagattgtgggagagacagcaagtgaggcagacagcagtgagacctcagtctctgaaaaggagaatgggcatgagaaggacgacgatgttattcgctgtatctgtggcctctacaaggatgaaggtctcatgatccagtgtgacaagtgcatggtatggcagcactgtgattgtatgggagtgaactcagatgtggagcactacctttgtgagcagtgtgacccaaggcctgtggacagggaggttcccatgatccctcggccccactatgcccaacctggctgtgtctacttcatctgtttgctccgagatgacttgctgcttcgtcagggtgactgtgtgtatctgatgagggatagtcggcgcacccctgatggccacccggtccgtcagtcctatcgactgttatctcacattaaccgagataaacttgacatctttcgcattgagaagctttggaagaatgaaaaagaggaacggtttgcctttggtcaccattatttccgtccccacgaaacacaccactctccatcccgtcggttctatcataatgaactatttcgggtgccactctatgagatcattcccttggaggctgtagtggggacctgctgtgtgttggacctttatacgtattgtaaagggagacccaaaggagtaaaggagcaagatgtgtacatctgtgattatcggcttgacaagtcagcacacctgttttacaagatccaccggaaccgctatcctgtctgcaccaaaccctatgcttttgatcacttccccaagaagctcactcccaaaaaagatttctcgcctcattacgtcccagacaactacaagaggaatggaggacgatcatcctggaagtctgagcgctcaaagccacccctaaaagacttgggccaggaggatgatgctctacccttgattgaagaggttctagccagtcaagagcaagcagccaatgagatacccagcctggaggagccagaacgggaaggggccactgctaacgtcagtgagggtgaaaaaaaaacagaggaaagtagtcaagaaccccagtcaacctgtacccctgaggaacgacggcataaccaacgggaacgactcaaccagatcttgctcaatctccttgaaaaaatccctggaaaaaatgccattgatgtgacctacttgctggaggaaggatcaggcaggaaactgcgaaggcgtactttgtttatcccagaaaacagctttcgaaagtgaccctcaaagaatgagaacctcaagcatctgggatccagtggagctaatcagtcctgcctcctgctctctgggtatagacaggggtgggaagggtccatctgggcaaggggaatggggccatgttgttgacattaggtacttaataagccttggagctagtggagagggagaggaaagggttctgtccaagacagttcaggttaattaattttcttctccattgcttcaccttaagggttaataatgtagagaggagggaggaccacattgatgaccagaacctactggtactttatagcatttgccccaccccacagcttaggtttttctgtcatcctcagatcccacaggcattgcgaagaagctgcttcctatacccaggtataactcaaaatccaaagggatagggccaggatccctattcctaccccatctattctctgttggctccaagagctaccccagagaccttaaacagaaacagtagctgaggcttcttcctagatacctgactagggaagtttgtctctcctttcttgcccaaccaggtcaaagtaaaatgtgagttgacagctcaaagcacttgtaactgctgccccctccctacctctactccccaaaatggaatcatgggatagggaaggcccccatggggtcagaagggcacggtagttcttgcaattatttttgttttacccttcataacctgtcaaacatatttttttctaatgagaaagccaggcccccgccagcacacatgctgtttttaatgcgctgtagttcttgtgtgtctgctgtgctgtgcaaatggagattcagttcaaaataaaatcatttaaaaacctacataaaaagaactctaaacccacccctgcaacaaaagtcactacataaactgttcagcagtattcacctatcagagtatttgttgtgagtatagattatcaattgaaaacactactcttgttttcttaattgtacagttttcaatgtccctttcttaaagagacagtatatttctcttcacccctagcccatcttccctcaccctcctgaatgacatcaggaggtatatccagggtgtctccttccttcctactctcttgaccagaagttaacagactatactgtctctttaaaaataaaatttaaaaagctttgttgtcttttcagacatacatatgcatatatgttttagatgttcttataagagaaaagatggtttttaaatgtgccaagttgtgtgtgtgtgtgtatatatatgtgtgtatgtgtgtgtatatatatatgtgtgtgtgtatatatatacacacacacacacacacctgctgtgtgattggtaagcaatacaatagtaaacatgtccccattacttttttctaatattggaccaatgctgtcctaattgtacatttccccttatggtgacgatgctctgactcgtttaggtagacacattgaccaccttccattccattaaatattttttcctttttcccctttctgtgtcattcttgaggaaaaaacaaaagagagaggggatgccaatgatccccttgagcagagaaaaagcaaaataaatattttattaaagaaaaaagagaattaagaaaatagtttggagtattttcttactgtagagaagcactgtacattactaagagacctgggtataagatactcacatgtggagctggaaaaatcgcatgtccaagcccgtttgagtggtttcttttgtttttcattgcagggagtgggtgggagggaggtgggactaggggcactttgggggtctccttttagtcaaaagcgagaaaatgacaagaaagagattaaaattcaatgtttcctttatagtgttaaacactaaaattttaaaaaagatgaaaaagaaaaaaaaactttgtaaaatgcgagaacagaagcaaaagacactacgctctgtcattttatctttcttttgttgaaagactaaaaaaaaactgaaatgttttttagacaatcaaatgttaggtaagtgcaaaaacttgttttttcttactggtgtagaaattaatgcctttttttatttttcagttattttataataacgaaataaaaagaaccccccagctgccaggcgggttttggtgtttgaaatgcggggcaaagcactacatcactgcaaatagatacagagttagtctgcatgtctgtaggctgtgtgattgcggaaaatataaatgctgctaatatatttcctttttacaaaagcatatctaaatagatgattgttttgatgttaatctttgtaaattatgtattaccaattttaacattggatgtaattgcatacaaagcttgcatctcaatccttgaaagtctagtattaaatggaaaaaacttttcctaa

SEQ ID NO: 109084 - DNA, 10979 bp, Homo sapiens
  Payload ID: 1432
  Gene Symbol: ASH1L
  Gene Name: ash1 (absent, small, or homeotic)-like (Drosophila)
  Uniprot ID: Q9NR48
  ENST ID: ENST00000392403
  CDS Start-End: 480-9374
ggagtggaaggttgaggggggcgctaggcgcccttcgctccctccctctggaggagctgccgccgccaccgccgccactctgctgctgccgccgccgccgccgccgctcccgccgccattttgggttcgctttgcggaggggagacgatcccagtctcggttgcgggacccgcctcccctcagtttgccccctttagccttccacctttcccttctcctctctcgcatttccgccagtcagcttacccgctggccgcctcctgacaagcgggagggatccgccgtggacccagggaagcggaggagcctggcggccaccccctcttccccacttccctgcactctcatcgctctcggcctcggcctcggcctccgacacgagaaagatgctggtttcgagttttggagatccttgttttttatggaacacagttctgtaaaattttcataagattccttggcaataacatacgcttgtgatggaccctagaaatactgctatgttaggattgggttctgattccgaaggtttttcaagaaagagtccttctgccatcagtactggcacattggtcagtaagagagaagtagagctagaaaaaaacacaaaggaggaagaggaccttcgcaaacggaatcgagaaagaaacatcgaagctgggaaagatgatggtttgactgatgcacagcaacagttttcagtgaaagaaacaaacttttcagagggaaatttaaaattgaaaattggcctccaggctaagagaactaaaaaacctccaaagaacttggagaactatgtatgtcgacctgccataaaaacaactattaagcacccaaggaaagcacttaaaagtggaaagatgacggatgaaaagaatgaacactgtccttcaaaacgagacccttcaaagttgtacaagaaagcagatgatgttgcagccattgaatgccagtctgaagaagtcatccgtcttcattcacagggagaaaacaatcctttgtctaagaagctgtctccagtacactcagaaatggcagattatattaatgcaacgccatctactcttcttggtagccgggatcctgatttaaaggacagagcattacttaatggaggaactagtgtaacagaaaagttggcacagctgattgctacctgtcctccttccaagtcttccaagacaaaaccgaagaagttaggaactggcactacagcaggattggttagcaaggatttgatcaggaaagcaggtgttggctctgtagctggaataatacataaggacttaataaaaaagccaaccatcagcacagcagttggattggtaactaaagatcctgggaaaaagccagtgtttaatgcagcagtaggattggtcaataaggactctgtgaaaaaactgggaactggcactacagcggtattcattaataaaaacttaggcaaaaagccaggaactatcactacagtaggactgctaagcaaagattcaggaaagaagctaggaattggtattgttccaggtttagtgcataaagagtctggcaagaagttaggacttggcactgtggttggactggttaataaagatttgggaaagaaattgggttctactgttggcctagtggccaaggactgtgcaaagaagattgtagcaagttcagcaatgggattggttaataaggacattggaaagaaactaatgagttgtcctttggcaggtctgatcagtaaagatgccataaaccttaaagccgaagcactgctccccactcaggaaccgcttaaggcttcttgtagtacaaacatcaataatcaggaaagtcaggaactttctgaatccctgaaagatagtgccaccagcaaaacttttgaaaagaatgttgtacggcagaataaagaaagcatattggaaaagttctcagtacgaaaagaaatcattaatttggagaaagaaatgtttaatgaaggaacatgcattcagcaagacagtttctcatccagtgaaaagggatcttatgaaacctcaaagcatgaaaagcagcctcctgtatattgcacttctccggactttaaaatgggaggtgcttctgatgtatctaccgctaaatccccattcagtgcagtaggagaaagcaatctcccttccccatcacctactgtatctgttaatcctttaaccagaagtccccctgaaacttcttcacagttggctcctaatccattacttttaagttctactacagaactaatcgaagaaatttctgaatctgttggaaagaaccagtttacttctgaaagtacccacttgaacgttggtcataggtcagttggtcatagtataagtattgaatgtaaagggattgataaagaggtaaatgattcaaaaactacccatatagatattccaagaataagctcttcccttggaaaaaagccaagtttgacttctgaatccagcattcatactattactccttcagttgttaacttcactagtttatttagtaataagccttttttaaaactgggtgcagtatctgcatcagacaaacactgccaagttgctgaaagcctaagtactagtttgcagtccaaaccattaaaaaaaagaaaaggaagaaaacctcggtggactaaagtggtggcaagaagcacatgccggtctccaaaagggctagaattagaaagatcagagctttttaaaaacgtttcatgtagctcactatcaaatagtaattctgagccagccaagtttatgaaaaacattggacccccttcatttgtagatcatgacttccttaaacgccgattgccaaagttgagcaaatccacagctccatctcttgctctcttagctgatagtgaaaaaccatctcataagtcttttgctactcacaaactatcctccagtatgtgtgtctctagtgaccttttgtctgatatttataagcccaaaagaggaaggcctaaatctaaggagatgcctcaactggaagggccacctaaaaggactttaaaaatccctgcttctaaagtgttttctttacagtctaaggaagaacaagaacccccaattttacagccagaaattgaaatcccttccttcaaacaaggtctgtctgtgtctccttttccaaaaaagagaggcaggcctaagaggcaaatgaggtcaccagtcaagatgaagccacctgtactgtcagtggctccatttgttgccactgaaagtccaagcaagctagaatctgaaagtgacaaccatagaagtagcagtgatttctttgagagcgaggatcaacttcaggatccagatgacctagatgacagtcataggccaagtgtctgtagtatgagtgaccttgagatggaaccagataaaaaaattaccaagagaaacaatggacaattaatgaaaacaattatccgcaaaataaataaaatgaagactttaaagagaaagaaactgttgaatcagattctttcaagttctgtagaatcaagtaataaagggaaagtgcaatccaaactccataatacggtatcaagtcttgctgccacatttggctctaaattgggccaacagataaatgtcagcaagaaaggaaccatttatataggaaagagaagaggtcgcaaaccaaaaactgtcttaaatggtattctttctggtagtcctactagccttgctgttcttgagcaaacagctcaacaggcagctgggtcagcattaggacagattcttcccccattactgccttcatctgctagtagttctgagattcttccatcacctatttgctctcagtcttctgggactagtggaggtcagagccctgtaagtagtgatgcaggttttgttgaacccagttcagtgccatatttgcatttacactccagacagggcagtatgattcagactcttgcaatgaagaaggcctcaaaggggaggaggcggttatctcctcctactttgttgccaaattctccttcgcacttgagtgaactcacatctctaaaagaagctactccttccccaatcagtgagtctcatagtgatgagaccattcccagtgatagtggaattggaacagataataacagcacatcagacagggcagagaaattttgtgggcaaaaaaagaggaggcattcttttgagcatgtttctctgattccccctgaaacctctacagtgctaagcagtcttaaagaaaaacataaacacaaatgtaagcgcaggaatcatgattacctcagctatgacaagatgaaaaggcagaaacgaaaacggaaaaagaaatatccccagcttcgaaatagacaggatccagactttattgcagagctggaggaactaataagtcgcctaagtgaaattcggatcactcatcgaagtcatcattttatcccccgagatcttctgccaactatctttcgaatcaactttaatagtttctatacacatccttctttccccttagaccctttgcactacattcgaaaacctgacttaaaaaagaaaagagggagaccccctaagatgagggaggcaatggctgaaatgccttttatgcacagccttagttttcctctttctagtactggattctatccatcttatggtatgccttactctccttcaccccttacagctgctcccataggattaggttactatggaaggtatcctcccactctttatccacctcctccatctccttctttcaccacgccacttccacctccttcctatatgcatgctggtcatttacttctcaatcctgccaaataccataagaaaaagcataagctacttcgacaggaggcctttcttacaaccagcaggactcccctcctttccatgagtacctaccccagtgttcctcctgagatggcctatggttggatggttgagcacaaacacaggcaccgtcacaaacacagagaacaccgttcttctgaacaaccccaggtttctatggacactggctcttcccgatctgtcctggaatctttgaagcgctatagatttggaaaggatgctgttggagagcgatataagcataaggaaaagcaccgttgtcacatgtcctgccctcatctctctccttcaaaaagcttaataaacagagaggaacagtgggtccaccgagagccttcagaatctagtccattggccttgggattgcagacacctttacagattgactgttcagaaagttctccaagcttatcccttggaggattcactcccaactctgagccagccagcagtgatgaacatacaaaccttttcacaagtgcaataggcagctgcagagtttcaaaccctaactccagtggccggaagaaattaactgacagccctggactcttttctgcacaggacacttcactaaatcggcttcacagaaaggagtcactgccttctaacgaaagggcagtacagactttggcaggctcccagccaacctctgataaaccctcccagcggccatcagagagcacaaattgtagccctacccggaaaaggtcttcatctgagagtacttcttcaacagtaaacggagttccctctcgaagtccaagattagttgcttctggggatgactctgtggatagtctgctgcagcggatggtacaaaatgaggaccaagagcccatggagaaaagtattgatgctgtgattgcaactgcctctgcaccaccttcttccagtccaggccgtagccacagcaaggaccgaaccctgggaaaaccagacagccttttagtgcctgcagtcacaagtgactcttgcaataatagcatctcactcctatctgaaaagttgacaagcagctgttccccccatcatatcaagagaagtgtagtggaagctatgcaacgccaagctcggaaaatgtgcaattacgacaaaatcttggccacaaagaaaaacctagaccatgtcaataaaatcttaaaagccaaaaaacttcaaaggcaggccaggacagggaataactttgtgaaacgtaggccaggtcgacctcggaaatgtccccttcaggctgtcgtatcaatgcaagcattccaggctgctcagtttgtcaacccagaattgaacagagacgaggaaggagcagcactgcacctcagtcctgacacagttacagatgtaattgaggctgttgttcagagtgtaaatctgaacccagaacataaaaaggggttgaagagaaaaggttggctattggaagaacagaccagaaaaaagcagaagccattaccagaggaagaagagcaagagaataataaaagctttaatgaagcaccagttgagattcccagtccttctgaaaccccagctaaaccttctgaacctgaaagtaccttgcagcctgtgctttctctcatcccaagggaaaagaagcccccacgtcccccaaagaagaagtatcagaaagcagggctgtattctgacgtttacaaaactacagacccaaagagtcgattgatccaattaaagaaagagaagctggagtatactccaggagagcatgaatatggattatttccagcgcccattcatgttggaaagtatctaagacaaaagagaattgacttccagcttccttatgatatcctttggcagtggaaacacaatcagctatacaaaaagccagatgtcccactatataagaaaattcgttcaaatgtctacgttgatgtcaaacccctttctggttacgaagctaccacctgtaactgtaagaagccagatgatgacaccaggaagggctgtgttgatgactgcctcaatagaatgatctttgctgagtgttcccccaacacttgcccatgtggcgagcaatgctgtaaccagaggatacagaggcatgaatgggtgcaatgtctagaacgatttcgagctgaggaaaaaggttggggaatcagaaccaaagagcccctaaaagctgggcagttcatcattgaatacctaggggaggtcgtcagtgaacaggagttcaggaacaggatgattgagcagtatcataatcacagtgaccactactgcctgaacctggatagtgggatggtgattgacagttaccgcatgggaaatgaggcccgattcatcaaccatagctgtgacccaaattgtgaaatgcagaaatggtctgttaatggagtataccggattggactctatgctcttaaagacatgccagctgggactgaactcacttatgattataactttcattccttcaatgtggaaaaacagcaactttgtaagtgtggctttgagaaatgtcgaggaatcatcggaggcaagagtcagcgtgtgaatggactcaccagcagcaaaaacagccagcccatggccacacacaaaaaatctggacggtcaaaagagaagagaaagtctaagcacaagctgaagaaaaggagaggccatctctctgaggaacccagtgaaaatatcaacaccccaactagattgaccccccaattacagatgaagccaatgtccaatcgtgaaaggaactttgtgttaaagcatcatgtattcttggtccgaaactgggagaagattcgtcaaaaacaggaggaagtaaagcacaccagtgataatattcactcagcatcattatatacccgttggaatgggatctgccgagatgatgggaatatcaagtctgatgtcttcatgacccagttctctgccctgcagacagctcgatctgttcgaacaagacggttggcagctgcagaggaaaatattgaagtggctcgggcagcccgcctagcccagatcttcaaagaaatttgtgatggtatcatctcttataaagattcttcccggcaagcactggcagctccacttttgaaccttcccccaaagaaaaagaatgctgattattatgagaagatctctgatcccctagatcttatcaccatagagaagcagatcctcactggttactataagacagtggaagcttttgatgctgacatgctcaaagtctttcggaatgctgagaagtactatgggcgtaaatccccagttgggagagatgtttgtcgtctacgaaaggcctattacaatgcccggcatgaggcatcagcccagattgatgagattgtgggagagacagcaagtgaggcagacagcagtgagacctcagtctctgaaaaggagaatgggcatgagaaggacgacgatgttattcgctgtatctgtggcctctacaaggatgaaggtctcatgatccagtgtgacaagtgcatggtatggcagcactgtgattgtatgggagtgaactcagatgtggagcactacctttgtgagcagtgtgacccaaggcctgtggacagggaggttcccatgatccctcggccccactatgcccaacctggctgtgtctacttcatctgtttgctccgagatgacttgctgcttcgtcagggtgactgtgtgtatctgatgagggatagtcggcgcacccctgatggccacccggtccgtcagtcctatcgactgttatctcacattaaccgagataaacttgacatctttcgcattgagaagctttggaagaatgaaaaagaggaacggtttgcctttggtcaccattatttccgtccccacgaaacacaccactctccatcccgtcggttctatcataatgaactatttcgggtgccactctatgagatcattcccttggaggctgtagtggggacctgctgtgtgttggacctttatacgtattgtaaagggagacccaaaggagtaaaggagcaagatgtgtacatctgtgattatcggcttgacaagtcagcacacctgttttacaagatccaccggaaccgctatcctgtctgcaccaaaccctatgcttttgatcacttccccaagaagctcactcccaaaaaagatttctcgcctcattacgtcccagacaactacaagaggaatggaggacgatcatcctggaagtctgagcgctcaaagccacccctaaaagacttgggccaggaggatgatgctctacccttgattgaagaggttctagccagtcaagagcaagcagccaatgagatacccagcctggaggagccagaacgggaaggggccactgctaacgtcagtgagggtgaaaaaaaaacagaggaaagtagtcaagaaccccagtcaacctgtacccctgaggaacgacggcataaccaacgggaacgactcaaccagatcttgctcaatctccttgaaaaaatccctggaaaaaatgccattgatgtgacctacttgctggaggaaggatcaggcaggaaactgcgaaggcgtactttgtttatcccagaaaacagctttcgaaagtgaccctcaaagaatgagaacctcaagcatctgggatccagtggagctaatcagtcctgcctcctgctctctgggtatagacaggggtgggaagggtccatctgggcaaggggaatggggccatgttgttgacattaggtacttaataagccttggagctagtggagagggagaggaaagggttctgtccaagacagttcaggttaattaattttcttctccattgcttcaccttaagggttaataatgtagagaggagggaggaccacattgatgaccagaacctactggtactttatagcatttgccccaccccacagcttaggtttttctgtcatcctcagatcccacaggcattgcgaagaagctgcttcctatacccaggtataactcaaaatccaaagggatagggccaggatccctattcctaccccatctattctctgttggctccaagagctaccccagagaccttaaacagaaacagtagctgaggcttcttcctagatacctgactagggaagtttgtctctcctttcttgcccaaccaggtcaaagtaaaatgtgagttgacagctcaaagcacttgtaactgctgccccctccctacctctactccccaaaatggaatcatgggatagggaaggcccccatggggtcagaagggcacggtagttcttgcaattatttttgttttacccttcataacctgtcaaacatatttttttctaatgagaaagccaggcccccgccagcacacatgctgtttttaatgcgctgtagttcttgtgtgtctgctgtgctgtgcaaatggagattcagttcaaaataaaatcatttaaaaacctacataaaaagaactctaaacccacccctgcaacaaaagtcactacataaactgttcagcagtattcacctatcagagtatttgttgtgagtatagattatcaattgaaaacactactcttgttttcttaattgtacagttttcaatgtccctttcttaaagagacagtatatttctcttcacccctagcccatcttccctcaccctcctgaatgacatcaggaggtatatccagggtgtctccttccttcctactctcttgaccagaagttaacagactatactgtctctttaaaaataaaatttaaaaagctttgttgtcttttcagacatacatatgcatatatgttttagatgttcttataagagaaaagatggtttttaaatgtgccaagttgtgtgtgtgtgtgtatatatatgtgtgtatgtgtgtgtatatatatatgtgtgtgtgtatatatatacacacacacacacacacctgctgtgtgattggtaagcaatacaatagtaaacatgtccccattacttttttctaatattggaccaatgctgtcctaattgtacatttccccttatggtgacgatgctctgactcgtttaggtagacacattgaccaccttccattccattaaatattttttcctttttcccctttctgtgtcattcttgaggaaaaaacaaaagagagaggggatgccaatgatccccttgagcagagaaaaagcaaaataaatattttattaaagaaaaaagagaa

SEQ ID NO: 109085 - DNA, 784 bp, Homo sapiens
  Payload ID: 1432
  Gene Symbol: ASH1L
  Gene Name: ash1 (absent, small, or homeotic)-like (Drosophila)
  ENST ID: ENST00000492987
  CDS Start-End: 1-463
gctcaaagtctttcggaatgctgagaagtactatgggcgtaaatccccagttgggagagatgtttgtcgtctacgaaaggcctattacaatgcccggcatgaggcatcagcccagattgatgagattgtgggagagacagcaagtgaggcagacagcagtgagacctcagtctctgaaaaggagaatgggcatgagaaggacgacgatgttattcgctgtatctgtggcctctacaaggatgaaggtctcatgatccagtgtgacaagtgcatggtatggcagcactgtgattgtatgggagtgaactcagatgtggagcactacctttgtgagcagtgtgacccaaggcctgtggacagggagtatgaccaaagggaaaataaaatacttagaaatctgtggaaggaatggcactatataaaactaaggtttttggccgggcacggtcgctcatgcctgtaatcctagcacactgggaggctaaggcggatggattgcctgagctcaggagttcgagaccagcctgggcaacacggtgaaaccccatctctactaaaatacaaaaaaaattagccgggcatggaggcgtgcacctgaagtctcaggaggttcccatgatccctcggccccactatgcccaacctggctgtgtctacttcatctgtttgctccgagatgacttgctgcttcgtcagggtgactgtgtgtatctgatgagggatagtcggcgcacccctgatggccacccggtccgtcagtcctatcgactgttatctcacatta

SEQ ID NO: 109086 - DNA, 1862 bp, Homo sapiens
  Payload ID: 1432
  Gene Symbol: ASH1L
  Gene Name: ash1 (absent, small, or homeotic)-like (Drosophila)
  ENST ID: ENST00000548830
  CDS Start-End: 272-805
ggaggaggcttgggcttgcgccgttgaagtcagcttacccgctggccgcctcctgacaagcgggagggatccgccgtggacccagggaagcggaggagcctggcggccaccccctcttccccacttccctgcactctcatcgctctcggcctcggcctcggcctccgacacgagaaagatgctggtttcgagttttggagatccttgttttttatggaacacagttctgtaaaattttcataagattccttggcaataacatacgcttgtgatggaccctagaaatactgctatgttaggattgggttctgattccgaaggtttttcaagaaagagtccttctgccatcagtactggcacattggtcagtaagagagaagtagagctagaaaaaaacacaaaggaggaagaggaccttcgcaaacggaatcgagaaagaaacatcgaagctgggaaagatgatggtttgactgatgcacagcaacagttttcagtgaaagaaacaaacttttcagagggaaatttaaaattgaaaattggcctccaggctaagagaactaaaaaacctccaaagaacttggagaactatgtatgtcgacctgccataaaaacaactattaagcacccaaggaaagcacttaaaagtggaaagatgacggatgaaaagaatgaacactgtccttcaaaacgaatggagtcttactctgtcgcccagactggagtgcagtggtgcgatctcggctcaccgcaacctccgcctcctgggttcaagcgattctcctattctcctgcctcagccccctgagtagctgggattacaggcgacccttcaaagttgtacaagaaagcagatgatgttgcagccattgaatgccagtctgaagaagtcatccgtcttcattcacagggagaaaacaatcctttgtctaagaagctgtctccagtacactcagaaatggcagattatattaatgcaacgccatctactcttcttggtagccgggatcctgatttaaaggacagagcattacttaatggaggaactagtgtaacagaaaagttggcacagctgattgctacctgtcctccttccaagtcttccaagacaaaaccgaagaagttaggaactggcactacagcaggattggttagcaaggatttgatcaggaaagcaggtgttggctctgtagctggaataatacataaggacttaataaaaaagccaaccatcagcacagcagttggattggtaactaaagatcctgggaaaaagccagtgtttaatgcagcagtaggattggtcaataaggactctgtgaaaaaactgggaactggcactacagcggtattcattaataaaaacttaggcaaaaagccaggaactatcactacagtaggactgctaagcaaagattcaggaaagaagctaggaattggtattgttccaggtttagtgcataaagagtctggcaagaagttaggacttggcactgtggttggactggttaataaagatttgggaaagaaattgggttctactgttggcctagtggccaaggactgtgcaaagaagattgtagcaagttcagcaatgggattggttaataaggacattggaaagaaactaatgagttgtcctttggcaggtctgatcagtaaagatgccataaaccttaaagccgaagcactgctccccactcaggaaccgcttaaggcttcttgtagtacaaacatcaataatcaggaaagtcaggaactttctgaatccctgaaagatagtgccaccagcaaaacttttgaaaagaatgttgtacggcagaataaagaaagcatattggaaaagttctcagtacgaaaagaaa

SEQ ID NO: 109087 - DNA, 3090 bp, Homo sapiens
  Payload ID: 1433
  Gene Symbol: ASH2L
  Gene Name: ash2 (absent, small, or homeotic)-like (Drosophila)
  Uniprot ID: Q9UBL3
  ENST ID: ENST00000343823
  CDS Start-End: 310-2196
gcagaatatccagtcgtagccacgaaaatacgccgcgtcagtccctgactcgaaaggaagtcctccagagagccgcactaaccatctagcttcctccaccttcagcctgccaggcccgcggccaccgccggcgcgggaggccggcccacctctgcccgcgcgcctggccttaaagcggtcgtggaattatgcttcctcaggcaggcggtggacgcaccgcgggctttttctgtttgaagactacagcgtcacacagcaacgcgcgcgagagaagagagtattctcgcgagaagtccaggggtggccgtgatggcggcggcaggagcaggacctggccaggaagcgggtgccgggcctggcccaggagcggtcgcaaatgcaacaggggcagaagagggggagatgaagccggtggcagcgggagcagccgctcctcctggagaggggatctctgctgctccgacagttgagcccagttccggggaggctgaaggcggggaggcaaacttggtcgatgtaagcggtggcttggagacagaatcatctaatggaaaagatacactagaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcatcctgtctacctttcatgaccaactacagttttcattgcaacgtctgccatcacagtgggaatacctatttcctccggaagcaagcaaacttgaaggaaatgtgccttagtgctttggccaacctgacatggcagtcccgaacacaggatgaacatccgaagacaatgttctccaaagataaggatattataccatttattgataaatactgggagtgcatgacaaccagacagagacctgggaaaatgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgagctccccagttaaagatctcagatgaccggctgactgtggttggagagaagggctactctatggtgagggcctctcatggagtacggaaaggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgagataatattttataaaaatggtgtcaatcaaggtgtggcttacaaagatatttttgagggggtttacttcccagccatctcactgtacaagagctgcacggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgtgaaagaaacttgcttgcagctttaacaaaatgagaaacttcccaaataaaacttgttttgaagtttatgtgacactttgcttcccttcagattgggtgcctcttggtgacagtgttcagaaatgtaagcagcacgaggaagggagctggcactgggaggaagagccgggtttctgagttgtgttttggctgctttcctattgctcccattcttgccaatcagccaccccctttcctgtgaaaatctgccaccttgaggagaggaacaagagtttaaaagggctaatgatctccctcccggtcttcccttggaacatggatgttgatata

SEQ ID NO: 109088 - DNA, 2678 bp, Homo sapiens
  Payload ID: 1433
  Gene Symbol: ASH2L
  Gene Name: ash2 (absent, small, or homeotic)-like (Drosophila)
  Uniprot ID: Q9UBL3
  ENST ID: ENST00000428278
  CDS Start-End: 442-2046
atcccgcggctcctggagccctgccgcccgccccctgcgaacccaggccccgccgccaatggctcgccctgcctctgcgccgcttggcccgtcccctctcaagcatatctcggataacgccccttccgcacctttcacgggcggtgggagctgaggctcctgtcgttatctctgatccttgcaccctggcaggaagctggtagctcacactttaacgggaggccttcacatattccagaaaagaaaccactttgcagtgccagactggaagaagtaacggtcactctgaaaacagggtgggagagctgcctctctttgaacctctcccaggaccaactctaacccagggaggcaaacttggtcgatgtaagcggtggcttggagacagaatcatctaatggaaaagatacactagaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcatcctgtctacctttcatgaccaactacagttttcattgcaacgtctgccatcacagtgggaatacctatttcctccggaagcaagcaaacttgaaggaaatgtgccttagtgctttggccaacctgacatggcagtcccgaacacaggatgaacatccgaagacaatgttctccaaagataaggatattataccatttattgataaatactgggagtgcatgacaaccagacagagacctgggaaaatgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgagctccccagttaaagatctcagatgaccggctgactgtggttggagagaagggctactctatggtgagggcctctcatggagtacggaaaggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgagataatattttataaaaatggtgtcaatcaaggtgtggcttacaaagatatttttgagggggtttacttcccagccatctcactgtacaagagctgcacggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgtgaaagaaacttgcttgcagctttaacaaaatgagaaacttcccaaataaaacttgttttgaagttta

SEQ ID NO: 109089 - DNA, 613 bp, Homo sapiens
  Payload ID: 1433
  Gene Symbol: ASH2L
  Gene Name: ash2 (absent, small, or homeotic)-like (Drosophila)
  ENST ID: ENST00000521808
  CDS Start-End: 1-271
tcagataatattttataaaaatggtgtcaatcaaggtgtggcttacaaagatatttttgagggggtttacttcccagccatctcactgtacaagagctgcacggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccagagaaagcttggactatatttctggaaggcacccactgtggggtgctgcttgttctgtggtgttgctgtgcagcggccgggaggagcagagggctgcaggagaccctctgagattctgctttgtgcacatgtactgccagcgcatggcattcttgagcccataaagcaagacttctcaggccctgtggttagcatcccccacacccatatcagccactagcattttaaagatggttttaggtgggtacataagggcccagaaaaaaagttttacaattattttaggggcctgaaccctcatgtcatagctaatcagtgaatgaagttaccttttaatcc

SEQ ID NO: 109090 - DNA, 656 bp, Homo sapiens
  Payload ID: 1433
  Gene Symbol: ASH2L
  Gene Name: ash2 (absent, small, or homeotic)-like (Drosophila)
  ENST ID: ENST00000517719
  CDS Start-End: 52-656
acgcgcgcgagagaagagagtattctcgcgagaagtccaggggtggccgtgatggcggcggcaggagcaggacctggccaggaagcgggtgccgggcctggcccaggagcggtcgcaaatgcaacaggggcagaagagggggagatgaagccggtggcagcgggagcagccgctcctcctggagaggggatctctgctgctccgacagttgagcccagttccggggaggctgaaggcggaaaagaaaccactttgcagtgccagactggaagaagtaacggtcactctgaaaacagggtgggagagctgcctctctttgaacctctcccaggaccaactctaacccaggaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcatcctgtctacctttcatgaccaactacagttttcattgcaacgtctgccatcacagtgggaatacctatttcctccggaagcaagcaaacttgaaggaaatgtgccttagtgctttggccaacctgacatggcagtcccgaacacaggatgaacatccgaa

SEQ ID NO: 109091 - DNA, 575 bp, Homo sapiens
  Payload ID: 1433
  Gene Symbol: ASH2L
  Gene Name: ash2 (absent, small, or homeotic)-like (Drosophila)
  ENST ID: ENST00000524247
  CDS Start-End: 1-575
gggctactctatggtgagggcctctcatggagtacggaaaggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgagataatattttataaaaatggtgtcaatcaaggtgtggcttacaaagatatttttgagggggtttacttcccagccatctcactgtacaagagctgcacggtttccattaactttggaccatgcttcaagtatcctccgaaggatctcacttaccgccctgtgagtaaca

SEQ ID NO: 109092 - DNA, 2433 bp, Homo sapiens
  Payload ID: 1433
  Gene Symbol: ASH2L
  Gene Name: ash2 (absent, small, or homeotic)-like (Drosophila)
  Uniprot ID: Q9UBL3
  ENST ID: ENST00000521652
  CDS Start-End: 296-1801
ggagctgaggctcctgtcgttatctctgatccttgcaccctggcaggaagctggtagctcacactttaacgggaggccttcacatattccagaaaagaaaccactttgcagtgccagactggaagaagtaacggtcactctgaaaacagggtgggagagctgcctctctttgaacctctcccaggaccaactctaacccagggaggcaaacttggtcgatgtaagcggtggcttggagacagaatcatctaatggaaaagatacactagaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcatcctgtctacctttcatgaccaactacagttttcattgcaacgtctgccatcacagtgggaatacctatttcctccggaagcaagcaaacttgaaggaaatgtgccttagtgctttggccaacctgacatggcagtcccgaacacaggatgaacatccgaagacaatgttctccaaagataaggatattataccatttattgataaatactgggagtgcatgacaaccagacagagacctgggaaaatgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgagctccccagttaaagatctcagatgaccggctgactgtggttggagagaagggctactctatggtgagggcctctcatggagtacggaaaggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgaggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgtgaaagaaacttgcttgcagctttaacaaaatgagaaacttcccaaataaaacttgttttgaagttta

SEQ ID NO: 109093 - DNA, 2194 bp, Homo sapiens
  Payload ID: 1433
  Gene Symbol: ASH2L
  Gene Name: ash2 (absent, small, or homeotic)-like (Drosophila)
  ENST ID: ENST00000517496
  CDS Start-End: 2-367
gatggcggcggcaggagcaggacctggccaggaagcgggtgccgggcctggcccaggagcggtcgcaaatgcaacaggggcagaagagggggagatgaagccggtggcagcgggagcagccgctcctcctggagaggggatctctgctgctccgacagttgagcccagttccggggaggctgaaggcggggaggcaaacttggtcgatgtaagcggtggcttggagacagaatcatctaatggaaaagatacactaatcctgtctacctttcatgaccaactacagttttcattgcaacgtctgccatcacagtgggaatacctatttcctccggaagcaagcaaacttgaaggaaatgtgccttagtgctttggccaacctgacatggcagtcccgaacacaggatgaacatccgaagacaatgttctccaaagataaggatattataccatttattgataaatactgggagtgcatgacaaccagacagagacctgggaaaatgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgagctccccagttaaagatctcagatgaccggctgactgtggttggagagaagggctactctatggtgagggcctctcatggagtacggaaaggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgagataatattttataaaaatggtgtcaatcaaggtgtggcttacaaagatatttttgagggggtttacttcccagccatctcactgtacaagagctgcacggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattcc

SEQ ID NO: 109094 - DNA, 2808 bp, Homo sapiens
  Payload ID: 1433
  Gene Symbol: ASH2L
  Gene Name: ash2 (absent, small, or homeotic)-like (Drosophila)
  ENST ID: ENST00000545394
  CDS Start-End: 330-1799
cacagcaacgcgcgcgagagaagagagtattctcgcgagaagtccaggggtggccgtgatggcggcggcaggagcaggacctggccaggaagcgggtgccgggcctggcccaggagcggtcgcaaatgcaacaggggcagaagagggggagatgaagccggtggcagcgggagcagccgctcctcctggagaggggatctctgctgctccgacagttgagcccagttccggggaggctgaaggcggggaggcaaacttggtcgatgtaagcggtggcttggagacagaatcatctaatggaaaagatacactaatcctgtctacctttcatgaccaactacagttttcattgcaacgtctgccatcacagtgggaatacctatttcctccggaagcaagcaaacttgaaggaaatgtgccttagtgctttggccaacctgacatggcagtcccgaacacaggatgaacatccgaagacaatgttctccaaagataaggatattataccatttattgataaatactgggagtgcatgacaaccagacagagacctgggaaaatgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgagctccccagttaaagatctcagatgaccggctgactgtggttggagagaagggctactctatggtgagggcctctcatggagtacggaaaggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgagataatattttataaaaatggtgtcaatcaaggtgtggcttacaaagatatttttgagggggtttacttcccagccatctcactgtacaagagctgcacggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgtgaaagaaacttgcttgcagctttaacaaaatgagaaacttcccaaataaaacttgttttgaagtttatgtgacactttgcttcccttcagattgggtgcctcttggtgacagtgttcagaaatgtaagcagcacgaggaagggagctggcactgggaggaagagccgggtttctgagttgtgttttggctgctttcctattgctcccattcttgccaatcagccaccccctttcctgtgaaaatctgccaccttgaggagaggaacaagagtttaaaagggctaatgatctccctcccggtcttcccttggaacatggatgttgatatatgtgcgggtggtttcctgtcttgcttatcttcctttgccctgagctgatggctaaagggcagttttcggactattaaagactgaaatgtaagaatgagccttctaggctgggcgc

SEQ ID NO: 109095 - DNA, 1504 bp, Homo sapiens
  Payload ID: 1434
  Gene Symbol: ASGR1
  Gene Name: asialoglycoprotein receptor 1
  Uniprot ID: P07306
  ENST ID: ENST00000269299
  CDS Start-End: 401-1276
cccaaacggtgcacggaagagtgaggtgactggcatgtgtgggggcaacacgattctcctccctggggagcagagcagaggcaacccatcccccactcccacccccacactcccctaagttccaatccatttccacctctgtttactgtccaaagtcccgggcactggagatgccacgtttggcgtgcttggacacacagacacgcagacacagagacaccggggcccagggccctcctatggaccctgcccgctcccctcccattgtccacggctgtccgcccacccccattctccaagcttcagccccctccttagttcggcatctgcacagcactgaagaacctgggaatcagaccctgagaccctgagcaatcccaggtccagcgccagccctatcatgaccaaggagtatcaagaccttcagcatctggacaatgaggagagtgaccaccatcagctcagaaaagggccacctcctccccagcccctcctgcagcgtctctgctccggacctcgcctcctcctgctctccctgggcctcagcctcctgctgcttgtggttgtctgtgtgatcggatcccaaaactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaatttatttcttcaatgcctcgacctgccgcaggggtccgggattgggaatccgcccatctgggggcctcttctgctttctcgggaattttcatctaggattttaagggaaggggaaggatagggtgatgttccgaaggtgaggagcttgaaacccgtggcgctttctgcagtttgcaggttatcattgtgaactttttttttttaagagtaaaaagaaatatacctaaa

SEQ ID NO: 109096 - DNA, 944 bp, Homo sapiens
  Payload ID: 1434
  Gene Symbol: ASGR1
  Gene Name: asialoglycoprotein receptor 1
  ENST ID: ENST00000380920
  CDS Start-End: 266-838
tgtcagtgatcagtttggtgaagggggaaaagggccacctcctccccagcccctcctgcagcgtctctgctccggacctcgcctcctcctgctctccctgggcctcagcctcctgctgcttgtggttgtctgtgtgatcggatcccaaaactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaatttatttcttcaatgcctcgacctgccgcaggggtccgggattgggaatccgcccatctgggggcctcttctgctttctcgggaattttcatctaggattttaagg

SEQ ID NO: 109097 - DNA, 797 bp, Homo sapiens
  Payload ID: 1434
  Gene Symbol: ASGR1
  Gene Name: asialoglycoprotein receptor 1
  ENST ID: ENST00000572879
  CDS Start-End: 435-719
tctggccctgcagggtcgcccaccgcccgcatttcttcatgtacatggttcctcctagactactagggccgccttagcttgctacccttttaggaccctggagctgtgccagggtcccctctgtccccgcgctcctgacaccccctcctcttgcagggccacctcctccccagcccctcctgcagcgtctctgctccggacctcgcctcctcctgctctccctgggcctcagcctcctgctgcttgtggttgtctgtgtgatcggatcccaaaactcccagctgcaggaggagctgcggggcctgagagagacgttcagcaacttcacagcgagcacggaggcccaggtcaagggcttgagcacccaggatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagtgagtgcgcgccctccctcggcctgggtccggccgccttcgcgccctggggccctgggctgaggagtctggagcgacccgc

SEQ ID NO: 109098 - DNA, 627 bp, Homo sapiens
  Payload ID: 1434
  Gene Symbol: ASGR1
  Gene Name: asialoglycoprotein receptor 1
  ENST ID: ENST00000570576
  CDS Start-End: 539-627
ggagggggtggactgaggttcctggattggctgcagtgacgcagtcatgccattaggtgtcagcaaaagctcagggcctcggtgggatggggcggctcagcgcttagcccccttccccagccctcttttctccccgatttccagttgcctctggccctgcagggtcgcccaccgcccgcatttcttcatgtacatggttcctcctagactactagggccgccttagcttgctacccttttaggaccctggagctgtgccagggtcccctctgtccccgcgctcctgacaccccctcctcttgcagggccacctcctccccagcccctcctgcagcgtctctgctccggacctcgcctcctcctgctctccctgggcctcagcctcctgctgcttgtggttgtctgtgtgatcggatcccaaaactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgt

SEQ ID NO: 109099 - DNA, 1552 bp, Homo sapiens
  Payload ID: 1434
  Gene Symbol: ASGR1
  Gene Name: asialoglycoprotein receptor 1
  Uniprot ID: P07306
  ENST ID: ENST00000574388
  CDS Start-End: 794-1552
acacagagacaccggggcccagggccctcctatggaccctgcccgctcccctcccattgtccacggctgtccgcccacccccattctccaagcttcagccccctccttagttcggcatctgcacagcactgaagaacctgggaatcagaccctgagaccctgagcaagtaaaatgggaagagaggtggcgggaggctggctgggggtgcaggggtgcggagggaacccagggtgtgttggggggtgctgggtgggaaacatcagaggatggattctggatgtcaggcctgggaggggatggaggaaagaagaaagctcccggtggggcgcggtggtccacgcctgtaatcccagcacgttgggaggctggggtgggtggattgcctgagctcaggagtttgagacaagcctgggcaacacggtgaaaccccgtctctactaaaatacaaaaaagtagccaggcgtggtggcgtgcacctgttgtcccagctactccagaggctgaggcaggagaaccgcttgaacccgggaggcagaggttgcagtaagctgagatcatgccactgcactccggcctggggacagagcaagactccctctcaaaaaaaaaaaaaaaaagaaaagaaaaaaaagaaaaagaaaagaaagaaagaagaaaggtctccatgatggagccgtcaatcagatgggagtaaagagatgggcccctcattcccactctagtcctggtgagcccccacctcagccccagcctcagtcttgactcagtcccaggtccagcgccagccctatcatgaccaaggagtatcaagaccttcagcatctggacaatgaggagagtgaccaccatcagctcagaaaagactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaa

SEQ ID NO: 109100 - DNA, 855 bp, Homo sapiens
  Payload ID: 1434
  Gene Symbol: ASGR1
  Gene Name: asialoglycoprotein receptor 1
  ENST ID: ENST00000573083
  CDS Start-End: 503-855
cacagagacaccggggcccagggccctcctatggaccctgcccgctcccctcccattgtccacggctgtccgcccacccccattctccaagcttcagccccctccttagttcggcatctgcacagcactgaagaacctgggaatcagaccctgagaccctgagcaaccaggcgtggtggcgtgcacctgttgtcccagctactccagaggctgaggcaggagaaccgcttgaacccgggaggcagaggttgcagtaagctgagatcatgccactgcactccggcctggggacagagcaagactccctctcaaaaaaaaaaaaaaaaagaaaagaaaaaaaagaaaaagaaaagaaagaaagaagaaaggtctccatgatggagccgtcaatcagatgggagtaaagagatgggcccctcattcccactctagtcctggtgagcccccacctcagccccagcctcagtcttgactcagtcccaggtccagcgccagccctatcatgaccaaggagtatcaagaccttcagcatctggacaatgaggagagtgaccaccatcagctcagaaaagggccacctcctccccagcccctcctgcagcgtctctgctccggacctcgcctcctcctgctctccctgggcctcagcctcctgctgcttgtggttgtctgtgtgatcggatcccaaaactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtga

SEQ ID NO: 109101 - DNA, 887 bp, Homo sapiens
  Payload ID: 1434
  Gene Symbol: ASGR1
  Gene Name: asialoglycoprotein receptor 1
  ENST ID: ENST00000574330
  CDS Start-End: 1-488
tgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagtgagtgcgcgccctccctcggcctgggtccggccgccttcgcgccctggggccctgggctgaggagtctggagcgacccgcctgcggatccgacctcctggggcccacagctggctctgtccccaggaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaatttatttcttcaatgcctcgacctgccgcaggggtccgggattgggaatccgcccatctgggggcctcttctgctttctcgggaattttcatctaggattt

SEQ ID NO: 109102 - DNA, 1384 bp, Homo sapiens
  Payload ID: 1434
  Gene Symbol: ASGR1
  Gene Name: asialoglycoprotein receptor 1
  Uniprot ID: P07306
  ENST ID: ENST00000619926
  CDS Start-End: 401-1159
cccaaacggtgcacggaagagtgaggtgactggcatgtgtgggggcaacacgattctcctccctggggagcagagcagaggcaacccatcccccactcccacccccacactcccctaagttccaatccatttccacctctgtttactgtccaaagtcccgggcactggagatgccacgtttggcgtgcttggacacacagacacgcagacacagagacaccggggcccagggccctcctatggaccctgcccgctcccctcccattgtccacggctgtccgcccacccccattctccaagcttcagccccctccttagttcggcatctgcacagcactgaagaacctgggaatcagaccctgagaccctgagcaatcccaggtccagcgccagccctatcatgaccaaggagtatcaagaccttcagcatctggacaatgaggagagtgaccaccatcagctcagaaaagactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaatttatttcttcaatgcctcgacctgccgcaggggtccgggattgggaatccgcccatctgggggcctcttctgctttctcgggaattttcatctaggattttaagggaaggggaaggatagggtgatgttccgaaggtgaggagcttgaaacccgtggcgctttctgcagtttgcaggttatcattgtgaactttttttttttaagagtaaaaagaaatatacct

SEQ ID NO: 109103 - DNA, 1396 bp, Homo sapiens
  Payload ID: 1435
  Gene Symbol: ASGR2
  Gene Name: asialoglycoprotein receptor 2
  Uniprot ID: P07307
  ENST ID: ENST00000254850
  CDS Start-End: 280-1143
tactgtccaaagtcccaggccaggaggtgccaggttagagcttggacactcagaccctccagtgcaggccttgcccggaccagcccctcctccactctcctctcccctgtgagctccacctgccccagttctcctggctttaacccctccttggccaaggccagggttgcctgcgggagccaggtgtccgctctccacacctttcacagccccagccctcagagcaacctcagcccagcccagcccagctccagctccagctccagcccgggccccatcatggccaaggactttcaagatatccagcagctgagctcggaggaaaatgaccatcctttccatcaagggccacctcctgcccagcccctggcacagcgtctctgctccatggtctgcttcagtctgcttgccctgagcttcaacatcctgctgctggtggtcatctgtgtgactgggtcccaaagtgcacagctgcaagccgagctgcggagcctgaaggaagctttcagcaacttctcctcgagcaccctgacggaggtccaggcaatcagcacccacggaggcagcgtgggtgacaagatcacatccctaggagccaagctggagaaacagcagcaggacctgaaagcagatcacgatgccctgctcttccatctgaagcacttccccgtggacctgcgcttcgtggcctgccagatggagctcctccacagcaacggctcccaaaggacctgctgccccgtcaactgggtggagcaccaaggcagctgctactggttctctcactccgggaaggcctgggctgaggcggagaagtactgccagctggagaacgcacacctggtggtcatcaactcctgggaggagcagaaattcattgtacaacacacgaaccccttcaatacctggataggtctcacggacagtgatggctcttggaaatgggtggatggcacagactataggcacaactacaagaactgggctgtcactcagccagataattggcacgggcacgagctgggtggaagtgaagactgtgttgaagtccagccggatggccgctggaacgatgacttctgcctgcaggtgtaccgctgggtgtgtgagaaaaggcggaatgccaccggcgaggtggcctgaccccagcacacctctggctaacccataccccacacctgcccagctctggcttctctgttgaggattttgaggaaaggaagaaacactgagacaggggtatggggaagagctgagcaaagagagaaaggaggtagtttaagagtccctgaccctggaggactgagatcccacctccttctgtaattcattgtaattattataatcgtcagcctcttcaatggcgtaggaaagaagaaacaaatgcttgaatctc

SEQ ID NO: 109104 - DNA, 1386 bp, Homo sapiens
  Payload ID: 1435
  Gene Symbol: ASGR2
  Gene Name: asialoglycoprotein receptor 2
  Uniprot ID: P07307
  ENST ID: ENST00000355035
  CDS Start-End: 198-1133
ctgcgggagccaggtgtccgctctccacacctttcacagatcctacccaggccaccaccccgaacccctccgaccctgcgttccatcccaccatcaacctccacgtgaatctgcacctctgccccagccccagccctcagagcaacctcagcccagcccagcccagctccagctccagctccagcccgggccccatcatggccaaggactttcaagatatccagcagctgagctcggaggaaaatgaccatcctttccatcaaggtgaggggccaggcactcgcaggctgaatcccaggagaggaaatccatttttgaaagggccacctcctgcccagcccctggcacagcgtctctgctccatggtctgcttcagtctgcttgccctgagcttcaacatcctgctgctggtggtcatctgtgtgactgggtcccaaagtgagggtcacgggggtgcacagctgcaagccgagctgcggagcctgaaggaagctttcagcaacttctcctcgagcaccctgacggaggtccaggcaatcagcacccacggaggcagcgtgggtgacaagatcacatccctaggagccaagctggagaaacagcagcaggacctgaaagcagatcacgatgccctgctcttccatctgaagcacttccccgtggacctgcgcttcgtggcctgccagatggagctcctccacagcaacggctcccaaaggacctgctgccccgtcaactgggtggagcaccaaggcagctgctactggttctctcactccgggaaggcctgggctgaggcggagaagtactgccagctggagaacgcacacctggtggtcatcaactcctgggaggagcagaaattcattgtacaacacacgaaccccttcaatacctggataggtctcacggacagtgatggctcttggaaatgggtggatggcacagactataggcacaactacaagaactgggctgtcactcagccagataattggcacgggcacgagctgggtggaagtgaagactgtgttgaagtccagccggatggccgctggaacgatgacttctgcctgcaggtgtaccgctgggtgtgtgagaaaaggcggaatgccaccggcgaggtggcctgaccccagcacacctctggctaacccataccccacacctgcccagctctggcttctctgttgaggattttgaggaaaggaagaaacactgagacaggggtatggggaagagctgagcaaagagagaaaggaggtagtttaagagtccctgaccctggaggactgagatcccacctccttctgtaattcattgtaattattataatcgtcagcctcttcaatggcgtaggaaagaagaaacaaatgcttgaatctc

SEQ ID NO: 109105 - DNA, 879 bp, Homo sapiens
  Payload ID: 1435
  Gene Symbol: ASGR2
  Gene Name: asialoglycoprotein receptor 2
  Uniprot ID: P07307
  ENST ID: ENST00000446679
  CDS Start-End: 1-879
atggccaaggactttcaagatatccagcagctgagctcggaggaaaatgaccatcctttccatcaagggccacctcctgcccagcccctggcacagcgtctctgctccatggtctgcttcagtctgcttgccctgagcttcaacatcctgctgctggtggtcatctgtgtgactgggtcccaaagtgagggtcacgggggtgcacagctgcaagccgagctgcggagcctgaaggaagctttcagcaacttctcctcgagcaccctgacggaggtccaggcaatcagcacccacggaggcagcgtgggtgacaagatcacatccctaggagccaagctggagaaacagcagcaggacctgaaagcagatcacgatgccctgctcttccatctgaagcacttccccgtggacctgcgcttcgtggcctgccagatggagctcctccacagcaacggctcccaaaggacctgctgccccgtcaactgggtggagcaccaaggcagctgctactggttctctcactccgggaaggcctgggctgaggcggagaagtactgccagctggagaacgcacacctggtggtcatcaactcctgggaggagcagaaattcattgtacaacacacgaaccccttcaatacctggataggtctcacggacagtgatggctcttggaaatgggtggatggcacagactataggcacaactacaagaactgggctgtcactcagccagataattggcacgggcacgagctgggtggaagtgaagactgtgttgaagtccagccggatggccgctggaacgatgacttctgcctgcaggtgtaccgctgggtgtgtgagaaaaggcggaatgccaccggcgaggtggcctga

SEQ ID NO: 109106 - DNA, 1202 bp, Homo sapiens
  Payload ID: 1435
  Gene Symbol: ASGR2
  Gene Name: asialoglycoprotein receptor 2
  ENST ID: ENST00000574868
  CDS Start-End: 797-1202
ttttagtagagacagagtttcaccatgttggccaggctggtctcgaactcctgacctcagtttctctactcacctgggccaccacctagagcaagttgcctcatctctccgaggctccgcttccgaaccctgtgaaatgggagtaacagaagtcctgcctcgtgggggtgttgtgctgtgataaatgaagaaacaccttggagaatttagggcagtggctgggcctgaggacagtgtttgtgttgcctgggctggggcagggtctgggccggacggggctctctgaggttggattcctcctgcgaggagagctgtttttctgcaaagccccttcctcctcctgctgaagcttctggatttgagaggctttactctccaggagagtgaagcgagttgggccagagctgagagtctggtggccgagcccacaggaagctggggtctgtggttcagatgccggattgggcaagagtagagaactggtcgctgtgatcctggtcagggatatttggagacacccacagttctgtcccaggccaggaggtgccaggttagagcttggacactcagaccctccagtgcaggccttgcccggaccagcccctcctccactctcctctcccctgtgagctccacctgccccagttctcctggctttaacccctccttggccaaggccagggttgcctgcgggagccaggtgtccgctctccacacctttcacagccccagccctcagagcaacctcagcccagcccagcccagctccagctccagctccagcccgggccccatcatggccaaggactttcaagatatccagcagctgagctcggaggaaaatgaccatcctttccatcaaggtgaggggccaggcactcgcaggctgaatcccaggagaggaaatccatttttgaaagggccacctcctgcccagcccctggcacagcgtctctgctccatggtctgcttcagtctgcttgccctgagcttcaacatcctgctgctggtggtcatctgtgtgactgggtcccaaagtgcacagctgcaagccgagctgcggagcctgaaggaagctttcagcaacttctcctcgagcaccctgacggaggtccaggcaatcagcacccacggaggcagcgtgggtgacaagatcacatccctaggagccaagctggagaaacagcagcaggacctgaaag

SEQ ID NO: 109107 - DNA, 467 bp, Homo sapiens
  Payload ID: 1436
  Gene Symbol: ASPG
  Gene Name: asparaginase
  ENST ID: ENST00000550583
  CDS Start-End: 1-423
gcggccgcccggggaggccacacagaggcagtcaccatgctgctgcagagaggtgtggacgtgaacacccgggacacggatggcttcagcccgctgctgctggccgtgcggggcaggcatccgggtgtcattgggttgctgcgggaagccggggcctccctgtccacccaggagctggaggaagcagggacggagctgtgcaggctggcatacagggccgacctcgaaggcctgcaggtgtggtggcaggcaggggctgacctggggcagccgggctatgacgggcacagcgccctgcacgtcgcagaggcagccgggaacctggcagtggtggcctttctacagagcctggagggtgcggttggtgcccaggccccatgcccagagccctcatgttttcaggaagtgctgcctggtgtctaacctgaaggcgtcctgctgcagtataagccattccttcctcccat

SEQ ID NO: 109108 - DNA, 377 bp, Homo sapiens
  Payload ID: 1436
  Gene Symbol: ASPG
  Gene Name: asparaginase
  ENST ID: ENST00000551170
  CDS Start-End: 1-377
cccggccagccgcaaccagaggattctctacaccgtgctggagtgccagcccctcttcgactccagtgacatgaccatcgctgagtgggtttgccttgcccagaccatcaagaggcactacgagcagtaccacggctttgtggtcatccacggcaccgacaccatggcctttgctgcctcgatgctgtccttcatgctggagaacctgcagaagactgtcatcctcactggggcccaggtgcccatccatgccctgtggagcgacggccgtgagaacctgctgggggcactgctcatggctggccagtatgtgatcccagagctgctgaccaaggaccttcggggggagatgacgccaccctcggtggaagagcgcc

SEQ ID NO: 109109 - DNA, 1791 bp, Homo sapiens
  Payload ID: 1436
  Gene Symbol: ASPG
  Gene Name: asparaginase
  ENST ID: ENST00000546892
  CDS Start-End: 81-1748
cctccgcgcagtccctgagtcccgcaggccctgcgtccccgctgcacacccccgtccactcccgtggtccccggtccggcatggcgcgcgcggtggggcccgagcggaggctgctggccgtctacaccggcggcaccattggcatgcggagtgagctcggcgtgcttgtgcccgggacgggcctggctgccatcctgaggacactgcccatgttccatgacgaggagcacgcccgagcccgcggcctctctgaggacaccctggtgctacccccggccagccgcaaccagaggattctctacaccgtgctggagtgccagcccctcttcgactccagtgacatgaccatcgctgagtgggtttgccttgcccagaccatcaagaggcactacgagcagtaccacggctttgtggtcatccacggcaccgacaccatggcctttgctgcctcgatgctgtccttcatgctggagaacctgcagaagactgtcatcctcactggggcccaggtgcccatccatgccctgtggagcgacggccgtgagaacctgctgggggcactgctcatggctggccagtatgtgatcccagaggtctgccttttcttccagaatcagctgtttcggggcaaccgggcaaccaaggtagacgctcggaggttcgcagctttctgctccccgaacctgctgcctctggccacagtgggtgctgacatcacaatcaacagggagctggtgcggaaggtggacgggaaggctgggctggtggtgcacagcagcatggagcaggacgtgggcctgctgcgcctctaccctgggatccctgccgccctggttcgggccttcttgcagcctcccctgaagggcgtggtcatggagaccttcggttcagggaacggacccaccaagcccgacctgctgcaggagctgcgggtggccaccgagcgcggcctggtcatcgtcaactgtacccactgcctccagggggctgtgaccacagactatgcagctggcatggccatggcgggagccggcgtcatctcaggcttcgacatgacatcggaggccgccctggccaagctatcgtatgtgctgggccagccagggctgagcctggatgtcaggaaggagctgctgaccaaggaccttcggggggagatgacgccaccctcggtggaagagcgccggccctcactgcagggcaacacgctgggcggtggggtctcctggctcctcagtctgagcggcagccaggaggcagatgccctgcggaatgccctggtgcccagcctggcctgtgctgctgcccacgccggtgacgtggaggcgctgcaggcgcttgtggagctgggcagtgacctgggcctggtggactttaacggccaaaccccactgcacgcggccgcccggggaggccacacagaggcagtcaccatgctgctgcagagaggtgtggacgtgaacacccgggacacggatggcttcagcccgctgctgctggccgtgcggggcaggcatccgggtgtcattgggttgctgcgggaagccggggcctccctgtccacccaggagctggaggaagcagggacggagctgtgcaggcagaggcagccgggaacctggcagtggtggcctttctacagagcctggagggtgcggttggtgcccaggccccatgcccagaagtgctgcctggtgtctaacctgaaggcgtcctgctgcagtataagccattccttcctcccatgacctgctggaggggtctcaggcatgaccccactgctggggctgc

SEQ ID NO: 109110 - DNA, 4851 bp, Homo sapiens
  Payload ID: 1436
  Gene Symbol: ASPG
  Gene Name: asparaginase
  Uniprot ID: Q86U10
  ENST ID: ENST00000551177
  CDS Start-End: 93-1814
cgccccgggcctcctccgcgcagtccctgagtcccgcaggccctgcgtccccgctgcacacccccgtccactcccgtggtccccggtccggcatggcgcgcgcggtggggcccgagcggaggctgctggccgtctacaccggcggcaccattggcatgcggagtgagctcggcgtgcttgtgcccgggacgggcctggctgccatcctgaggacactgcccatgttccatgacgaggagcacgcccgagcccgcggcctctctgaggacaccctggtgctacccccggccagccgcaaccagaggattctctacaccgtgctggagtgccagcccctcttcgactccagtgacatgaccatcgctgagtgggtttgccttgcccagaccatcaagaggcactacgagcagtaccacggctttgtggtcatccacggcaccgacaccatggcctttgctgcctcgatgctgtccttcatgctggagaacctgcagaagactgtcatcctcactggggcccaggtgcccatccatgccctgtggagcgacggccgtgagaacctgctgggggcactgctcatggctggccagtatgtgatcccagaggtctgccttttcttccagaatcagctgtttcggggcaaccgggcaaccaaggtagacgctcggaggttcgcagctttctgctccccgaacctgctgcctctggccacagtgggtgctgacatcacaatcaacagggagctggtgcggaaggtggacgggaaggctgggctggtggtgcacagcagcatggagcaggacgtgggcctgctgcgcctctaccctgggatccctgccgccctggttcgggccttcttgcagcctcccctgaagggcgtggtcatggagaccttcggttcagggaacggacccaccaagcccgacctgctgcaggagctgcgggtggccaccgagcgcggcctggtcatcgtcaactgtacccactgcctccagggggctgtgaccacagactatgcagctggcatggccatggcgggagccggcgtcatctcaggcttcgacatgacatcggaggccgccctggccaagctatcgtatgtgctgggccagccagggctgagcctggatgtcaggaaggagctgctgaccaaggaccttcggggggagatgacgccaccctcggtggaagagcgccggccctcactgcagggcaacacgctgggcggtggggtctcctggctcctcagtctgagcggcagccaggaggcagatgccctgcggaatgccctggtgcccagcctggcctgtgctgctgcccacgccggtgacgtggaggcgctgcaggcgcttgtggagctgggcagtgacctgggcctggtggactttaacggccaaaccccactgcacgcggccgcccggggaggccacacagaggcagtcaccatgctgctgcagagaggtgtggacgtgaacacccgggacacggatggcttcagcccgctgctgctggccgtgcggggcaggcatccgggtgtcattgggttgctgcgggaagccggggcctccctgtccacccaggagctggaggaagcagggacggagctgtgcaggctggcatacagggccgacctcgaaggcctgcaggtgtggtggcaggcaggggctgacctggggcagccgggctatgacgggcacagcgccctgcacgtcgcagaggcagccgggaacctggcagtggtggcctttctacagagcctggagggtgcggttggtgcccaggccccatgcccagaagtgctgcctggtgtctaacctgaaggcgtcctgctgcagtataagccattccttcctcccatgacctgctggaggggtctcaggcatgaccccactgctggggctgcttcccagcctgctctcatgtaaagcctgaaggcctttgttgggcaggacggcaataaagtctctgacatcccctcaccaggtctgtacagcctggctctgagaggctctgtctgggtccgggactgtggatgtgtgtggggagtcaggcccaggctctgtggggtctctgcgggggtcacttggcccatccttccgggggcagctgtgcgtgtgagctgggcagggtggggtgcatggacgtgacttggccaagtggtcctttcccagctgccactcccccttcctgccaccctgcctttgcccaggctggtccctcctccagacaccctctgcccatctccttacctcctgcgccttcattctggagcttgaagtcccctcccccaggcagccctccaacccctggatgagcatgctgcccctgcttaactctttagtcctcacagtcccgtcccagttgctgtctggttttctgtcaccccagtatcgctgcacccggcccccctctcaggccagggccacaccagggctccatagggctgcggaagcctgtgagtgtcaagggggcttcacactctggtggtgagcccctggggaccattccagcccctgctctgcctgaagctcctgatgcagcctccaccgtgagccaggccaccctgtaagggaagaggtgagctgtgcctgcctggttgcacagcctgggcaggtgggcgggtggggcgggccctgctgctgcccggtgggggtggtgctccaaggccaagggcagcctcgtgccttctttcagctggggctgaaatcgggggtgtggacccctggcccccatcatgtgtgcatgcactggcctgggatggccagggactccctgctgctgcccccagcccctgaccccttcttgctgggtgtgaggagcatgggggctgcctccctccaggcctctctacctgcccaggtgacggttccttttgtccctctgtttggctggcctctggactggagccccaggagggcaaaagcatgaccccagagctggcccttggcacctgggcataccccaggctcctcagcctggttcccaagcctggctggtactgccgctggcatccttgctgtcctcaccccgacacaggtgtgcctgggccttgcacaacaaggtgacgccatgcgagcgtggcagggccggggaagcctttgctcctcaccctggtgaggcccatgaggggctgcaggtggagggagggtggcaccgggccccagagccaggagcccctgctgtccccggatggccgagacccttggagggccttgggagaggcggtggggcatctggacaaatgcctggtgcaggtgagaaggggtgggactacctccggcatccctgggctgagcccacctggtctccccggttgctcctgcacacggcagtgcccacctgcttccctcagctcctgaggggctgggcagagcctgttgctcacgccaccccactcagtgctgctccgggttgtgaaagctgcaggtggctcacgttagcccacatggcagcaccctcccagagcaggtgccaacctgccagtgtagacacaccgactgatgccgggggtgagtgtcctgtagtgtagaaacgcccactcatcctgcttgtcccgcagagagcatttgtcaagctggcctttctccaactgggtcactgatggagttcggcagagacggcttgggggccacgggctgggcagatggggagagctcctcacaaggctgggcagccagacccccattgtcagtcccctccaaaccctcgtgggatgtagggccctaccacagggagccccgggactgggccagtgtctcaggaggctgtgaagagtcataggcttgagtctgggagctttctcgggggccgttttgtgccccttggggagaggccagaggggccctgggtaaggggactcctctagaatcacccagaagtggcaggaggtgcagggccactgctcggggctccctgggctctgagctgggcagtgacctggccccaaggcctctggctctctggcgtgcagtgggaacagccgggacagacaggcttggagcgttcgtgtcctgcgccgcgttggtgtgtttcgtccccactgtgcctgtaggagggcaccgggtccccgtctatcctacttcatggctgaggaagctaaggcacagagtggccccgtcctgcgcccagggctctgcgttggcacagggcagagctgggctgtgaatcagggccgccttgtctcttgctgtggtgtgaggctgtgggagactcaggaatgaggcacagccaggtgcccagtgcccgtgggacccgcctccccacagtggggtggcgccgctcacacctggtaatttcacgctgggggaggccttggttcctatagcccatctcgaatcacctggatcccagggctatctctggggaacatctcctctccatcacgactactgtctttttcaccagcattttctatcctaaaatcagactcctcagctgagggccctccaggaccgcccttccccagctggaggtaaccagatttctcgtgtatgctaggaagttccccttctggtcacacctcaatatttcctgctgctggtgggaactgcaggtgcttgtacttgtcaccttctccccgtcctctctcgtcagttcccttggatgctggacacgggagccacctgggcgaggggagcccatccaagtggctgtgcgtcgggaagagtctgcccaggactgggctagaccagaacttagaattaaggagtggtggccaggcttggtggctcacacctgcaatcccagcactttgggaggccgaggcgggtggatagcttgagcctaggagtttgagaacagccaacatggcgaaactctgtctcttaaaaaataaataaaaacattagccag

SEQ ID NO: 109111 - DNA, 2182 bp, Homo sapiens
  Payload ID: 1437
  Gene Symbol: ASRGL1
  Gene Name: asparaginase like 1
  Uniprot ID: Q7L266
  ENST ID: ENST00000301776
  CDS Start-End: 134-1060
gaccagagcggttgcgggctgagcggtttcgagccggcgtcggggagcggcggtaccgggcggctgcggggctggctcgacccagcttgaggtctcggcgtccgcgtcctgcggtgccctgggatccgccgacatgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcaggttgtgggtctgtcttgaacacaaatggtgaggttgaaatggatgctagtatcatggatggaaaagacctgtctgcaggagcagtgtccgcagtccagtgtatagcaaatcccattaaacttgctcggcttgtcatggaaaagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaaaaacttgggaaccgtgggtgctgttgccttggactgcaaagggaatgtagcctacgcaacctccacaggcggtatcgttaataaaatggtcggccgcgttggggactcaccgtgtctaggagctggaggttatgccgacaatgacatcggagccgtctcaaccacagggcatggggaaagcatcctgaaggtgaacctggctagactcaccctgttccacatagaacaaggaaagacggtagaagaggctgcggacctatcgttgggttatatgaagtcaagggttaaaggtttaggtggcctcatcgtggttagcaaaacaggagactgggtggcaaagtggacctccacctccatgccctgggcagccgccaaggacggcaagctgcacttcggaattgatcctgacgatactactatcaccgaccttccctaagccgctggaagattgtattccagatgctagcttagaggtcaagtacagtctcctcatgagacatagcctaatcaattagatctagaattggaaaaattgtcccgtctgtcacttgttttgttgccttaataagcatctgaatgtttggttgtggggcgggttctgaagcgatgagagaaatgcccgtattaggaggattacttgagcccaggaggtcaaagctgaggtgagccatgattactccactgcactccagcctgggcaacagagccaggccctgtatcaaaaaaaaaaaaaaaaagaaaagggaaaaaagaaagaaagcagcagcatgatcctgacatgacagatgtgggagacccacagcctgcagacactgtgggctggaaggtgggaagggaggggccggtggaggtggagctgtttgaaagtgacacagcagcagtagaagcagtggtgggcgaagcccaggtgaccctcagaacgttgcacaagaacatcagggaaaagaaccagaatcctttaaggaaaatgttcttcatgtatgagagactaaagtgatttttctaagaaagttcagcccttctctgacttacctggacatttctagatacttccaaaggaccctctgggaatccatagcttcctaatctggagatgggaggtcataagggagacgctgtggggttccttgaagtttcttgggttcacagaggagccccctcacttggtgttctcccgtgagccagcctccacctgccaaagacactctggtcctcgtatagtgagtaatggggctcagggcctctccaacaacagagaggagctgatgctgtagggctgaccccgtgacttcctgagtcctcaccctgtccagtgctttgagattcttcccacctccccatcctcaccagccggatcgggcgctgtgcagtgtggtcagcatggtgaagaaagtcatttcctcggtgggcagtattcctctttatctctcattacactggaaatgttatttctgctgtatcatccgtgctcaacgttttagtctgtcaggctcaccttctctctggaaagaatttgcttaacttgacattccatgtgccgctaataaaatatattttg

SEQ ID NO: 109112 - DNA, 2270 bp, Homo sapiens
  Payload ID: 1437
  Gene Symbol: ASRGL1
  Gene Name: asparaginase like 1
  Uniprot ID: Q7L266
  ENST ID: ENST00000415229
  CDS Start-End: 216-1142
gttgtgaccagagcggttgcgggctgagcggtttcgagccggcgtcggggagcggcggtaccgggcggctgcggggctggctcgacccagcttgaggtctcggcgtccgcgtcctgcggtgccctggggtctcccgaggaccttgtacccgcgcggcttccttgggctggctttggacgacgctttcgccttcctgctgcctaggatccgccgacatgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcaggttgtgggtctgtcttgaacacaaatggtgaggttgaaatggatgctagtatcatggatggaaaagacctgtctgcaggagcagtgtccgcagtccagtgtatagcaaatcccattaaacttgctcggcttgtcatggaaaagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaaaaacttgggaaccgtgggtgctgttgccttggactgcaaagggaatgtagcctacgcaacctccacaggcggtatcgttaataaaatggtcggccgcgttggggactcaccgtgtctaggagctggaggttatgccgacaatgacatcggagccgtctcaaccacagggcatggggaaagcatcctgaaggtgaacctggctagactcaccctgttccacatagaacaaggaaagacggtagaagaggctgcggacctatcgttgggttatatgaagtcaagggttaaaggtttaggtggcctcatcgtggttagcaaaacaggagactgggtggcaaagtggacctccacctccatgccctgggcagccgccaaggacggcaagctgcacttcggaattgatcctgacgatactactatcaccgaccttccctaagccgctggaagattgtattccagatgctagcttagaggtcaagtacagtctcctcatgagacatagcctaatcaattagatctagaattggaaaaattgtcccgtctgtcacttgttttgttgccttaataagcatctgaatgtttggttgtggggcgggttctgaagcgatgagagaaatgcccgtattaggaggattacttgagcccaggaggtcaaagctgaggtgagccatgattactccactgcactccagcctgggcaacagagccaggccctgtatcaaaaaaaaaaaaaaaaagaaaagggaaaaaagaaagaaagcagcagcatgatcctgacatgacagatgtgggagacccacagcctgcagacactgtgggctggaaggtgggaagggaggggccggtggaggtggagctgtttgaaagtgacacagcagcagtagaagcagtggtgggcgaagcccaggtgaccctcagaacgttgcacaagaacatcagggaaaagaaccagaatcctttaaggaaaatgttcttcatgtatgagagactaaagtgatttttctaagaaagttcagcccttctctgacttacctggacatttctagatacttccaaaggaccctctgggaatccatagcttcctaatctggagatgggaggtcataagggagacgctgtggggttccttgaagtttcttgggttcacagaggagccccctcacttggtgttctcccgtgagccagcctccacctgccaaagacactctggtcctcgtatagtgagtaatggggctcagggcctctccaacaacagagaggagctgatgctgtagggctgaccccgtgacttcctgagtcctcaccctgtccagtgctttgagattcttcccacctccccatcctcaccagccggatcgggcgctgtgcagtgtggtcagcatggtgaagaaagtcatttcctcggtgggcagtattcctctttatctctcattacactggaaatgttatttctgctgtatcatccgtgctcaacgttttagtctgtcaggctcaccttctctctggaaagaatttgcttaacttgacattccatgtgccgctaataaaatatattttgaaagaa

SEQ ID NO: 109113 - DNA, 1177 bp, Homo sapiens
  Payload ID: 1437
  Gene Symbol: ASRGL1
  Gene Name: asparaginase like 1
  ENST ID: ENST00000534183
  CDS Start-End: 136-348
gtgaccagagcggttgcgggctgagcggtttcgagccggcgtcggggagcggcggtaccgggcggctgcggggctggctcgacccagcttgaggtctcggcgtccgcgtcctgcggtgccctgggatccgccgacatgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaaaaacttgggaaccgtgggtgctgttgccttggactgcaaagggaatgtagcctacgcaacctccacaggcggtatcgttaataaaatggtcggccgcgttggggactcaccgtgtctaggtaggaccaagggatgcctcctgccccttcccctcttctcccgccctcaggctttcctcactctctattccctgcccctctccgtttcttgctgcgttccctttctgcttttggtgcagctccaggatgtctgggagtgacaatggggttggaaggggttgttcggggtgctgccttgagagggtgtttgtatctggcgccactgtttttactagattgcatgcctttttggaacaacttggggagagaagtggagacagggatgctaacgttgcccccagtctaccctgtcgtgattctgtcttctctttagccacagtttcaggatctgcagacttacttgagtaagacttactcccgagacatgggctctgattagcaatctgagaaatctgagactgcagttgttagatctgagcagcatgaaagtgacatacttctacagacacattatagattgagatgttgtttacattaacggggaagcacgccatctcattcccaggagtgggtgagaggcagggctggggggctgtatgtttcactccgtgcagactttcacacttgtcatgcag

SEQ ID NO: 109114 - DNA, 574 bp, Homo sapiens
  Payload ID: 1437
  Gene Symbol: ASRGL1
  Gene Name: asparaginase like 1
  ENST ID: ENST00000529226
  CDS Start-End: 194-406
gctgagcggtttcgagccggcgtcggggagcggcggtaccgggcggctgcggggctggctcgacccagcttgaggtctcggcgtccgcgtcctgcggtgccctggggtctcccgaggaccttgtacccgcgcggcttccttgggctggctttggacgacgctttcgccttcctgctgcctaggatccgccgacatgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaaaaacttgggaaccgtgggtgctgttgccttgga

SEQ ID NO: 109115 - DNA, 639 bp, Homo sapiens
  Payload ID: 1437
  Gene Symbol: ASRGL1
  Gene Name: asparaginase like 1
  ENST ID: ENST00000534571
  CDS Start-End: 92-586
gggagcggcggtaccgggcggctgcggggctggctcgacccagcttgaggtctcggcgtccgcgtcctgcggtgccctgggatccgccgacatgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcaggttgtgggtctgtcttgaacacaaatggtgaggttgaaatggatgctagtatcatggatggaaaagacctgtctgcaggagcagtgtccgcagtccagtgtatagcaaatcccattaaacttgctcggcttgtcatggaaaagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaagtaagtcttacctgtggctcgcattatttgggagttattaaaatatgaaagtttggc

SEQ ID NO: 109116 - DNA, 535 bp, Homo sapiens
  Payload ID: 1437
  Gene Symbol: ASRGL1
  Gene Name: asparaginase like 1
  ENST ID: ENST00000526096
  CDS Start-End: 135-535
cggtaccgggcggctgcggggctggctcgacccagcttgaggtctcggcgtccgcgtcctgcggtgccctggtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcaggttgtgggtctgtcttgaacacaaatggtgaggttgaaatggatgctagtatcatggatggaaaagacctgtctgcaggagcagtgtccgcagtccagtgtatagcaaatcccattaaacttgctcggcttgtcatggaaaagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaac

SEQ ID NO: 109117 - DNA, 1543 bp, Homo sapiens
  Payload ID: 1437
  Gene Symbol: ASRGL1
  Gene Name: asparaginase like 1
  ENST ID: ENST00000528206
  CDS Start-End: 1-171
attcctggagaaaaactggtgacagagagaaacaaaaagcgcctggaaaaagagaagcatgaaaaaggtgctcagaaaacagattgtcaaaagttcttccgagggcacaagcttaccacaagactgactgtagacgtactcgggaatctctcatcaacttgttctcaatgaccacgctctagctcaccttcaccctagagaaaagcacccacgttgggcaccagatgaaggggtggccagcccctctacacctgtgggcgtttctcatcaggtgggacgagagactgagaaaagaaataagaggctgggtgcggtgggtcacgcctgtaatccccgcactttgggaggccgaggccggtggatcacgaggtcaggagatcgagaccatcctggctaacagggtgaaaccccatctctactaaaaatacaaaaaattagccgggcccagtggcgggtgcctgtagtcccagctactcaggaggctgaggcaggagagacagagacaacgtatagagaaaaaaaagtgggcccaggggaccggtgctcagcatacggaggacccccaccggcaacagtctctgagttccctcagtatttactgatcattatctctaccatctggagagggggatgtggcaggacaataagttaatagagaggagagggtcagcaggaaaacatgtgaacaaatgtctctgtgtcataaataaggaaaggtgctatgccttgatgtgcatgtatacaaacattaaagagcagtattgtcgctagcacctctcacctccagccctaaggctgttttctcctatctcagtaaatagaacatacaatcgggttttaaacccagacattctattgcccagggacaagcaggagacagatgccttcctcttatcacaactgcaaagaggccttcctcttttactaatgctcctcagcacagaccctttacgggtggggtgtcgggctgggggacagtgtcgggctgggggacggtcaggtctttcccttcccacaaggccatatctcaggctatcacatggggagaaaccttggacaatacctggctttcctaggcagaggtccctgcagccttccgcagtgtattgtgtccctgggtacttgaaattagagaatggtaatgacttttaacaagcatactgccttcaagcacttttttaacaaagcacagcctgcatagccctaaatccattaaaccttgagtcaacacagcacgtctctgcgacacagggttggggtagggttacagattaacagcatctcaaggcagaagaatttttcttagtacagaacaaaatagagtctcttatgtctacttctttctacatagacacagtaacagcctgatctctttcgtttccccacaaatccatatagtatttgagtgtgataatgtaaaaatcagtattcatttctaaatctaagtactgctttgagaattttgttggtaattccagttgctgctgcttcagcagaaggaagcttctccaaattaaaataaattaaaaacttgctaaaaact

SEQ ID NO: 109118 - DNA, 1161 bp, Homo sapiens
  Payload ID: 1437
  Gene Symbol: ASRGL1
  Gene Name: asparaginase like 1
  ENST ID: ENST00000628829
  CDS Start-End: 94-306
cggggagcggcggtaccgggcggctgcggggctggctcgacccagcttgaggtctcggcgtccgcgtcctgcggtgccctgggatccgccgacatgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaaaaacttgggaaccgtgggtgctgttgccttggactgcaaagggaatgtagcctacgcaacctccacaggcggtatcgttaataaaatggtcggccgcgttggggactcaccgtgtctaggagctggaggttatgccgacaatgacatcggagccgtctcaaccacagggcatggggaaagcatcctgaaggtgaacctggctagactcaccctgttccacatagaacaaggaaagacggtagaagaggctgcggacctatcgttgggttatatgaagtcaagggttaaaggtttaggtggcctcatcgtggttagcaaaacaggagactgggtggcaaagtggacctccacctccatgccctgggcagccgccaaggacggcaagctgcacttcggaattgatcctgacgatactactatcaccgaccttccctaagccgctggaagattgtattccagatgctagcttagaggtcaagtacagtctcctcatgagacatagcctaatcaattagatctagaattggaaaaattgtcccgtctgtcacttgttttgttgccttaataagcatctgaatgtttggttgtggggcgggttctgaagcgatgagagaaatgcccgtattaggaggattacttgagcccaggaggtcaaagctgaggtgagccatgattactccactgcactccagcctgggcaacagagccaggccctgtatc

SEQ ID NO: 109119 - DNA, 2356 bp, Homo sapiens
  Payload ID: 1438
  Gene Symbol: ASNS
  Gene Name: asparagine synthetase (glutamine-hydrolyzing)
  Uniprot ID: P08243
  ENST ID: ENST00000175506
  CDS Start-End: 530-2215
agtcctgctccgccccggacaccccgcggccccgcccctgtgcgcgctggttggtcctcgcaggcatgatgaaacttcccgcacgcgttacaggagccaggtcggtataagcgccagcggcctcgccgcccgtcaagctgtccacatccctggcctcagcccgccacatcaccctgacctgcttacgcccagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaccattgctgt

SEQ ID NO: 109120 - DNA, 1994 bp, Homo sapiens
  Payload ID: 1438
  Gene Symbol: ASNS
  Gene Name: asparagine synthetase (glutamine-hydrolyzing)
  Uniprot ID: P08243
  ENST ID: ENST00000394308
  CDS Start-End: 181-1866
aaacttcccgcacgcgttacaggagccaggtcggtataagcgccagcggcctcgccgcccgtcaagctgtccacatccctggcctcagcccgccacatcaccctgacctgcttacgcccagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatct

SEQ ID NO: 109121 - DNA, 2289 bp, Homo sapiens
  Payload ID: 1438
  Gene Symbol: ASNS
  Gene Name: asparagine synthetase (glutamine-hydrolyzing)
  Uniprot ID: P08243
  ENST ID: ENST00000394309
  CDS Start-End: 473-2158
tttctgtcctggttccctgaagcatcgagagggaaccgcggccggcaggccggaccgctccggagaggaggcagcggcagtttgagcccctgtaaatgttatatgtgtacttttttttactatgtggcgtcgaagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaa

SEQ ID NO: 109122 - DNA, 745 bp, Homo sapiens
  Payload ID: 1438
  Gene Symbol: ASNS
  Gene Name: asparagine synthetase (glutamine-hydrolyzing)
  ENST ID: ENST00000437657
  CDS Start-End: 259-745
ccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagaggtctgtttagggacacaggcgaccaagtacagaaaaagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaag

SEQ ID NO: 109123 - DNA, 562 bp, Homo sapiens
  Payload ID: 1438
  Gene Symbol: ASNS
  Gene Name: asparagine synthetase (glutamine-hydrolyzing)
  ENST ID: ENST00000451771
  CDS Start-End: 465-562
atgatgaaacttcccgcacgcgttacaggagccaggtcggtataagcgccagcggcctcgccgcccgtcaagctgtccacatccctggcctcagcccgccacatcaccctgacctgcttacgcccagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccg

SEQ ID NO: 109124 - DNA, 828 bp, Homo sapiens
  Payload ID: 1438
  Gene Symbol: ASNS
  Gene Name: asparagine synthetase (glutamine-hydrolyzing)
  ENST ID: ENST00000442734
  CDS Start-End: 185-828
gattgttacgcacctgacagctagcggaaggacctttctgtcctggttccctgaagcatcgagagggaaccgcggccggcaggccggaccgctccggagaggaggcagcggcagtttgagcccctattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccct

SEQ ID NO: 109125 - DNA, 1947 bp, Homo sapiens
  Payload ID: 1438
  Gene Symbol: ASNS
  Gene Name: asparagine synthetase (glutamine-hydrolyzing)
  ENST ID: ENST00000454046
  CDS Start-End: 60-1265
attttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggattggagagggagaaagaaaaactgctttgtgtgccaaaagcaaaactcttggtgtttttgtttgtgaaataggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatct

SEQ ID NO: 109126 - DNA, 579 bp, Homo sapiens
  Payload ID: 1438
  Gene Symbol: ASNS
  Gene Name: asparagine synthetase (glutamine-hydrolyzing)
  ENST ID: ENST00000448127
  CDS Start-End: 224-579
tactgaacaatgcaactttgagacagaaatatttgagaacatttttgtcagtgaggacattttgatagtgaatattttgtatcttctattaacttgaaatgttttatttgttataaagccaggatatctgatatcaaattaaattgttttttttttccctttagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatgg

SEQ ID NO: 109127 - DNA, 1812 bp, Homo sapiens
  Payload ID: 1438
  Gene Symbol: ASNS
  Gene Name: asparagine synthetase (glutamine-hydrolyzing)
  Uniprot ID: P08243
  ENST ID: ENST00000444334
  CDS Start-End: 135-1757
ataagcgccagcggcctcgccgcccgtcaagctgtccacatccctggcctcagcccgccacatcaccctgacctgcttacgcccagattttcttcaatcacatctgaataaatcacttgaagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggact

SEQ ID NO: 109128 - DNA, 1588 bp, Homo sapiens
  Payload ID: 1438
  Gene Symbol: ASNS
  Gene Name: asparagine synthetase (glutamine-hydrolyzing)
  Uniprot ID: P08243
  ENST ID: ENST00000455086
  CDS Start-End: 45-1481
cctggcctcagcccgccacatcaccctgacctgcttacgcccagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaa

SEQ ID NO: 109129 - DNA, 573 bp, Homo sapiens
  Payload ID: 1438
  Gene Symbol: ASNS
  Gene Name: asparagine synthetase (glutamine-hydrolyzing)
  ENST ID: ENST00000453600
  CDS Start-End: 385-573
aagctgtccacatccctggcctcagcccgccacatcaccctgacctgcttacgcccagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagagattttcttcaatcacatctgaataaatcacttgaagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaaggtg

SEQ ID NO: 109130 - DNA, 584 bp, Homo sapiens
  Payload ID: 1438
  Gene Symbol: ASNS
  Gene Name: asparagine synthetase (glutamine-hydrolyzing)
  ENST ID: ENST00000414884
  CDS Start-End: 500-584
acgcacctgacagctagcggaaggacctttctgtcctggttccctgaagcatcgagagggaaccgcggccggcaggccggaccgctccggagaggaggcagcggcagtttgagcccctgtaaatgttatatgtgtacttttttttactatgtggcgtcgaagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtc

SEQ ID NO: 109131 - DNA, 1638 bp, Homo sapiens
  Payload ID: 1438
  Gene Symbol: ASNS
  Gene Name: asparagine synthetase (glutamine-hydrolyzing)
  Uniprot ID: P08243
  ENST ID: ENST00000437628
  CDS Start-End: 74-1510
gaagcatcgagagggaaccgcggccggcaggccggaccgctccggagaggaggcagcggcagtttgagcccctatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatct

SEQ ID NO: 109132 - DNA, 1865 bp, Homo sapiens
  Payload ID: 1438
  Gene Symbol: ASNS
  Gene Name: asparagine synthetase (glutamine-hydrolyzing)
  Uniprot ID: P08243
  ENST ID: ENST00000422745
  CDS Start-End: 130-1752
ttcccgcacgcgttacaggagccaggtcggtataagcgccagcggcctcgccgcccgtcaagctgtccacatccctggcctcagcccgccacatcaccctgacctgcttacgcccagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaat

SEQ ID NO: 109133 - DNA, 2450 bp, Homo sapiens
  Payload ID: 1439
  Gene Symbol: ASNSD1
  Gene Name: asparagine synthetase domain containing 1
  Uniprot ID: Q9NWL6
  ENST ID: ENST00000260952
  CDS Start-End: 414-2345
aaaagaaagggtgagcgcggctggaagcgcgcatgcgctgtggctaatgccgtaggctccttcagggctgagccatcccgcgtgtcttgcgctcggtggaaatgcccagccgagggacgcgaccagaggacagctctgtgctgatccccaccgacaattcgaccccacacaaggaggatctaagcagcaagattaaagaacaaaaaattgtggtggatgaactttctaaccttaagaagaataggaaagtatataggcaacaacagaacagcaatatattctttcttgcagaccgaacagaaatgctgtctgagagcaagaatatattggatgaactgaaaaaagaataccaagaaatagaaaacttagacaagaccaaaatcaagaaatagtcaacctgatttcacataacaatgtgtggcatttgttgttctgtaaacttttctgctgagcatttcagtcaagatttaaaagaggacttactatataatcttaaacagcggggacccaatagtagtaaacaattgttaaagtctgatgttaactaccagtgtttattttctgctcacgtcctacacttgaggggtgttttgactacccagcctgtggaagatgaaagaggcaatgtgtttctatggaatggagaaatttttagtggaataaaggttgaagctgaagagaatgacactcaaattttgtttaattatctttcctcctgtaagaatgaatctgagattttgtcactcttctcagaagtacaaggtccctggtcatttatatattatcaagcatctagtcattatttatggtttggtagggatttttttggtcgccgtagcttgctttggcattttagtaatttgggcaagagtttctgcctctcttcagttggcacccaaacatctggattggcaaatcagtggcaagaagttccagcatctggacttttcagaattgatcttaagtctactgtcatttccggatgcattattttacaactgtatccttggaaatatatttctagggagaatattattgaagaaaatgttaatagcctgagtcaaatttcagcagacttaccagcatttgtatcagtggtagcaaatgaagccaaactgtatcttgaaaaacctgttgttcctttaaatatgatgttgccacaagctgcattggagactcattgcagtaatatttccaatgtgccacctacaagagagatacttcaagtctttcttactgatgtacacatgaaggaagtaattcagcagttcattgatgtcctgagtgtagcagtcaagaaacgtgtcttgtgtttacctagggatgaaaacctgacagcaaatgaagttttgaaaacgtgtgataggaaagcaaatgttgcaatcctgttttctgggggcattgattccatggttattgcaacccttgctgaccgtcatattcctttagatgaaccaattgatcttcttaatgtagctttcatagctgaagaaaagaccatgccaactacctttaacagagaagggaataaacagaaaaataaatgtgaaataccttcagaagaattctctaaagatgttgctgctgctgctgctgacagtcctaataaacatgtcagtgtaccagatcgaatcacaggaagggcgggactaaaggaactacaagctgttagcccttcccgaatttggaattttgttgaaattaatgtttctatggaagaactgcagaaattaagaagaactcgaatatgtcacttaattcggccattggatacagttttggatgatagcattggctgtgcagtctggtttgcttctagaggaattggttggttagtggcccaggaaggagtgaaatcctatcagagcaatgcaaaggtagttctcactggaattggtgcagatgagcaacttgcaggttattctcgtcatcgtgtccgctttcagtcgcatgggctggaaggattgaataaggaaataatgatggaactgggtcgaatttcttctagaaatcttggtcgtgatgacagagttattggtgatcatggaaaagaagcaagatttcctttcctggatgaaaatgttgtctcctttctaaattctctgccgatttgggaaaaagcaaacttgactttaccccgaggaattggtgaaaaattacttttacgccttgcagctgtggaacttggtcttacagcctctgctcttctgcccaaacgggccatgcagtttggatcaagaattgcaaaaatggaaaaaattaatgaaaaggcatctgataaatgtggacggctccaaatcatgtccttagaaaatctttctattgaaaaggagactaaattgtaatgtgattcacaatgtaacaatataaaaataagtttttatataattatataaaagtaagatactctgctgctttactattgtataacatagtagttttaaagttca

SEQ ID NO: 109134 - DNA, 567 bp, Homo sapiens
  Payload ID: 1439
  Gene Symbol: ASNSD1
  Gene Name: asparagine synthetase domain containing 1
  ENST ID: ENST00000425590
  CDS Start-End: 349-567
gctggaagcgcgcatgcgctgtggctaatgccgtaggctccttcagggctgagccatcccgcgtgtcttgcgctcggtggaaatgcccagccgagggacgcgaccagaggacagctctgtgctgatccccaccgacaattcgaccccacacaaggaggatctaagcagcaagattaaagaacaaaaaattgtggtggatgaactttctaaccttaagaagaataggaccgaacagaaatgctgtctgagagcaagaatatattggatgaactgaaaaaagaataccaagaaatagaaaacttagacaagaccaaaatcaagaaatagtcaacctgatttcacataacaatgtgtggcatttgttgttctgtaaacttttctgctgagcatttcagtcaagatttaaaagaggacttactatataatcttaaacagcggggacccaatagtagtaaacaattgttaaagtctgatgttaactaccagtgtttattttctgctcacgtcctacacttgaggggtgttttgactacccagcctgtggaagatgaaagaggcaatgtgttt

SEQ ID NO: 109135 - DNA, 2172 bp, Homo sapiens
  Payload ID: 1439
  Gene Symbol: ASNSD1
  Gene Name: asparagine synthetase domain containing 1
  ENST ID: ENST00000420250
  CDS Start-End: 317-2172
ctaatgccgtaggctccttcagggctgagccatcccgcgtgtcttgcgctcggtggaaatgcccagccgagggacgcgaccagaggacagctctgtgctgatccccaccgacaattcgaccccacacaaggaggatctaagcagcaagaaagtatataggcaacaacagaacagcaatatattctttcttgcagaccgaacagaaatgctgtctgagagcaagaatatattggatgaactgaaaaaagaataccaagaaatagaaaacttagacaagaccaaaatcaagaaatagtcaacctgatttcacataacaatgtgtggcatttgttgttctgtaaacttttctgctgagcatttcagtcaagatttaaaagaggacttactatataatcttaaacagcggggacccaatagtagtaaacaattgttaaagtctgatgttaactaccagtgtttattttctgctcacgtcctacacttgaggggtgttttgactacccagcctgtggaagatgaaagaggcaatgtgtttctatggaatggagaaatttttagtggaataaaggttgaagctgaagagaatgacactcaaattttgtttaattatctttcctcctgtaagaatgaatctgagattttgtcactcttctcagaagtacaaggtccctggtcatttatatattatcaagcatctagtcattatttatggtttggtagggatttttttggtcgccgtagcttgctttggcattttagtaatttgggcaagagtttctgcctctcttcagttggcacccaaacatctggattggcaaatcagtggcaagaagttccagcatctggacttttcagaattgatcttaagtctactgtcatttccggatgcattattttacaactgtatccttggaaatatatttctagggagaatattattgaagaaaatgttaatagcctgagtcaaatttcagcagacttaccagcatttgtatcagtggtagcaaatgaagccaaactgtatcttgaaaaacctgttgttcctttaaatatgatgttgccacaagctgcattggagactcattgcagtaatatttccaatgtgccacctacaagagagatacttcaagtctttcttactgatgtacacatgaaggaagtaattcagcagttcattgatgtcctgagtgtagcagtcaagaaacgtgtcttgtgtttacctagggatgaaaacctgacagcaaatgaagttttgaaaacgtgtgataggaaagcaaatgttgcaatcctgttttctgggggcattgattccatggttattgcaacccttgctgaccgtcatattcctttagatgaaccaattgatcttcttaatgtagctttcatagctgaagaaaagaccatgccaactacctttaacagagaagggaataaacagaaaaataaatgtgaaataccttcagaagaattctctaaagatgttgctgctgctgctgctgacagtcctaataaacatgtcagtgtaccagatcgaatcacaggaagggcgggactaaaggaactacaagctgttagcccttcccgaatttggaattttgttgaaattaatgtttctatggaagaactgcagaaattaagaagaactcgaatatgtcacttaattcggccattggatacagttttggatgatagcattggctgtgcagtctggtttgcttctagaggaattggttggttagtggcccaggaaggagtgaaatcctatcagagcaatgcaaaggtagttctcactggaattggtgcagatgagcaacttgcaggttattctcgtcatcgtgtccgctttcagtcgcatgggctggaaggattgaataaggaaataatgatggaactgggtcgaatttcttctagaaatcttggtcgtgatgacagagttattggtgatcatggaaaagaagcaagatttcctttcctggatgaaaatgttgtctcctttctaaattctctgccgatttgggaaaaagcaaacttgactttaccccgaggaattggtgaaaaattacttttacgccttgcagctgtggaacttggtcttacagcctctgctcttctgcccaaacgggccatgcagtttggatcaagaattgcaaaaatggaaaaaattaatgaaaa

SEQ ID NO: 109136 - DNA, 581 bp, Homo sapiens
  Payload ID: 1439
  Gene Symbol: ASNSD1
  Gene Name: asparagine synthetase domain containing 1
  ENST ID: ENST00000607829
  CDS Start-End: 1-291
atgcccagccgagggacgcgaccagaggacagctctgtgctgatccccaccgacaattcgaccccacacaaggaggatctaagcagcaagattaaagaacaaaaaattgtggtggatgaactttctaaccttaagaagaataggaaagtatataggcaacaacagaacagcaatatattctttcttgcagaccgaacagaaatgctgtctgagagcaagaatatattggatgaactgaaaaaagaataccaagaaatagaaaacttagacaagaccaaaatcaagaaatagtcaacctgatttcacataacaatgtgtggcatttgttgttctgtaaacttttctgctgagcatttcagtcaagatttaaaagaggacttactatataatcttaaacagcggggacccaatagtagtaaacaattgttaaagtctgatgttaactaccagtgtttattttctgctcacgtcctacacttgaggggtgttttgactacccagcctgtggaagatgaaagaggcaatgtgtttctatggaatggagaaatttttagtggaataaaggttgaagctgaagagaa

SEQ ID NO: 109137 - DNA, 535 bp, Homo sapiens
  Payload ID: 1439
  Gene Symbol: ASNSD1
  Gene Name: asparagine synthetase domain containing 1
  ENST ID: ENST00000607690
  CDS Start-End: 1-192
atgcccagccgagggacgcgaccagaggacagctctgtgctgatccccaccgacaattcgaccccacacaaggaggatctaagcagcaagattaaagaacaaaaaattgtggtggatgaactttctaaccttaagaagaataggaccgaacagaaatgctgtctgagagcaagaatatattggatgaactgaaaaaagaataccaagaaatagaaaacttagacaagaccaaaatcaagaaatagtcaacctgatttcacataacaatgtgtggcatttgttgttctgtaaacttttctgctgagcatttcagtcaagatttaaaagaggacttactatataatcttaaacagcggggacccaatagtagtaaacaattgttaaagtctgatgttaactaccagtgtttattttctgctcacgtcctacacttgaggggtgttttgactacccagcctgtggaagatgaaagaggcaatgtgtttctatggaatggagaaatttttagtggaataaaggttgaagctgaagagaa

SEQ ID NO: 109138 - DNA, 579 bp, Homo sapiens
  Payload ID: 1439
  Gene Symbol: ASNSD1
  Gene Name: asparagine synthetase domain containing 1
  ENST ID: ENST00000607535
  CDS Start-End: 63-200
gtggctaatgccgtaggctccttcagggctgagccatcccgcgtgtcttgcgctcggtggaaatgcccagccgagggacgcgaccagaggacagctctgtgctgatccccaccgacaattcgaccccacacaaggaggatctaagcagcaagaccgaacagaaatgctgtctgagagcaagaatatattggatgaactgaaaaaagaataccaagaaatagaaaacttagacaagaccaaaatcaagaaatagtcaacctgatttcacataacaatgtgtggcatttgttgttctgtaaacttttctgctgagcatttcagtcaagatttaaaagaggacttactatataatcttaaacagcggggacccaatagtagtaaacaattgttaaagtctgatgttaactaccagtgtttattttctgctcacgtcctacacttgaggggtgttttgactacccagcctgtggaagatgaaagaggcaatgtgtttctatggaatggagaaatttttagtggaataaaggttgaagctgaagagaatgacactcaaattttgtttaattatctttcctcctg

SEQ ID NO: 109139 - DNA, 968 bp, Homo sapiens
  Payload ID: 1439
  Gene Symbol: ASNSD1
  Gene Name: asparagine synthetase domain containing 1
  ENST ID: ENST00000607062
  CDS Start-End: 449-937
gtgagcgcgcagacgctattggtaagactcgcgggaaaagaaagggtgagcgcggctggaagcgcgcatgcgctgtggctaatgccgtaggctccttcagggctgagccatcccgcgtgtcttgcgctcggtggaaatgcccagccgagggacgcgaccagaggacagctctgtgctgatccccaccgacaattcgaccccacacaaggaggatctaagcagcaagattaaagaacaaaaaattgtggtggatgaactttctaaccttaagaagaataggaaagtatataggcaacaacagaacagcaatatattctttcttgcagaccgaacagaaatgctgtctgagagcaagaatatattggatgaactgaaaaaagaataccaagaaatagaaaacttagacaagaccaaaatcaagaaatagtcaacctgatttcacataacaatgtgtggcatttgttgttctgtagttctcactggaattggtgcagatgagcaacttgcaggttattctcgtcatcgtgtccgctttcagtcgcatgggctggaaggattgaataaggaaataatgatggaactgggtcgaatttcttctagaaatcttggtcgtgatgacagagttattggtgatcatggaaaagaagcaagatttcctttcctggatgaaaatgttgtctcctttctaaattctctgccgatttgggaaaaagcaaacttgactttaccccgaggaattggtgaaaaattacttttacgccttgcagctgtggaacttggtcttacagcctctgctcttctgcccaaacgggccatgcagtttggatcaagaattgcaaaaatggaaaaaattaatgaaaaggcatctgataaatgtggacggctccaaatcatgtccttagaaaatctttctattgaaaaggagactaaattgtaatgtgattcacaatgtaacaatataaaaataa

SEQ ID NO: 109140 - DNA, 741 bp, Homo sapiens
  Payload ID: 1439
  Gene Symbol: ASNSD1
  Gene Name: asparagine synthetase domain containing 1
  ENST ID: ENST00000606910
  CDS Start-End: 3-741
aaatgcccagccgagggacgcgaccagaggacagctctgtgctgatccccaccgacaattcgaccccacacaaggaggatctaagcagcaagattaaagaacaaaaaattgtggtggatgaactttctaaccttaagaagaataggaaagtatataggcaacaacagaacagcaatatattctttcttgcagaccgaacagaaatgctgtctgagagcaagactttcatagctgaagaaaagaccatgccaactacctttaacagagaagggaataaacagaaaaataaatgtgaaataccttcagaagaattctctaaagatgttgctgctgctgctgctgacagtcctaataaacatgtcagtgtaccagatcgaatcacaggaagggcgggactaaaggaactacaagctgttagcccttcccgaatttggaattttgttgaaattaatgtttctatggaagaactgcagaaattaagaagaactcgaatatgtcacttaattcggccattggatacagttttggatgatagcattggctgtgcagtctggtttgcttctagaggaattggttggttagtggcccaggaaggagtgaaatcctatcagagcaatgcaaaggtagttctcactggaattggtgcagatgagcaacttgcaggttattctcgtcatcgtgtccgctttcagtcgcatgggctggaaggattgaataaggaaataatgatggaactgggtc

SEQ ID NO: 109141 - DNA, 573 bp, Homo sapiens
  Payload ID: 1439
  Gene Symbol: ASNSD1
  Gene Name: asparagine synthetase domain containing 1
  ENST ID: ENST00000605941
  CDS Start-End: 70-243
atgcgctgtggctaatgccgtaggctccttcagggctgagccatcccgcgtgtcttgcgctcggtggaaatgcccagccgagggacgcgaccagaggacagctctgtgctgatccccaccgacaattcgaccccacacaaggaggatctaagcagcaagattaaagaacaaaaaattgtggtggatgaactttctaaccttaagaagaataggcctaaattatgttttccagaaagtatataggcaacaacagaacagcaatatattctttcttgcagaccgaacagaaatgctgtctgagagcaagaatatattggatgaactgaaaaaagaataccaagaaatagaaaacttagacaagaccaaaatcaagaaatagtcaacctgatttcacataacaatgtgtggcatttgttgttctgtaaacttttctgctgagcatttcagtcaagatttaaaagaggacttactatataatcttaaacagcggggacccaatagtagtaaacaattgttaaagtctgatgttaactaccagtgtttattttctgctcacgtcctacacttgagggg

SEQ ID NO: 109142 - DNA, 3099 bp, Homo sapiens
  Payload ID: 1440
  Gene Symbol: NARS
  Gene Name: asparaginyl-tRNA synthetase
  Uniprot ID: O43776
  ENST ID: ENST00000256854
  CDS Start-End: 457-2103
aaccagcctccaccatctggggatcggggcgacatccttggtctggtttgcaagaggacccgcacgcctccagctggggcggaattggaagattcagaaaggaaagttggggaggcggggaaggaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcaggcgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtaccttgaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaactc

SEQ ID NO: 109143 - DNA, 937 bp, Homo sapiens
  Payload ID: 1440
  Gene Symbol: NARS
  Gene Name: asparaginyl-tRNA synthetase
  Uniprot ID: O43776
  ENST ID: ENST00000540592
  CDS Start-End: 76-600
ggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaagtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctg

SEQ ID NO: 109144 - DNA, 562 bp, Homo sapiens
  Payload ID: 1440
  Gene Symbol: NARS
  Gene Name: asparaginyl-tRNA synthetase
  ENST ID: ENST00000587194
  CDS Start-End: 76-562
ggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaagtgtcagtgctacaatggagttctcttgtccacggagagcagtgttgcagtgtatggaatgctaaat

SEQ ID NO: 109145 - DNA, 1608 bp, Homo sapiens
  Payload ID: 1440
  Gene Symbol: NARS
  Gene Name: asparaginyl-tRNA synthetase
  ENST ID: ENST00000586807
  CDS Start-End: 69-479
gttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattca

SEQ ID NO: 109146 - DNA, 1002 bp, Homo sapiens
  Payload ID: 1440
  Gene Symbol: NARS
  Gene Name: asparaginyl-tRNA synthetase
  ENST ID: ENST00000587675
  CDS Start-End: 618-1002
gtctcgcagctggcgcggtgtttgctggtgacatgaactcaaccagcctccaccatctggggatcggggcgacatccttggtctggtttgcaagaggacccgcacgcctccagctggggcggaattggaagattcagaaaggaaagttggggaggcggggaaggaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcaggcgccctcagatctacgctctctgatgcaacgccggaatcgcggaaaccgccggtgcacgttggagtcataagacggcgtcggtgttgcagtctgtgtccttggaggtgaccagggccactgcaggcatggtgctaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtg

SEQ ID NO: 109147 - DNA, 463 bp, Homo sapiens
  Payload ID: 1440
  Gene Symbol: NARS
  Gene Name: asparaginyl-tRNA synthetase
  ENST ID: ENST00000590123
  CDS Start-End: 21-164
tgaccagggccactgcaggcatggtgctagagctgtacgtctctgaccgagagggaagcgatgccacgggagatggaaccaaggagaaaccatttaaaacaggtctaaagtattgtacaatgttcaagaactgtcttttctctcctccctacccaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgg

SEQ ID NO: 109148 - DNA, 582 bp, Homo sapiens
  Payload ID: 1440
  Gene Symbol: NARS
  Gene Name: asparaginyl-tRNA synthetase
  ENST ID: ENST00000588661
  CDS Start-End: 93-582
tctgatgcaacgccggaatcgcggaaaccgccggtgcacgttggagtcataagacggcgtcggtgttgcagtctgtgtccttggaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtg

SEQ ID NO: 109149 - DNA, 584 bp, Homo sapiens
  Payload ID: 1440
  Gene Symbol: NARS
  Gene Name: asparaginyl-tRNA synthetase
  ENST ID: ENST00000591599
  CDS Start-End: 84-584
aaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggc

SEQ ID NO: 109150 - DNA, 2519 bp, Homo sapiens
  Payload ID: 1441
  Gene Symbol: NARS2
  Gene Name: asparaginyl-tRNA synthetase 2, mitochondrial (putative)
  Uniprot ID: Q96I59
  ENST ID: ENST00000281038
  CDS Start-End: 377-1810
gtagcgtgatgacgtaagcggcgttggcgtggtgtggtaggagtggttgcgcgtgttgcggcccgggttctgttcgtaggtttacaattgtcgcgggtagtggggcgccccagctgccaactgcacgtggtttctttctggcgtttgcctagtgtcctgtccattccgccccgttgggaagtgggaagcggagaggttctgtggggacagagctgggagtcctgaaggagaaagcgcgcagccgaggggctctggagtgccttagagcagagctgcggccgcggaaggggagcagctgagaaaggagggccgctgcaggcggggttcgaaccgtggggtctgggctgctcccgcggagggcctgggcggacgcgggatgctgggggtccgctgcctgctgcggtccgtgcgcttctgttcctccgcccccttccccaagcacaaaccttcagccaaactgagcgtgcgggacgctctcggggctcagaacgcgagtggggagcgcattaagatccagggatggattcgttctgtccgatcccagaaggaagtcttgttcctgcatgtaaatgatgggtcatctttggaaagccttcaggttgttgcagattcaggccttgacagtagagaattaaattttgggagttctgtggaagtacaagggcagctgataaaaagtccatccaaaaggcaaaatgtggaactgaaggcagaaaaaattaaagttattggaaattgtgatgccaaggatttccccatcaaatataaagagaggcatcctctggagtatctgcgacaatatcctcactttaggtgtaggactaacgttctgggttctatattgaggattcgcagtgaagcgacagctgctattcattctttctttaaggacagtggctttgtacatattcatactccaataatcacatccaatgactctgagggagctggagaactttttcaacttgaaccttcaggcaaacttaaggtacctgaggagaatttcttcaatgttcctgctttcttaactgtctcaggacaacttcatctagaagtgatgtcaggagcttttactcaagtgtttacctttggtccgaccttccgagctgaaaattctcagagccggaggcacctggcagagttttatatgatagaagcagagatttcttttgttgacagccttcaagatcttatgcaggttatagaggaactgttcaaggctacaacaatgatggttctctcaaaatgtcctgaagatgttgaactctgtcacaaattcatagcacctggccaaaaggacagattagaacatatgctaaaaaacaactttttaatcatttcttatactgaagcagtggagatcttaaagcaagcatcccagaacttcacctttaccccagagtggggtgctgacctacggactgaacatgaaaagtacctggtgaagcactgtggcaacatacctgtcttcgttattaattatccattaacactcaagcctttctacatgagggataatgaagatggccctcagcacacggttgctgctgttgatcttctggttcctggagttggggaactctttggaggaggcctcagagaagaacgataccatttcttagaggagcgcttagccagatcgggacttacagaagtctaccaatggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttttctcccttgccatatactttgtgataaatccttatctcattttcagtacttcattaaacattgcagaaaaaaatattccttaaggtcttaattgatttaaagaagtagctattctgaattgaaatctcctttcattgaactggatgaaaaaatcatgtttaataactgttgcttttcaattttcaaagctgttgagatattacattaagtatttcaactctttaatcactgttgttataatttgtttatatttgatgtttataatttgtctaataaaatagatttttttaatagacacctatgg

SEQ ID NO: 109151 - DNA, 755 bp, Homo sapiens
  Payload ID: 1441
  Gene Symbol: NARS2
  Gene Name: asparaginyl-tRNA synthetase 2, mitochondrial (putative)
  ENST ID: ENST00000529880
  CDS Start-End: 31-755
gctcccgcggagggcctgggcggacgcgggatgctgggggtccgctgcctgctgcggtccgtgcgcttctgttcctccgcccccttccccaagcacaaaccttcagccaaactgagcgtgcgggacgctctcggggctcagaacgcgagtggggagcgcattaagatccagggatggattcgttctgtccgatcccagaaggaagtcttgttcctgcatgtaaatgatgggtcatctttggaaagccttcaggttgttgcagattcaggccttgacagtagagaattaaattttgggagttctgtggaagtacaagggcagctgataaaaagtccatccaaaaggcaaaatgtggaactgaaggcagaaaaaattaaagttattggaaattgtgatgccaaggatttccccatcaaatataaagagaggcatcctctggagtatctgcgacaatatcctcactttaggtgtaggactaacgttctgggttctatattgaggattcgcagtgaagcgacagctgctattcattctttctttaaggacagtggctttgtacatattcatactccaataatcacatccaatgactctgagggagctggagaactttttcaacttgaatggggtgctgacctacggactgaacatgaaaagtacctggtgaagcactgtggcaacatacctgtcttcgttattaattatccattaacactcaagcctttctacatgagggataatgaagatggccctca

SEQ ID NO: 109152 - DNA, 2137 bp, Homo sapiens
  Payload ID: 1441
  Gene Symbol: NARS2
  Gene Name: asparaginyl-tRNA synthetase 2, mitochondrial (putative)
  Uniprot ID: Q96I59
  ENST ID: ENST00000528850
  CDS Start-End: 938-1690
agggtctagctctgtcacccagactggagcgcagtgatgtgatctcagatgactacaacctccatctcccaggctcaagcaatcctcctgcctcggcctccagagtagctgaaactataggcatgcaccaccacactctataattttttaagttttttgtgaagatgagtctcactgtattgcccaggctggtctcaaactcctggactcaagcagtcctcctccttcggcatcccaaaatgctgggattacaggcataagcctggtagatgttgttataataaatacttattttttgagtaggttcttgctttgtcacccatgattgtactgacacagtcatggcttgccgttgcagtgatttctgttgtcctcacatatcctttactttttagcgggatggattcgttctgtccgatcccagaaggaagtcttgttcctgcatgtaaatgatgggtcatctttggaaagccttcaggttgttgcagattcaggccttgacagtagagaattaaattttgggagttctgtggaagtacaagggcagctgataaaaagtccatccaaaaggcaaaatgtggaactgaaggcagaaaaaattaaagttattggaaattgtgatgccaaggatttccccatcaaatataaagagaggcatcctctggagtatctgcgacaatatcctcactttaggtgtaggactaacgttctgggttctatattgaggattcgcagtgaagcgacagctgctattcattctttctttaaggacagtggctttgtacatattcatactccaataatcacatccaatgactctgagggagctggagaactttttcaacttgaaccttcaggcaaacttaaggtacctgaggagaatttcttcaatgttcctgctttcttaactgtctcaggacaacttcatctagaagtgatgtcaggagcttttactcaagtgtttacctttggtccgaccttccgagctgaaaattctcagagccggaggcacctggcagagttttatatgatagaagcagagatttcttttgttgacagccttcaagatcttatgcaggttatagaggaactgttcaaggctacaacaatgatggttctctcaaaatgtcctgaagatgttgaactctgtcacaaattcatagcacctggccaaaaggacagattagaacatatgctaaaaaacaactttttaatcatttcttatactgaagcagtggagatcttaaagcaagcatcccagaacttcacctttaccccagagtggggtgctgacctacggactgaacatgaaaagtacctggtgaagcactgtggcaacatacctgtcttcgttattaattatccattaacactcaagcctttctacatgagggataatgaagatggccctcagcacacggttgctgctgttgatcttctggttcctggagttggggaactctttggaggaggcctcagagaagaacgataccatttcttagaggagcgcttagccagatcgggacttacagaagtctaccaatggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttttctcccttgccatatactttgtgataaatccttatctcattt

SEQ ID NO: 109153 - DNA, 594 bp, Homo sapiens
  Payload ID: 1441
  Gene Symbol: NARS2
  Gene Name: asparaginyl-tRNA synthetase 2, mitochondrial (putative)
  ENST ID: ENST00000529571
  CDS Start-End: 587-594
cttcttccccgtagcgtgatgacgtaagcggcgttggcgtggtgtgggatggattcgttctgtccgatcccagaaggaagtcttgttcctgcatgtaaatgatgggtcatctttggaaagccttcaggttgttgcagattcaggccttgacagtagagaattaaattttgggagttctgtggaagtacaagggcagctgataaaaagtccatccaaaaggcaaaatgtggaactgaaggcagaaaaaattaaagttattggaaattgtgatgccaaggatttccccatcaaatataaagagaggcatcctctggagtatctgcgacaatatcctcactttaggtgtaggactaacgttctgggttctatattgaggattcgcagtgaagcgacagctgctattcattctttctttaaggacagtggctttgtacatattcatactccaataatcacatccaatgactctgagggagctggagaactttttcaacttgaaccttcaggcaaacttaaggtacctgaggagaatttcttcaatgttcctgctttcttaactgtctcaggacaacttcatctagaagtgatgtcagg

SEQ ID NO: 109154 - DNA, 725 bp, Homo sapiens
  Payload ID: 1441
  Gene Symbol: NARS2
  Gene Name: asparaginyl-tRNA synthetase 2, mitochondrial (putative)
  ENST ID: ENST00000529771
  CDS Start-End: 1-244
ggttgctgctgttgatcttctggttcctggagttggggaactctttggaggaggcctcagagaagaacgataccatttcttagaggagcgcttagccaggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttttctcccttgccatatactttgtgataaatccttatctcattttcagtacttcattaaacattgcagaaaaaaatat

SEQ ID NO: 109155 - DNA, 861 bp, Homo sapiens
  Payload ID: 1441
  Gene Symbol: NARS2
  Gene Name: asparaginyl-tRNA synthetase 2, mitochondrial (putative)
  ENST ID: ENST00000525345
  CDS Start-End: 1-319
ccccatcaaatataaagagaggcatcctctggagtatctgcgacaatatcctcactttaggtgtaggactaacgttctgggttctatattgaggattcgcagtgaagcgacagctgctattcattctttctttaaggacagtggctttgtacatattcatactccaataatcacatccaatgactctgagggagctggagaactttttcaacttgaaccttcaggcaaacttaaggtacctgaggagaatttcttcaatgttcctgctttcttaactgtctcaggacaacttcatctagaagtgatgtcagggttatagaggaactgttcaaggctacaacaatgatggttctctcaaaatgtcctgaagatgttgaactctgtcacaaattcatagcacctggccaaaaggacagattagaacatatgctaaaaaacaactttttaatcatttcttatactgaagcagtggagatcttaaagcaagcatcccagaacttcacctttaccccagagtggggtgctgacctacggactgaacatgaaaagtacctggtgaagcactgtggcaacatacctgtcttcgttattaattatccattaacactcaagcctttctacatgagggataatgaagatggccctcagcacacggttgctgctgttgatcttctggttcctggagttggggaactctttggaggaggcctcagagaagaacgataccatttcttagaggagcgcttagccagatcgggacttacagaagtctaccaatggtatctggaccttcgtcgatttggatctgtgccacatggaggttttgggatgggatttgaacgctacctgcagtgcatcttg

SEQ ID NO: 109156 - DNA, 3730 bp, Homo sapiens
  Payload ID: 1442
  Gene Symbol: ASPH
  Gene Name: aspartate beta-hydroxylase
  Uniprot ID: Q12797
  ENST ID: ENST00000356457
  CDS Start-End: 226-1167
agggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggttcccgcgtcgcgtgtgtacccccgcgcactgaaggaggtccgccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaatttttgtagcttttagctgattaattagaaaaatttaatatttcagtgaaagttttaaattatcatttatttatttttttaaatgagaggggaaagctgaaattccttgttaagacacaaggaaaaagaatggccctactattatcatgcaaaaatgctttgttggcacctcagattaatcatataatagctatagtctcttcagcatttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaagctcacagagcccgatgcctgctgctatttcacggcaatgagcctttttctttctacactgaagattttcttcttatttaatgtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatgtagtgagtcctgcatgggtactcgatgtgtaatgaaacctgaaataataagataataagaaaagcaataattttctaaagctgtgctgtcggtgatacagagatgatactcaaattataataaaactcttcattttgtgaattatagaagctactttttataaagccatatttttttagggaaactaaggagtgacatagaactgatgaatgagtaaaagtaagttttgctggatttttgtagaactctggacgttgaggattcattatgctgtggttaactttaaatatttttgaattccaaatatctgaattaatgagccttgtctttacaaatatgtgccattgtgcaacatcggtggattttctaaaaataatgtaaatgtcttctattaaatgttgagtgcaataaaatacagaagaattctctatattgtcattatttttgaagtataaggtatttttaatttgttacataataaaatcagttcattttatccttactagtattttagaagattatagcatttttgataactaaaatcacaaaggaataccttcagccagttaacgtatttctaacagataatgcttattttgcatttactatcatgctacattgccaggaagcaagattaaaattaaatagcccctgcagccatcctttgtagattttgtcctgcacctagaagttttgattattccctggacagcctgctccaccttttttccccaaatttttaatttttgtgagtatataatagatgtataaatttgactatatgagatatttcgatacagatatagaaaatgtacaataaattattgttggctatagtaactctgttttgctatcaaatactagatcttattcattgtatataactatatttttgtacccattaaccatcttcacctcctgctcccctctcccctcactacccttcccaacctctggtaaccatccttctaccctctacctctgtgagttcaattgttttaatttttagcacccacaaattagtgagaacatgtgatgtttatctttctgtgcctggcttatttcacctaacataatgacctccagttccatccatgttgtttcaaatggcaggatcttattcttttttatggctgagtagtactccattatatatgtaccacattttcttcattcgtctgttgacagacccttaagttgattccaaagcttagctattgtaaatagtgcaataaacatgagagtgcgtaaattt

SEQ ID NO: 109157 - DNA, 1603 bp, Homo sapiens
  Payload ID: 1442
  Gene Symbol: ASPH
  Gene Name: aspartate beta-hydroxylase
  Uniprot ID: Q12797
  ENST ID: ENST00000379449
  CDS Start-End: 176-787
cgggtgaagtcttcccaggtgctgcaggcggtgctgaggcacagggtctgctgcaggagcagcggcccgaacccgctccagcggcccgccgccgccagcggttcccgcgtcgcgtgtgtacccccgcgcactgaaggaggtccgccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggcctgaccaaagatggcagtaatgaaaatattgattctcttgaggaagtccttaatattttagcagaggaaagttcagattggttttatggtttcctctcatttctctatgatataatgactccttttgaaatgctagaagaagaagaagaagaaagcgaaaccgcagatggtgttgatggtacgtcacagaatgaaggggttcagggaaagacttgtgtcatattggatttacataaccagtaaccttgattcagggactgaagtcattggctaatgaacacctgaagcagcctcctttttcttttctttccttggcttatgcagggcttaatgtgcagtggggtggttgtgatcttaccgtgcaagtcaaccatgtgatcttgcccagtacagctactagctagtcccttgctcgctcagctcccccaacttctattgaagaaaatggtactcctcattcttgtagtcagctacaaagtacactgaaaatgatgttcttggtggtataattggtttctgtatcgttttgtttcaactcatgtattcactgaactaaatttggacacttaacagcaaattgtgttgtggttaacccttgatgcttgtctttctaacacactattaattatgatgattctaatggatttcattataaaaatatttctggcatgatttttaagttaaatgcttctctgttctttaacatgactgatgtataaaatgatggttctttactaagctgatattttttattgtaatttgtttaggtttgtcagataggttcatacaaatttctatgtaaaattctgtgttaatggtgcttttaaaataatttaaaaataactccatgtttttgccttagagtaagttaacttactgttttcagatagtagcatgacatatttctgtctgtgaaagcaaaatttattttaaattttatttccaaatatacatccagagaaagtaatttgtattttttttaaagtaggcatattacacaagagggaacatgtgaatatgtatcttaatgttgtacatattaaaattattcatcctaaa

SEQ ID NO: 109158 - DNA, 5268 bp, Homo sapiens
  Payload ID: 1442
  Gene Symbol: ASPH
  Gene Name: aspartate beta-hydroxylase
  Uniprot ID: Q12797
  ENST ID: ENST00000379454
  CDS Start-End: 189-2465
cgcagccggcaggcgggtgaagtcttcccaggtgctgcaggcggtgctgaggcacagggtctgctgcaggagcagcggcccgaacccgctccagcggcccgccgccgccagcggttcccgcgtcgcgtgtgtacccccgcgcactgaaggaggtccgccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaaacaaatagaaaaacagatgatccagaacaaaaagcaaaagttaagaaaaagaagcctaaacttttaaataaatttgataagactattaaagctgaacttgatgctgcagaaaaactccgtaaaaggggaaaaattgaggaagcagtgaatgcatttaaagaactagtacgcaaataccctcagagtccacgagcaagatatgggaaggcgcagtgtgaggatgatttggctgagaagaggagaagtaatgaggtgctacgtggagccatcgagacctaccaagaggtggccagcctacctgatgtccctgcagacctgctgaagctgagtttgaagcgtcgctcagacaggcaacaatttctaggtcatatgagaggttccctgcttaccctgcagagattagttcaactatttcccaatgatacttccttaaaaaatgaccttggcgtgggatacctcttgataggagataatgacaatgcaaagaaagtttatgaagaggtgctgagtgtgacacctaatgatggctttgctaaagtccattatggcttcatcctgaaggcacagaacaaaattgctgagagcatcccatatttaaaggaaggaatagaatccggagatcctggcactgatgatgggagattttatttccacctgggggatgccatgcagagggttgggaacaaagaggcatataagtggtatgagcttgggcacaagagaggacactttgcatctgtctggcaacgctcactctacaatgtgaatggactgaaagcacagccttggtggaccccaaaagaaacgggctacacagagttagtaaagtctttagaaagaaactggaagttaatccgagatgaaggccttgcagtgatggataaagccaaaggtctcttcctgcctgaggatgaaaacctgagggaaaaaggggactggagccagttcacgctgtggcagcaaggaagaagaaatgaaaatgcctgcaaaggagctcctaaaacctgtaccttactagaaaagttccccgagacaacaggatgcagaagaggacagatcaaatattccatcatgcaccccgggactcacgtgtggccgcacacagggcccacaaactgcaggctccgaatgcacctgggcttggtgattcccaaggaaggctgcaagattcgatgtgccaacgagaccaagacctgggaggaaggcaaggtgctcatctttgatgactcctttgagcacgaggtatggcaggatgcctcatctttccggctgatattcatcgtggatgtgtggcatccggaactgacaccacagcagagacgcagccttccagcaatttagcatgaattcatgcaagcttgggaaactctggagagaggctgcctttctggttccatctccttgggtgtgaggatagaatttcgaacaccaagagtcaattcccttgacttgcagcccgagtaattcaaagcctcctcctagggtcagaagacactaaagggaatatttgcctcgctgcaattcatttaggaaacaccctgctgtgtgtcatctcatgacagcactggtcttctgccagtatttaaggtgaacatttgatagcttctaccttaccagccaaagatattttttccacatagaataggtctaattcaatgtataatgagaacatatgtagaaactgtgaatggattgctttagtttgtaatttttctatgcagttatatttttctagtgtagctagactattttgtcatcatgtaccactacatttttgtttattttaatgacaagctgtataaatgctttacttctagctatttaatggtagcattactggggaactcagacttccctcttttaattcttcttagtaaaagatactcatgaaaaaagcagttttattttcctaacaaaaaagaaagagctcattatgtcagtgtctatgaactgtacccatcccaactctcaaatcgtttggttttttttatcttgattgagatcctcttctcactatgctagtggtggagatattgacaaaatcctatttctttcaaagaggaacttttcacaccgaaaaaagagcatggaattattttatattgttataaaaatcccagatgcaaatttttttaatgccaattattagagcttctggggaaaaagtatagttcacggaaataaaactatgttctttcagggttgggtggataggtggctgctagggtgtctggctcctggcggctttgccatccatgaggcaagggctgggaacacagtgtctttgcctatggtagatccatgtgaatgtcaggaagccagctcttcagtcttggagatgatttctgctacaattctgtagaaagattaaggatggcagagtaaaaggttaccaagaatgccaggatgtttttcttgggcgtaggaggtccagattactttcctttttgatgaaagagtttggaagactgtcccatctctctggcttgagaaatctctgccattttaaacatcactgtgaaatagcaattattatcatctgtatttagttttaacattacccacaacatagaaataataggtaaaaatcgtcttgcctactcattccaaagatgatcaagtcattaatctagcaaagtattcatgtatcagattttgtatattttgaatcaaagctaactaggaatgttagatataagaatgtaatgatattcatgcactgaattctaagccaatatgaacaaaaatgctgcatgaatggcacatataggtcaccaaagttcattcacaggtagaaaaaacttgtgctttcttttccatctaaaaacaaaaggagactttctttatctcatttaaagaacagctctttgaaattgaaattgaccctttttgcttgaccttaaggagattagcttccagtagatgagtttgcaaaatacttttcctgttcttttgttttgctggtattgaaaacatcccactaaatcagatgaagaggcatgggaggaaaaatatccaaattaattactaaaatcgagaagagaaggcaaactcttgaaaagtaaaaaggtgtttgtgaccttcagtatttattgaacagaggaaataactgacaagggcaatacaattcaatgttcatgtagtaacattcatgtcacttgttgaatttggttctcatatgtatattgcatacacataaattcaaactataagtcgtcatttttgagccatcatcttacattcatgtaatgaaattatggaagagagtaaaaactagctcttaacttagtaaatataatatggtatttaaaatcaggtcactacagtaaggttctaagtattgccaattgaaaagctagaaatggtattactgttgcaaagtgttgtcaataattgactccaatagcattgtaaatacttgtatcccacaactattttaaacccaagcaataaaatggattttctaattcacttcaattctttatttctcttacctatctatgtcttggtacataagaaaagtgtttccatcactgcattggtagaattatttcagtgttattatttttgtgatttcgtatgtctacacaaaaatgaattagtttaatttatattgtgatacagttgtttgagaaatatttttaattctgtttcaactttatttctccaagtgtataatataaaaattacttctgttattgttctctaccaataggggaaaaaattaaaacattagatccattgagaaagagatgatgtaataaataattaagattagtaataatattatcaggggtgattatgaccagttgaataatctctttcccttgaattatttagctaacaaattaactctcccaaatatttaaaataatgtaaaatcatattttactgcccattattaactaaaatatttttgtttgactttgagcaccaactggtaatactaataaatacccatgtcatgcagatggctgggcgaataagagatgtctaaaaatatgcactggtcttggaaaacatggcacaagtaaggatatcatatatgatgtctgtttattttatgtctgatttcttttgaatgagtagttggggactccatttctaaggagactaggtaaataaaatgacctttgacatttca

SEQ ID NO: 109159 - DNA, 1290 bp, Homo sapiens
  Payload ID: 1442
  Gene Symbol: ASPH
  Gene Name: aspartate beta-hydroxylase
  Uniprot ID: Q12797
  ENST ID: ENST00000389204
  CDS Start-End: 87-764
ctaaaacctgccagcagtacttttgagtttttttttttgttttgttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattagaaggacccagtggggtagccaagagaaaaactaaggctaaagttaaagaactcactaaagaagagctcaagaaggagaaagagaaacctgagtcaaggaaggaaagtaagaatgaagagagaaaaaaggggaagaaagaggatgtccgaaaggataagaaaattgctgatgcagacctatccaggaaggagtctcctaagggtaaaaaggacagagaaaaagagaaagtggacctagaaaaaagtgctaaaaccaaggaaaataggaaaaaatcaacaaatatgaaggatgtttctagtaaaatggcatcccgagacaaagatgacagaaaggaaagtagaagttctaccagatatgcacacttaacaaagggaaatacccagaaaagaaacggctaaagctctggcatcatcatcccagaacatggtcatgttccagattgcagtttgttacaaaaaagcatggaaaatgtaatattgctctgattggtgagggtgtgtaaattagccattgaatgtatcattggtgcttagcaagtaaattacctgaaatttaaatataccgtctcatacttctaaatgtaaaaacattttaaaaatgtcatagaatatgatgtaataacttctatttattgatcatgtattcagataaatgtatatgtatcatgaatttttatggattaatatattgaatactttcattgacgttaaataagaatattaagattttaaatgttatttctgtgcataatgccttgtaactttttcaagtatgctaaatactcagggagatggatttgctcgttgttttcttccctccttccccttcctgcttccctgtttttctctttcgtggacacctccccaggctcatgtgccaccaccttccctcctctccagccctcccagccctcccgcagccttt

SEQ ID NO: 109160 - DNA, 3717 bp, Homo sapiens
  Payload ID: 1442
  Gene Symbol: ASPH
  Gene Name: aspartate beta-hydroxylase
  ENST ID: ENST00000445642
  CDS Start-End: 270-1154
ggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggttcccgcgtcgcgtgtgtacccccgcgcactgaaggaggtccgccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaatttttgtagcttttagctgattaattagaaaaatttaatatttcagtgaaagttttaaattatcatttatttatttttttaaatgagaggggaaagctgaaattccttgttaagacacaaggaaaaagaatggccctactattatcatgcaaaaatgctttgttggcacctcagattaatcatataatagctatagtctcttcagcatttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaagctcacagagcccgatgcctgctgctatttcacggcaatgagcctttttctttctacactgaagattttcttcttatttaatgtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatgtagtgagtcctgcatgggtactcgatgtgtaatgaaacctgaaataataagataataagaaaagcaataattttctaaagctgtgctgtcggtgatacagagatgatactcaaattataataaaactcttcattttgtgaattatagaagctactttttataaagccatatttttttagggaaactaaggagtgacatagaactgatgaatgagtaaaagtaagttttgctggatttttgtagaactctggacgttgaggattcattatgctgtggttaactttaaatatttttgaattccaaatatctgaattaatgagccttgtctttacaaatatgtgccattgtgcaacatcggtggattttctaaaaataatgtaaatgtcttctattaaatgttgagtgcaataaaatacagaagaattctctatattgtcattatttttgaagtataaggtatttttaatttgttacataataaaatcagttcattttatccttactagtattttagaagattatagcatttttgataactaaaatcacaaaggaataccttcagccagttaacgtatttctaacagataatgcttattttgcatttactatcatgctacattgccaggaagcaagattaaaattaaatagcccctgcagccatcctttgtagattttgtcctgcacctagaagttttgattattccctggacagcctgctccaccttttttccccaaatttttaatttttgtgagtatataatagatgtataaatttgactatatgagatatttcgatacagatatagaaaatgtacaataaattattgttggctatagtaactctgttttgctatcaaatactagatcttattcattgtatataactatatttttgtacccattaaccatcttcacctcctgctcccctctcccctcactacccttcccaacctctggtaaccatccttctaccctctacctctgtgagttcaattgttttaatttttagcacccacaaattagtgagaacatgtgatgtttatctttctgtgcctggcttatttcacctaacataatgacctccagttccatccatgttgtttcaaatggcaggatcttattcttttttatggctgagtagtactccattatatatgtaccacattttcttcattcgtctgttgacagacccttaagttgattccaaagcttagctattgtaaatagtgcaataaacatgagagtgcgtaaattt

SEQ ID NO: 109161 - DNA, 2874 bp, Homo sapiens
  Payload ID: 1442
  Gene Symbol: ASPH
  Gene Name: aspartate beta-hydroxylase
  ENST ID: ENST00000519234
  CDS Start-End: 155-1138
ctgcaggcggtgctgaggcacagggtctgctgcaggagcagcggcccgaacccgctccagcggcccgccgccgccagcggttcccgcgtcgcgtgtgtacccccgcgcactgaaggaggtccgccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaatttttgtagcttttagctgattaattagaaaaatttaatatttcagtgaaagttttaaattatcatttatttatttttttaaatgagaggggaaagctgaaattccttgttaagacacaaggaaaaagaatggccctactattatcatgcaaaaatgctttgttggcacctcagattaatcatataatagctatagtctcttcagcatttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaagctcacagagcccgatgcctgctgctatttcacggcaatgagcctttttctttctacactgaagattttcttcttatttaatgtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatgtagtgagtcctgcatgggtactcgatgtgtaatgaaacctgaaataataagataataagaaaagcaataattttctaaagctgtgctgtcggtgatacagagatgatactcaaattataataaaactcttcattttgtgaattatagaagctactttttataaagccatatttttttagggaaactaaggagtgacatagaactgatgaatgagtaaaagtaagttttgctggatttttgtagaactctggacgttgaggattcattatgctgtggttaactttaaatatttttgaattccaaatatctgaattaatgagccttgtctttacaaatatgtgccattgtgcaacatcggtggattttctaaaaataatgtaaatgtcttctattaaatgttgagtgcaataaaatacagaagaattctc

SEQ ID NO: 109162 - DNA, 755 bp, Homo sapiens
  Payload ID: 1442
  Gene Symbol: ASPH
  Gene Name: aspartate beta-hydroxylase
  ENST ID: ENST00000518306
  CDS Start-End: 162-755
tttcagttctagaggcccttacagtgcagggattggccagtctcaagctctggtaggcaagtgcatgcagtgtgcctaaaacctgccagcagtacttttgagtttttttttttgttttgttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgaaaccgagcatagttaccacgtggaagagacagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaa

SEQ ID NO: 109163 - DNA, 809 bp, Homo sapiens
  Payload ID: 1442
  Gene Symbol: ASPH
  Gene Name: aspartate beta-hydroxylase
  ENST ID: ENST00000517661
  CDS Start-End: 88-612
cctaaaacctgccagcagtacttttgagtttttttttttgttttgttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggcctgaccaaagatggcagtaatgaaaatattgattctcttgaggaagtccttaatattttagcagaggaaagttcagattggttttatggtttcctctcatttctctatgatataatgactccttttgaaatgctagaagaagaagaagaagaaagcgaaaccgcagatggtgttgatggtacgtcacagaatgaaggggttcagggaaagacttgtgtcatattggatttacataaccagtaaccttgattcagggactgaagtcattggctaatgaacacctgaagcagcctcctttttcttttctttccttggcttatgcagggcttaatgtgcagtggggtggttgtgatcttaccgtgcaagtcaaccatgtgatcttgcccagtacagctactagctagtcccttgctcgctcagctcccccaacttctattgaa

SEQ ID NO: 109164 - DNA, 1258 bp, Homo sapiens
  Payload ID: 1442
  Gene Symbol: ASPH
  Gene Name: aspartate beta-hydroxylase
  Uniprot ID: Q12797
  ENST ID: ENST00000522835
  CDS Start-End: 125-895
cagtctcaagctctggtaggcaagtgcatgcagtgtgcctaaaacctgccagcagtacttttgagtttttttttttgttttgttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgtt

SEQ ID NO: 109165 - DNA, 2744 bp, Homo sapiens
  Payload ID: 1442
  Gene Symbol: ASPH
  Gene Name: aspartate beta-hydroxylase
  Uniprot ID: Q12797
  ENST ID: ENST00000518068
  CDS Start-End: 198-1010
ccgggcgcgcgcagccggcaggcgggtgaagtcttcccaggtgctgcaggcggtgctgaggcacagggtctgctgcaggagcagcggcccgaacccgctccagcggcccgccgccgccagcggttcccgcgtcgcgtgtgtacccccgcgcactgaaggaggtccgccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaatttttgtagcttttagctgattaattagaaaaatttaatatttcagtgaaagttttaaattatcatttatttatttttttaaatgagaggggaaagctgaaattccttgttaagacacaaggaaaaagaatggccctactattatcatgcaaaaatgctttgttggcacctcagattaatcatataatagctatagtctcttcagcatttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaagctcacagagcccgatgcctgctgctatttcacggcaatgagcctttttctttctacactgaagattttcttcttatttaatgtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatgtagtgagtcctgcatgggtactcgatgtgtaatgaaacctgaaataataagataataagaaaagcaataattttctaaagctgtgctgtcggtgatacagagatgatactcaaattataataaaactcttcattttgtgaattatagaagctactttttataaagccatatttttttagggaaactaaggagtgacatagaactgatgaatgagtaaaagtaagttttgctggatttttgtagaactctggacgttgaggattcattatgctgtggttaactttaaatatttttgaattccaaatatctgaattaatgagccttgtctttacaaatatgtgccattgtgcaacatcggtggattttctaaaaataatgtaaatgtcttctattaaatgttgagtgcaataaaatacagaagaattc

SEQ ID NO: 109166 - DNA, 531 bp, Homo sapiens
  Payload ID: 1442
  Gene Symbol: ASPH
  Gene Name: aspartate beta-hydroxylase
  ENST ID: ENST00000522349
  CDS Start-End: 124-531
agtctcaagctctggtaggcaagtgcatgcagtgtgcctaaaacctgccagcagtacttttgagtttttttttttgttttgttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattagttaagaaaaagaagcctaaacttttaaataaatttgataagactattaaagctgaacttgatgctgcagaaaaactccgtaaaaggggaaaaattgaggaagcagtgaatgcatttaaagaactagtacgcaaataccctcagagtccacgagcaagatatgggaaggcgcag

SEQ ID NO: 109167 - DNA, 6337 bp, Homo sapiens
  Payload ID: 1442
  Gene Symbol: ASPH
  Gene Name: aspartate beta-hydroxylase
  ENST ID: ENST00000517856
  CDS Start-End: 217-558
caggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggttcccgcgtcgcgtgtgtacccccgcgcactgaaggaggtccgccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggtaatttgcattgtatatagatgatcgtctcaaaatttcacaatgagagactgatgaaattgacataaatcaatcagcatgaacacttgaattaatccagaggactacttaagttaattctgtaggtggttgctttattgagaatattttgtattatgacctgcttagctatgcaagtttgtaacttcagaggtcctcataatgatacttggataataaagattccccatagacacttccattgaaaaagaaaagaagtaaacaagtgtcatttgtaatttgaaatgttttaagttaactgtcatgttactgtccatgaaatggatctggtgacttaggctctatctcctgacattgatttctttctcctgtgtcctcaattatttcttctcctgttaatgcccactggtaataattctcaaaatcgattgctcagaatattccattgtaaaatgcaccttggaaatggttgttttcctcatttgtaaattgaagacaatgcctattcctcaaggtggttgtgagaaccagtcaatgttgcatatgtgtaaacagccagcacatggttgggcattcagtttccctttatcattggtagaataagaatagtaatactcaaccaaaacgtctcagtcaggggttaaaaacttggaagcactgaaactgtgcttcctattcctacttaggtcaacagattgcaaaacaaatatttcagtcctttatcctttgtaatgaatgtgtctttgtgaaatgagtatagtggagcctgatttattctattgagatcattgagggggcaaatgcaaataattataaatgttgcacatgagtgaagccgtaagaatgcttaatttttaaaagaatattgtgacaacctgaaaacacaagatatgaaggctagaaaaaaagttatgaaataaactatagccttaagtatatggtacaatcgagaagcctaataaccagcctaattgtgaaaaacttatgtttgttttgtattcagaacacatttttccatagatgagattttatggtcttcagagattttttttttactctggtccacaaaaattgatttaattctaatatccatttctgcaactctcattgtaactatgtttctatggaaaatgcatttatcattctgccttgggatattaggaatatatttagttttacttctgaatgttctccagaatttctttggttacatccatggtgttaaatccattcagataccttacatggacaaaaatcatggattggctcacataattgtaaagcccaggagtagttttggcttttttcttttgttatgctggatctaggtgcttgaacagtgttctcaacatccatctgtctatggaccctcaggaatgttggctttcttctcgggcagagtctcgtgtgctcatcttcaaccctactccttatggggtgggagataagaaagctgtgattggtgacaccctgggatatgtgagtgcccacttttaaactgttgggtaaagaaaaattggagtcctctaaggaagttagtgtgtttttaccagaaggaggaggaattgatgcactgaaagcaggcagatgatggagtttgtttcccctttttctacccatcccattcctacttctccccctgcccaaatacagagaggtgaatgggatgggccaaaataggtatttcaaaataagaagctgtggagctaaacattgggtactcatgggcataaagatggaaacaggagacactagaacttctagagaggggagagagggagggagacaagggttgaaaaactaactattggatactatgctcattacctgagtgatggaatcattcatattctaaatttcaatatcacgcaatatacccatgcagcaaacttgcacgtgctccttgaatctaaatagaagttgaagttatatttaaaaattaaaaaaaaaaaagctagggagaagagagagatctcattccaaacaattattggtcaacaatagttttagaccattgaaagaatataagagaatgttgacttgataataaatattgccatttagatgtcaggtgataaagtttattttgttgttaagctctctccattttgccccattcagtttaaaaggaaagtttttgtgtttaggaaactaaaggatgggtgatatgtagcagacccataaggttattttcatgaaaaacctagcttgggctaatctgaaagattcctcaataacagtctttggtgtcttatcctttcttctccatttgcctaagaatataattgtataagctggatgtttattccttggctatcgtttttacctaggaatcaatttctgcaagagctctgtaagccttacaaagcagaaagtcatccatttcttttttctttgttctcatttagtgcctcatttgatttcactttgtgtatctatttattgctccatgttaagtcaggtatgcatacatcatagaagtctgcctctcatttccatcttctttgccttatgtatcacttctcttgtgtcctattagagggagatgatctatgcttaaagctgttgggttatttttgataattatataacaccaacatgctgtgtctatagttcccatttattgattcaactaatatttctgagtatctacagcatgccgggactgggcaaggcatgggggatacaagagattgaggtggctgcaatccctccagtgaaatgctgcaaaataagcaaggggctgagagagaaagtaatgagactgaaacgattgtcagtacagcccactagtccctctgcctagaacgtgctcctgaatgtgctcctgctctgtgtggtgggctgcctttgtctctcccacgggacccagcccagtcatcacctctgcactcagacatctctgaccctcccaagtggctgcatcccacacactccagttatcgcactcatcaccttgcctcattcttggactttgctgccagactacgatttatctcgagcacctatcctagtaactgacactaataggcattcattgtttgtttattgaatggtgactatacaaaataaattatctaaaaatatttcaggtgtatatatactgttgaagaatattaggaagaagaaaaccgtgtgtgtgtgtttttgaagaacccaaaagattgttcagtaattgcagtgttttaactaccttggaagttacctgtgactggcagggaggggggtgtaaagattttttttagaagaaattaatgaaatggtaaatttttggaaaaatacttatttaaattatctcatttaattcttaaagcccttcttaggggtcctgttttgtcccctttttgcatttgtggaaaccaaaaagtgtagctgtggttaacactgagatagaattcaaatggaattcaaaggcatcctcttgtcccaggtgcctgaacttacacaccatgctgagttgcatgtccttgaactgtatttttcatgatgttaaagtgagtccactctcaccagtctttgttgagtcccttcattggtgctgaaaccaggctcttgggaaccttattggcagtgtttaattcttttgtaatttatgtctgtttgaaatctgtctgtccagcttgggttacttgaagatgctttgaatctggaatggctcttactgcatatcatggggcagctttgagtacctggtagtctcagaattttggtaagttccgagactgctgttggtatactgaggaagatctgtattcactgattacacaagccaggagcgacaacgaggattaacgtggttacctagtatgcatgcctttctggtgtattgattttccagaatatttctcaaatttcatatacctatgagccttattcttgggataaattgatttatactgctagactccttgcaattgaaacagtaccacttctgagcactcaccctgagcacagataaccatagctggagtaacctggattagtaaggacacgttttctttcatctgtacacctttgaattagtaaaccaaagattaaaacactaattttaaaaaactttttagctttttaatgggctaggtgtatgaaattgtatgaaacaaagtaagtttataattgtttcccaggttttgttgagggagtggcttgcttataactcttaggagaagtaaatcctttgtgttccctcaagtcacagcccttggatccagcatccagggcctttctgatatgcacacctctcttggtgcctcagtcacctttcttttccttggtgccaaatatgtgcccagttgaggaatttcgtacagtcacatgcctcatgctatcattttggttaaggatggactgcatgtatgatagtggtcccataagatcatagtgtcatatttatactgtaccttttctgtgtttagatacacaaacactttgtgttacaattgtctacagtattcggtacagtacgtgctgtacagttttgtagcctgggaacaataggatgttgcatacagtctaggtttgtggcaggctataccttctaagtttgcctgggcacactgcaatgttcccacagtggtaaaatttcctaatggcacatttcaacatgtatttccacacattcctcagaatgtatcgctgttgttaagcaacacatgactgaacttgcagttccctacccgaaacacacgtgtaacttacatagccacatccctgatttccttcagggtctgttcacatgttatcagtgagtccttttgccaaagtattatgaatagtccccacccccacttttccctaatgtgctccctgttctgtgtcttccccgtactatctgtccccatccaatatactctaaatagttcatgtttcttattttttaagtttctctctcccccggaaggtaggtgtgttgttttcatttactgtagaataatgccttgaattaataggtgctaaatatttgttgaacgattaaatacaacatacaatttagtaagtttacaactactgcatatttatggaaagaaatatattgattctttctcattatgggcagcagtgaataaagtaagctaatcctgggcttgggtatttgtgtcactcatatttgctatgagtggttgatttaaagtgctgatttcatttgcatttcatagcttcatctaattttaattaaaattggaggggcaattatatagtgattaaatgcaaatgttttataatttccaaatttatctgattaacctaaagaactaaaaccaaggtatgttttaagggaattaatgtgttttccaaatcatgttgtggccattgctgtggactggcagtatctattcaccatacataatgactggaaggcggctgtggacaccctgttcctcttggcagcacaggaatggaagtgggtcccagtcctgatgattaacactgaaaagggagactgctggtagcttctggaaaaaatttcctcaagcctaagaaagaagcagagcaagagatgctccttttgcttctggacatcgccttgtctgaaaaagaagcttgcagctggggagctctgattgccagcctgagggtgaagcttgacctgcgatgcagtcagccgcctccgcacttcttgtttagttagatgataaatttccttcctacccaaccattataagctggcagtttggtaactgcagccccaggaacatcgaaaccgacacatctcatgtcataacctaattttgaatatttatttcattgctacttcattgccacttgtacctcataataaatccatttttgaaaaccttt

SEQ ID NO: 109168 - DNA, 1947 bp, Homo sapiens
  Payload ID: 1442
  Gene Symbol: ASPH
  Gene Name: aspartate beta-hydroxylase
  Uniprot ID: Q12797
  ENST ID: ENST00000517847
  CDS Start-End: 81-980
cctgccagcagtacttttgagtttttttttttgttttgttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaatttttgtagcttttagctgattaattagaaaaatttaatatttcagtgaaagttttaaattatcatttatttatttttttaaatgagaggggaaagctgaaattccttgttaagacacaaggaaaaagaatggccctactattatcatgcaaaaatgctttgttggcacctcagattaatcatataatagctatagtctcttcagcatttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaa

SEQ ID NO: 109169 - DNA, 2658 bp, Homo sapiens
  Payload ID: 1442
  Gene Symbol: ASPH
  Gene Name: aspartate beta-hydroxylase
  Uniprot ID: Q12797
  ENST ID: ENST00000517903
  CDS Start-End: 92-988
tgtgcctaaaacctgccagcagtacttttgagtttttttttttgttttgttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaatttttgtagcttttagctgattaattagaaaaatttaatatttcagtgaaagttttaaattatcatttatttatttttttaaatgagaggggaaagctgaaattccttgttaagacacaaggaaaaagaatggccctactattatcatgcaaaaatgctttgttggcacctcagattaatcatataatagctatagtctcttcagcatttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaagctcacagagcccgatgcctgctgctatttcacggcaatgagcctttttctttctacactgaagattttcttcttatttaatgtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatgtagtgagtcctgcatgggtactcgatgtgtaatgaaacctgaaataataagataataagaaaagcaataattttctaaagctgtgctgtcggtgatacagagatgatactcaaattataataaaactcttcattttgtgaattatagaagctactttttataaagccatatttttttagggaaactaaggagtgacatagaactgatgaatgagtaaaagtaagttttgctggatttttgtagaactctggacgttgaggattcattatgctgtggttaactttaaatatttttgaattccaaatatctgaattaatgagccttgtctttacaaatatgtgccattgtgcaacatcggtgga

SEQ ID NO: 109170 - DNA, 1277 bp, Homo sapiens
  Payload ID: 1442
  Gene Symbol: ASPH
  Gene Name: aspartate beta-hydroxylase
  ENST ID: ENST00000522919
  CDS Start-End: 1-492
atggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaaacaaatagaaaaacagatgatccagaacaaaaagcaaaagaggactcatttgcgtctggtgaaagccaggcggcttgcaccatgtcctgggacttcagccatcctttcatgtgttgacccttcttaaagaatggaagggggaactgaataaagaagataacagcttctagctaagaaggatgatgcattagtttgccaaatatataggctccttttgtgtgctatgctctgtggagcgctctgaaagcaaagcaagtaactacaatgtaaagaggtagagactatgaacaaaatgctgtgggaacaccaaggaggaaatgacacactgctggcaggagatggaaagcaactggagtcttcatggagcgatgacatttgagctggtcctcaagtagtgggtgaggattacatccatgcaagagccctgtgaacccagatactgaagtatgtctaatgacaaggatgataagttgatatggaaaaaaaatcacaggtgtttctgctcacagcaagcccagcagtactccaagagcagtacttaacttgggtgtcatgggctatgctctctatacagaagattacattagagtcttgtcttaaaaaccctttttgggaaaattatcataattcatttttttctaatatccaatgacttttacgcttttgctactttgattcatcagtacgttgatgataccttctcctctttgtcccattcctgcttcatgataatttaatgaaattaaagtaatggatttaattagcacctacatctatgattatatgtatatattatttatctgaaacctttggggtgggccagctaccacaattaaaatatcaacttgattcaagttgtgtgaagcacactttaaacttgaaataaaagtgaataaaatcta

SEQ ID NO: 109171 - DNA, 842 bp, Homo sapiens
  Payload ID: 1442
  Gene Symbol: ASPH
  Gene Name: aspartate beta-hydroxylase
  Uniprot ID: Q12797
  ENST ID: ENST00000522603
  CDS Start-End: 99-731
catgcagtgtgcctaaaacctgccagcagtacttttgagtttttttttttgttttgttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattagaaggacccagtggggtagccaagagaaaaactaaggctaaagttaaagaactcactaaagaagagctcaagaaggagaaagagaaacctgagtcaaggaaggaaagtaagaatgaagagagaaaaaaggggaagaaagaggatgtccgaaaggataagaaaattgctgatgcagacctatccaggaaggagtctcctaagggtaaaaaggacagagaaaaagagaaagtggacctagaaaaaagtgctaaaaccaaggaaaataggaaaaaatcaacaaatatgaaggatgtttctagtaaaatggcatcccgagacaaagatgacagaaaggaaagtagaagttctaccagatatgcacacttaacaaagggaaatacccagaaaagaaacggctaaagctctggcatcatcatcccagaacatggtcatgttccagattgcagtttgttacaaaaaagcatggaaaatgtaatattgctctgattggtgagggtgtgtaaattagcc

SEQ ID NO: 109172 - DNA, 5153 bp, Homo sapiens
  Payload ID: 1442
  Gene Symbol: ASPH
  Gene Name: aspartate beta-hydroxylase
  Uniprot ID: Q12797
  ENST ID: ENST00000541428
  CDS Start-End: 162-2351
tttcagttctagaggcccttacagtgcagggattggccagtctcaagctctggtaggcaagtgcatgcagtgtgcctaaaacctgccagcagtacttttgagtttttttttttgttttgttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaaacaaatagaaaaacagatgatccagaacaaaaagcaaaagttaagaaaaagaagcctaaacttttaaataaatttgataagactattaaagctgaacttgatgctgcagaaaaactccgtaaaaggggaaaaattgaggaagcagtgaatgcatttaaagaactagtacgcaaataccctcagagtccacgagcaagatatgggaaggcgcagtgtgaggatgatttggctgagaagaggagaagtaatgaggtgctacgtggagccatcgagacctaccaagaggtggccagcctacctgatgtccctgcagacctgctgaagctgagtttgaagcgtcgctcagacaggcaacaatttctaggtcatatgagaggttccctgcttaccctgcagagattagttcaactatttcccaatgatacttccttaaaaaatgaccttggcgtgggatacctcttgataggagataatgacaatgcaaagaaagtttatgaagaggtgctgagtgtgacacctaatgatggctttgctaaagtccattatggcttcatcctgaaggcacagaacaaaattgctgagagcatcccatatttaaaggaaggaatagaatccggagatcctggcactgatgatgggagattttatttccacctgggggatgccatgcagagggttgggaacaaagaggcatataagtggtatgagcttgggcacaagagaggacactttgcatctgtctggcaacgctcactctacaatgtgaatggactgaaagcacagccttggtggaccccaaaagaaacgggctacacagagttagtaaagtctttagaaagaaactggaagttaatccgagatgaaggccttgcagtgatggataaagccaaaggtctcttcctgcctgaggatgaaaacctgagggaaaaaggggactggagccagttcacgctgtggcagcaaggaagaagaaatgaaaatgcctgcaaaggagctcctaaaacctgtaccttactagaaaagttccccgagacaacaggatgcagaagaggacagatcaaatattccatcatgcaccccgggactcacgtgtggccgcacacagggcccacaaactgcaggctccgaatgcacctgggcttggtgattcccaaggaaggctgcaagattcgatgtgccaacgagaccaagacctgggaggaaggcaaggtgctcatctttgatgactcctttgagcacgaggtatggcaggatgcctcatctttccggctgatattcatcgtggatgtgtggcatccggaactgacaccacagcagagacgcagccttccagcaatttagcatgaattcatgcaagcttgggaaactctggagagaggctgcctttctggttccatctccttgggtgtgaggatagaatttcgaacaccaagagtcaattcccttgacttgcagcccgagtaattcaaagcctcctcctagggtcagaagacactaaagggaatatttgcctcgctgcaattcatttaggaaacaccctgctgtgtgtcatctcatgacagcactggtcttctgccagtatttaaggtgaacatttgatagcttctaccttaccagccaaagatattttttccacatagaataggtctaattcaatgtataatgagaacatatgtagaaactgtgaatggattgctttagtttgtaatttttctatgcagttatatttttctagtgtagctagactattttgtcatcatgtaccactacatttttgtttattttaatgacaagctgtataaatgctttacttctagctatttaatggtagcattactggggaactcagacttccctcttttaattcttcttagtaaaagatactcatgaaaaaagcagttttattttcctaacaaaaaagaaagagctcattatgtcagtgtctatgaactgtacccatcccaactctcaaatcgtttggttttttttatcttgattgagatcctcttctcactatgctagtggtggagatattgacaaaatcctatttctttcaaagaggaacttttcacaccgaaaaaagagcatggaattattttatattgttataaaaatcccagatgcaaatttttttaatgccaattattagagcttctggggaaaaagtatagttcacggaaataaaactatgttctttcagggttgggtggataggtggctgctagggtgtctggctcctggcggctttgccatccatgaggcaagggctgggaacacagtgtctttgcctatggtagatccatgtgaatgtcaggaagccagctcttcagtcttggagatgatttctgctacaattctgtagaaagattaaggatggcagagtaaaaggttaccaagaatgccaggatgtttttcttgggcgtaggaggtccagattactttcctttttgatgaaagagtttggaagactgtcccatctctctggcttgagaaatctctgccattttaaacatcactgtgaaatagcaattattatcatctgtatttagttttaacattacccacaacatagaaataataggtaaaaatcgtcttgcctactcattccaaagatgatcaagtcattaatctagcaaagtattcatgtatcagattttgtatattttgaatcaaagctaactaggaatgttagatataagaatgtaatgatattcatgcactgaattctaagccaatatgaacaaaaatgctgcatgaatggcacatataggtcaccaaagttcattcacaggtagaaaaaacttgtgctttcttttccatctaaaaacaaaaggagactttctttatctcatttaaagaacagctctttgaaattgaaattgaccctttttgcttgaccttaaggagattagcttccagtagatgagtttgcaaaatacttttcctgttcttttgttttgctggtattgaaaacatcccactaaatcagatgaagaggcatgggaggaaaaatatccaaattaattactaaaatcgagaagagaaggcaaactcttgaaaagtaaaaaggtgtttgtgaccttcagtatttattgaacagaggaaataactgacaagggcaatacaattcaatgttcatgtagtaacattcatgtcacttgttgaatttggttctcatatgtatattgcatacacataaattcaaactataagtcgtcatttttgagccatcatcttacattcatgtaatgaaattatggaagagagtaaaaactagctcttaacttagtaaatataatatggtatttaaaatcaggtcactacagtaaggttctaagtattgccaattgaaaagctagaaatggtattactgttgcaaagtgttgtcaataattgactccaatagcattgtaaatacttgtatcccacaactattttaaacccaagcaataaaatggattttctaattcacttcaattctttatttctcttacctatctatgtcttggtacataagaaaagtgtttccatcactgcattggtagaattatttcagtgttattatttttgtgatttcgtatgtctacacaaaaatgaattagtttaatttatattgtgatacagttgtttgagaaatatttttaattctgtttcaactttatttctccaagtgtataatataaaaattacttctgttattgttctctaccaataggggaaaaaattaaaacattagatccattgagaaagagatgatgtaataaataattaagattagtaataatattatcaggggtgattatgaccagttgaataatctctttcccttgaattatttagctaacaaattaactctcccaaatatttaaaataatgtaaaatcatattttactgcccattattaactaaaatatttttgtttgactttgagcaccaactggtaatactaataaatacccatgtcatgcagatggctgggcgaataagagatgtctaaaaatatgcactggtcttggaaaacatggcacaagtaaggatatcatatatgatgtctgtttattttatgtctgatttcttttgaatgagtagttggggactccatttctaaggagactaggtaaataaaatgacctttgacatttc

SEQ ID NO: 109173 - DNA, 556 bp, Homo sapiens
  Payload ID: 1442
  Gene Symbol: ASPH
  Gene Name: aspartate beta-hydroxylase
  ENST ID: ENST00000523927
  CDS Start-End: 1-556
ttttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagttaagaaaaagaagcctaaacttttaaataaatttgataagactattaaagctgaacttgatgctgcagaaaaactccgtaaaagg

SEQ ID NO: 109174 - DNA, 337 bp, Homo sapiens
  Payload ID: 1442
  Gene Symbol: ASPH
  Gene Name: aspartate beta-hydroxylase
  ENST ID: ENST00000519264
  CDS Start-End: 1-135
gaggataatcctgtagaagattcacaggtaattgtagaagaagtaagcatttttcctgtggaagaacagcaggaagtaccaccaggctatttgatggagaatatggaatcagaattgccttgggatgaaagttgaatagtgtataaattgtgacattactcctcttcctctccattccccatctctcctgagagcatctttagtgctttgtgacagtccaggctgcccagtgcttgtcagtgtcccagggtgtttccttttagttcactgcattacatacttttccctgttttttcctactttcctctacctgagccctcttgtcaccagttaatat

SEQ ID NO: 109175 - DNA, 587 bp, Homo sapiens
  Payload ID: 1442
  Gene Symbol: ASPH
  Gene Name: aspartate beta-hydroxylase
  ENST ID: ENST00000524173
  CDS Start-End: 1-587
cagtcccttctccatgaaatggtacacgcagaacatgaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagttaagaaaaagaagcctaaacttttaaataaatttgataagactattaaagctgaacttgatgctgcagaaaaactccgtaaaaggggaaaaattgaggaagcagtgaatgcatttaaagaactagtacgcaaataccctcagagtccacgagcaagatatgggaaggcgcagtgtgaggatgatttggctgagaagaggagaagtaatgaggtgctacgtggagccatcgagac

SEQ ID NO: 109176 - DNA, 536 bp, Homo sapiens
  Payload ID: 1442
  Gene Symbol: ASPH
  Gene Name: aspartate beta-hydroxylase
  ENST ID: ENST00000519678
  CDS Start-End: 1-404
gagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgt

SEQ ID NO: 109177 - DNA, 1584 bp, Homo sapiens
  Payload ID: 1443
  Gene Symbol: ASPHD1
  Gene Name: aspartate beta-hydroxylase domain containing 1
  Uniprot ID: Q5U4P2
  ENST ID: ENST00000308748
  CDS Start-End: 253-1425
cgggactgcaggtccaggcagggtaggaaccgctgcccaggggagctaggaggaagcggggagagagagcgagcgaaaagcgggggtggggaggaaagggggagattgaggtgggagagagaagcagagcgagagagaggaggctgctggaaggagaaagaagagggtgaggaggcgacagagggagaggaggaagaagaggtagaaggagagagaaaggggagagaaaggagagaggagggttggaggtgcatgaaggaggggagagggagcttcagcgtggagagaggaccgcggaaggagagagagacagcccagagtggaatgtggaagggaaacagtccagcggggagccagggggcagccatggaagggacaggtggggagctggggggacaggggaactggggtccggaggacgccccaggcctcttggccagggcctccctgatcatgctcccgtggccactacccctggcctcctcggccctcaccttgctcttcggggccctcacttccctgttcctctggtactgctaccgcctgggctcccaagacatgcaggccctaggggctgggagccgagctgggggtgttcgtggtgggcctgtgggatgctcggaggccggcgggccaagcccagggggtcctggggatcccggggaaggacctaggacggaaggcctagtgagccggcggcttcgggcctacgcaaggcgctactcctgggctgggatgggtagagtgaggcgggcagctcagggtggcccaggccctgggagagggccaggggtcctaggtattcagcgcccaggcctgcttttcctaccagacctgccttcagccccctttgtgccgcgggacgcccagcggcacgacgtggagctcctggagagcagcttccctgccattttgcgggacttcggggctgtgagctgggacttctcagggactacccctccgcctcggggctggtccccacctctggcccccgggtgctaccagctcctgctgtaccaagcaggccggtgccaacccagcaactgccgccggtgcccgggggcctatcgggcactgagggggcttcgaagctttatgagtgccaacaccttcggcaatgccggcttttccgttctcctgcctggggcccggctcgagggccgctgtgggcccaccaatgcccgggtcagatgccatctgggcctaaagatccctcctggctgtgagctggtggtcggcggtgagccccagtgctgggctgaggggcactgtctactggtggacgactcttttctacacacagtggctcacaatggctcccccgaagatgggcctcgagtggtcttcatcgtggacctctggcaccccaacgtggcaggggctgagcgccaggccctcgactttgtcttcgccccagacccttgaaggaaggtgctcccttcacacacccaggctggagagacactgcgctcagggacggcttgatggtagccaggacctcctctctactgcgggggtgggcgggggcggaggatgggaactggctagtgagcactgaaatataaattctgaatcctctcctaa

SEQ ID NO: 109178 - DNA, 1451 bp, Homo sapiens
  Payload ID: 1443
  Gene Symbol: ASPHD1
  Gene Name: aspartate beta-hydroxylase domain containing 1
  Uniprot ID: Q5U4P2
  ENST ID: ENST00000414952
  CDS Start-End: 115-1287
ggaggctgctggaaggagaaagaagagggtgaggaggcgacagagggagaggaggaagaagaggtagaaggagagagaaaggggagagaaaggagagaggagggttggaggtgcatgaaggaggggagagggagcttcagcgtggagagaggaccgcggaaggagagagagacagcccagagtggaatgtggaagggaaacagtccagcggggagccagggggcagccatggaagggacaggtggggagctggggggacaggggaactggggtccggaggacgccccaggcctcttggccagggcctccctgatcatgctcccgtggccactacccctggcctcctcggccctcaccttgctcttcggggccctcacttccctgttcctctggtactgctaccgcctgggctcccaagacatgcaggccctaggggctgggagccgagctgggggtgttcgtggtgggcctgtgggatgctcggaggccggcgggccaagcccagggggtcctggggatcccggggaaggacctaggacggaaggcctagtgagccggcggcttcgggcctacgcaaggcgctactcctgggctgggatgggtagagtgaggcgggcagctcagggtggcccaggccctgggagagggccaggggtcctaggtattcagcgcccaggcctgcttttcctaccagacctgccttcagccccctttgtgccgcgggacgcccagcggcacgacgtggagctcctggagagcagcttccctgccattttgcgggacttcggggctgtgagctgggacttctcagggactacccctccgcctcggggctggtccccacctctggcccccgggtgctaccagctcctgctgtaccaagcaggccggtgccaacccagcaactgccgccggtgcccgggggcctatcgggcactgagggggcttcgaagctttatgagtgccaacaccttcggcaatgccggcttttccgttctcctgcctggggcccggctcgagggccgctgtgggcccaccaatgcccgggtcagatgccatctgggcctaaagatccctcctggctgtgagctggtggtcggcggtgagccccagtgctgggctgaggggcactgtctactggtggacgactcttttctacacacagtggctcacaatggctcccccgaagatgggcctcgagtggtcttcatcgtggacctctggcaccccaacgtggcaggggctgagcgccaggccctcgactttgtcttcgccccagacccttgaaggaaggtgctcccttcacacacccaggctggagagacactgcgctcagggacggcttgatgataaccagatgcaacgtgaagatctagactggaccctggtttgatgaaccagctgtaaaaacacatttctggaacaactggagaaaccggagtatgccctgg

SEQ ID NO: 109179 - DNA, 1732 bp, Homo sapiens
  Payload ID: 1443
  Gene Symbol: ASPHD1
  Gene Name: aspartate beta-hydroxylase domain containing 1
  Uniprot ID: Q5U4P2
  ENST ID: ENST00000566693
  CDS Start-End: 115-1287
ggaggctgctggaaggagaaagaagagggtgaggaggcgacagagggagaggaggaagaagaggtagaaggagagagaaaggggagagaaaggagagaggagggttggaggtgcatgaaggaggggagagggagcttcagcgtggagagaggaccgcggaaggagagagagacagcccagagtggaatgtggaagggaaacagtccagcggggagccagggggcagccatggaagggacaggtggggagctggggggacaggggaactggggtccggaggacgccccaggcctcttggccagggcctccctgatcatgctcccgtggccactacccctggcctcctcggccctcaccttgctcttcggggccctcacttccctgttcctctggtactgctaccgcctgggctcccaagacatgcaggccctaggggctgggagccgagctgggggtgttcgtggtgggcctgtgggatgctcggaggccggcgggccaagcccagggggtcctggggatcccggggaaggacctaggacggaaggcctagtgagccggcggcttcgggcctacgcaaggcgctactcctgggctgggatgggtagagtgaggcgggcagctcagggtggcccaggccctgggagagggccaggggtcctaggtattcagcgcccaggcctgcttttcctaccagacctgccttcagccccctttgtgccgcgggacgcccagcggcacgacgtggagctcctggagagcagcttccctgccattttgcgggacttcggggctgtgagctgggacttctcagggactacccctccgcctcggggctggtccccacctctggcccccgggtgctaccagctcctgctgtaccaagcaggccggtgccaacccagcaactgccgccggtgcccgggggcctatcgggcactgagggggcttcgaagctttatgagtgccaacaccttcggcaatgccggcttttccgttctcctgcctggggcccggctcgagggccgctgtgggcccaccaatgcccgggtcagatgccatctgggcctaaagatccctcctggctgtgagctggtggtcggcggtgagccccagtgctgggctgaggggcactgtctactggtggacgactcttttctacacacagtggctcacaatggctcccccgaagatgggcctcgagtggtcttcatcgtggacctctggcaccccaacgtggcaggggctgagcgccaggccctcgactttgtcttcgccccagacccttgaaggaaggtgctcccttcacacacccaggctggagagacactgcgctcagggacggcttgatgggagaggctggggcagggccttatgtcttctcctagtacaaccaaacagataaccagatgcaacgtgaagatctagactggaccctggtttgatgaaccagctgtaaaaacacatttctggaacaactggagaaaccggagtatgccctggactggatattaaataaaaatttattgacatgtaaagatggcaattattaacaacaacaaaaaacagattataaaacatttcatacaacacgattgtattttggcaagcaaacacacacacacacacatactctcacacaggaaacgacctggaagaatatttggtgcttttattttttagattatttgtgtttctgaaatttctacaattaataaatactgctttaaaataa

SEQ ID NO: 109180 - DNA, 1115 bp, Homo sapiens
  Payload ID: 1443
  Gene Symbol: ASPHD1
  Gene Name: aspartate beta-hydroxylase domain containing 1
  ENST ID: ENST00000483405
  CDS Start-End: 627-956
cgggacggctggaggctggcaccgtggcccctgcgccccacgtggcgccctttccgggcggggggggtggggaggcacctccagcgacaactctcccccctcccccggcacccggctgatttgctgtgccactgggagggttcgggggtggctgagctgagagggctccgggaaggagtgacgtcagggtgagtgggagcccaggaaggagcgagtaggagagagggagcgagagccaggcaggaccgcagggtcggggctagtgaggagcgagggcaaggagagagcagtgaggccggagagaaagaagctgccgcggaggaagacaggctgcgggttcccgggactgcaggtccaggcaggacctgccttcagccccctttgtgccgcgggacgcccagcggcacgacgtggagctcctggagagcagcttccctgccattttgcgggacttcggggctgtgagctgggacttctcagggactacccctccgcctcggggctggtccccacctctggcccccgggtgctaccagctcctgctgtaccaagcaggccggtgccaacccagcaactgccgccggtgcccgggggcctatcgggcactgagggggcttcgaagctttatgagtgccaacaccttcggcaatgccggcttttccgttctcctgcctggggcccggctcgagggccgctgtgggcccaccaatgcccgggtcagatgccatctgggcctaaagatccctcctggctgtgagctggtggtcggcggtgagccccagtgctgggctgaggggcactgtctactggtggacgactcttttctacacacagtggctcacaatggctcccccgaagatgggcctcgagtggtcttcatcgtggacctctggcaccccaacgtggcaggggctgagcgccaggccctcgactttgtcttcgccccagacccttgaaggaaggtgctcccttcacacacccaggctggagagacactgcgctcagggacggcttgatggtagccaggacctcctctctactgcgggggtgggcgggggcggaggatgggaactggctagtgagcactgaaatataaattctgaatcctctcctaa

SEQ ID NO: 109181 - DNA, 775 bp, Homo sapiens
  Payload ID: 1443
  Gene Symbol: ASPHD1
  Gene Name: aspartate beta-hydroxylase domain containing 1
  ENST ID: ENST00000563177
  CDS Start-End: 456-775
attgcgggacggctggaggctggcaccgtggcccctgcgccccacgtggcgccctttccgggcggggggggtggggaggcacctccagcgacaactctcccccctcccccggcacccggctgatttgctgtgccactgggagggttcgggggtggctgagctgagagggctccgggaaggagtgacgtcaggacctgccttcagccccctttgtgccgcgggacgcccagcggcacgacgtggagctcctggagagcagcttccctgccattttgcgggacttcggggctgtgagctgggacttctcagggactacccctccgcctcggggctggtccccacctctggcccccgggtgctaccagctcctgctgtaccaagcaggccggtgccaacccagcaactgccgccggtgcccgggggcctatcgggcactgagggggcttcgaagctttatgagtgccaacaccttcggcaatgccggcttttccgttctcctgcctggggcccggctcgagggccgctgtgggcccaccaatgcccgggtcagatgccatctgggcctaaagatccctcctggctgtgagctggtggtcggcggtgagccccagtgctgggctgaggggcactgtctactggtggacgactcttttctacacacagtggctcacaatggctcccccgaagatgggcctcgagtggtcttcatcgtggacctctggcaccccaacgtggcaggggctgagcgccaggccctcgactttgtcttcgcccc

SEQ ID NO: 109182 - DNA, 3357 bp, Homo sapiens
  Payload ID: 1444
  Gene Symbol: ASPHD2
  Gene Name: aspartate beta-hydroxylase domain containing 2
  Uniprot ID: Q6ICH7
  ENST ID: ENST00000215906
  CDS Start-End: 439-1548
gcggccccgcggagcgcagcgcggcgtcggcaccggcaggggcaccggcgcggcttaggctcgggctcgggctccggctcgggctcccgcggcgtgggctgggcagcagccaggcggcggctccgcggcgccgggcaggggccgtccgcgggtccgcgccctcgggcggcggcgtctcctgggtcccggcagccgtccgcgcgcccgggcgcaggtttggttttcctaaacaaatcctttcacagggaccgacggcacttgataatgtgacaaaaaccagcctcttccaccccactgcagtgacttttgccggaaagtggagcagtgggcacggccaaccttgtcgttcatcaatgccgcccctggcagtatctgaggatcggtggcagccatgcctccccctgccccagccgctccttcccccccacgctaatctgcatggtgtgggcgcccttgggacccccgaggactgattgtctgaccttgcttcacacgcccagtaaggactcccccaagatgtcgctcgagtggctggtggcctggagctggtcgctggatggcctgagggactgcatcgccaccggcatccagtccgtgcgggactgcgacaccaccgctgtcatcactgtggcctgcctcctggtcctcttcgtgtggtactgttatcacgtgggcagggagcagccccggccctacgtctccgtcaactccctcatgcaggctgccgatgccaacgggctgcagaatggctacgtgtactgccagtcccctgagtgcgtgcgctgcacccacaacgagggcctcaaccagaagctgtaccacaacctgcaggagtacgccaagcgctactcctggtccggcatgggccgcatccacaagggcatccgcgagcagggccggtacctcaacagccggccctccatccagaagcccgaggtcttcttcctgcccgacctgcccaccacgccctatttctcccgggacgcacagaaacatgatgtggaagtgctggaacggaacttccagaccatcctgtgtgagtttgagaccctctacaaagctttctcaaactgcagcctcccgcaaggatggaaaatgaacagcacccccagcggggagtggttcaccttttacttggtcaatcagggggtttgtgttcccaggaactgtaggaagtgcccacggacgtaccgcttgctcggaagccttcggacctgtattgggaacaatgtttttgggaacgcgtgcatctctgtgctgagccctgggactgtgataacggagcactatggacccaccaacatccgcatccgatgccatttaggtctgaaaactccaaatggctgtgagctggtggtggggggagagccccagtgctgggcagaagggcgctgccttctctttgatgactctttcctgcatgctgcgttccatgaaggttcagcagaggatggcccacgggtggttttcatggtggatttgtggcatccaaacgtcgcagcggccgaacggcaggctcttgatttcatctttgctccgggacgatgagagtatttcccatgctggagtcggcgagaagggccgaggcggggcctgggcagactgtggtccggtccagtccctaccggtgttgtttccatgctcagaaacctgcctcagcggaaagctcttatttgggattttatatcatgtcgggtccctctttcccttggttattgtaaatggaaacttttcggcttgtatttccttagattttttttttttccttccaatcatttgcttcagagactcctttctggcctaacagcgcattcctttgattggtccttgagtgaccagagacttagtgcccttgtaagtctgtcttctgttgctacttgtttttttcagtgctctgaaatagagtaactaaatggttatttgtctgaatataataatgtaaaacttcttgtggtcatcttaaaaaaaaaaaaaaaaaactaaaaactgcaaaccagagagctagagaacttggcctctgatgctggcacactggggacccttcagccacctgacggcagggggacagtctgcagcccccacacctgactggcttcagtagccaggtggaggggctgccagacacagtcagggtggcacacagtgtccaggcccagggatactgtcaccatcgctcacctcattctaaaccttgtcaggtccctgatggcaaaagcattgggccagtaggactggaggctactctttaaacatggctttcctgcaaagctgaagctggtgtcccccagcaccaagctgcggctcacacagatcagccacggaacgtgtgatccgcttacctcactgcctacagaagccctactgccaaactgggcctggaaaattcccagttttaggtgttttgagtccacagtgatgaacgttaaggccaccaggttggctgataggagctgtagggggataggaccgcgctcacccagcgacatttggggaaagcctttctctggcaaaactggaataatagatctgaccaaagtttctgttttgctttggagttctgttgcctatgtttttttttttttcatttatttgtctgtacataaatgttcaaacactagacttggagatagtggaagagttggccctgtgtctttgtcatggcacaaaggtgtgcactgcgtgacaatgacccaagccagtgtgtgctagtgaggagacagagaagacctacatgcccagaggacccgtggccgttgtgctggttttctggtctcctgtgaagaacatgtggatctcttcccgaaggaaaaggtcccaggagaccagtttgaggcactcactctagaaatagcctgtgttagctgatgtgtgaaagcgtagccggccagccacactagagatgccttttctgaataatgtattatgagcagtgtcagatttataaagccgaggagtggtttggaatatacagctggtcgcaggtgcaggtccagtgtttagatccaaatggaaaacagcagcttctaagaggtacaactgttggaagaaaacacagttgaaatgcaccaggcaggtactagcaagtgtgcaaagagcacgtctacatttgagtaaaatgtctacacagatatttgtcagtgatgagaatgcaggaaaaggcagacatttcaaacatacctgaagtctttttactcattatcttgttaaagaatcactgaggtgcatgatttctacacatcgtgactgctctgctctgcgtttacaaaaccaacagcccgcgcaggtacctagctacctgcattcatgtgacatgtctggggaacagaagataaataaaggatcttgctgaaaaccaga

SEQ ID NO: 109183 - DNA, 848 bp, Homo sapiens
  Payload ID: 1445
  Gene Symbol: ASPDH
  Gene Name: aspartate dehydrogenase domain containing
  Uniprot ID: A6ND91
  ENST ID: ENST00000376916
  CDS Start-End: 182-718
gctgccgcagcctgcgccatttccgatgccaggcaccctcaaggcacagaggctggggctcatgttgggggcacttggcctctccaggcctcgaaggcttctcctgggctgacgcgagctggggaacgggagggacggacgtgggagcgagaacgtcacactggaggcagctggtggcacgatgggggacagagtgaaaggtagcaagtcaaggcgccctgatctggttgtggaagtggcccatcccaaaataatccatgaatctggggcacaaatcctgcgccatgccaatctcctgagccttcgtgtcaccatggccacacaccccgatggcttccggcttgagggacccctggctgcagcccacagccctgggccttgcactgtgctctacgaaggccctgtccgtgggctctgcccctttgccccgcgaaattccaacaccatggcggcggctgccctggctgcccccagcctgggcttcgatggggtgattggggtgctcgtggctgataccagcctcacggacatgcacgtggtggatgtagagctgagcggaccccggggccccacgggccgaagctttgctgtgcacacccgcagagagaaccctgccgagccaggcgcggtcaccggctccgccaccgtcacggccttctggcagagcctcctggcctgctgccagctcccctccaggccggggatccatctctgctgagaagcctcctccctcccgagacaagatcatctgcctggcctctcaccaccaccatcccacccctgccctgccccacttccccagggtctcccttctgactcagtaaagatcaccgctgcctccccccgca

SEQ ID NO: 109184 - DNA, 1040 bp, Homo sapiens
  Payload ID: 1445
  Gene Symbol: ASPDH
  Gene Name: aspartate dehydrogenase domain containing
  Uniprot ID: A6ND91
  ENST ID: ENST00000389208
  CDS Start-End: 63-914
gccttgtgcagcgggcagcgagcagcccagggagccaggccccagacaccgcactcagggccatggccgacaggggcccgtggagggtgggcgtggtgggctatggccgcctcggacagtccctcgtctcccgcctcttggctcagggaccagaacttggcctagaacttgtttttgtctggaatcgtgacccaggacgaatggcagggagcgtgcccccttccctgcagctccagaaccttgctgcccttggggaaaggcgccctgatctggttgtggaagtggcccatcccaaaataatccatgaatctggggcacaaatcctgcgccatgccaatctcctggtggggtccccctcagctctaagtgaccagaccacagagcggcagctcttggaggcctcacagcactgggaccacgccgtgtttgtggcccgaggggccctgtggggcgctgaggacatcaggagattggatgcagctgggggcctccggagccttcgtgtcaccatggccacacaccccgatggcttccggcttgagggacccctggctgcagcccacagccctgggccttgcactgtgctctacgaaggccctgtccgtgggctctgcccctttgccccgcgaaattccaacaccatggcggcggctgccctggctgcccccagcctgggcttcgatggggtgattggggtgctcgtggctgataccagcctcacggacatgcacgtggtggatgtagagctgagcggaccccggggccccacgggccgaagctttgctgtgcacacccgcagagagaaccctgccgagccaggcgcggtcaccggctccgccaccgtcacggccttctggcagagcctcctggcctgctgccagctcccctccaggccggggatccatctctgctgagaagcctcctccctcccgagacaagatcatctgcctggcctctcaccaccaccatcccacccctgccctgccccacttccccagggtctcccttctgactcagtaaagatcaccgctgcctccccc

SEQ ID NO: 109185 - DNA, 310 bp, Homo sapiens
  Payload ID: 1445
  Gene Symbol: ASPDH
  Gene Name: aspartate dehydrogenase domain containing
  ENST ID: ENST00000598657
  CDS Start-End: 156-310
tgccaggcaccctcaaggcacagaggctggggctcatgttgggggcacttggcctctccaggcctcgaaggcttctcctgggctgacgcgagctggggaacgggagggacggacgtgggagcgagaacgtcacactggaggcagctggtggcacgatgggggacagagtgaaaggtagcaagtcaaggcgccctgatctggttgtggaagtggcccatcccaaaataatccatgaatctggggcacaaatcctgcgccatgccaatctcctggtggggtccccctcagctctaagtgaccagaccacaga

SEQ ID NO: 109186 - DNA, 637 bp, Homo sapiens
  Payload ID: 1445
  Gene Symbol: ASPDH
  Gene Name: aspartate dehydrogenase domain containing
  ENST ID: ENST00000601207
  CDS Start-End: 235-637
gggggcacttggcctctccaggcctcgaaggcttctcctgggctgacgcgagctggggaacgggagggacggacgtgggagcgagaacgtcacactggaggcagctggtggcacgatgggggacagagtgaaaggcgccctgatctggttgtggaagtggcccatcccaaaataatccatgaatctggggcacaaatcctgcgccatgccaatctcctgagccttcgtgtcaccatggccacacaccccgatggcttccggcttgagggacccctggctgcagcccacagccctgggccttgcactgtgctctacgaaggccctgtccgtgggctctgcccctttgccccgcgaaattccaacaccatggcggcggctgccctggctgcccccagcctgggcttcgatggggtgattggggtgctcgtggctgataccagcctcacggacatgcacgtggtggatgtagagctgagcggaccccggggccccacgggccgaagctttgctgtgcacacccgcagagagaaccctgccgagccaggcgcggtcaccggctccgccaccgtcacggccttctggcagagcctcctggcctgctgccagctcccctccaggccggggatccatctctgct

SEQ ID NO: 109187 - DNA, 1300 bp, Homo sapiens
  Payload ID: 1446
  Gene Symbol: DRICH1
  Gene Name: aspartate-rich 1
  Uniprot ID: Q6PGQ1
  ENST ID: ENST00000317749
  CDS Start-End: 299-988
agtcagtagctcgcagtggagggaggaggagctccaactgtgctctttgatggcagtttttgcacctttgggtgcttgtcatgttcgtttatttttcaaagaagacagcaggtccctgacctcatagaccagctagtttgggaggtggcggcagaataagggctgaggacccagatctgcctggggtcaggctgcttctaaaagtgcagggccaccctcagtagtgtggctgctagggcagcacagttacaatttcgctgaaggctgaggcaggagtggagaggcatggagaggccccatggggaatatactgacctgttgtatcaactcccactgtggctggcccagggggaaggacgcaccctgttatgaatctgatactgatatttatgagactgtggctgctgcaacatcagaatccactactgtagagcctggcaagctggatgtgggagccacggagggccaagacctgcagcacatcagcaaccaaaagatgcccacaggtccccctgaggaccgcctgagtttaaaatttctgccatcaagtgaggaagacaatgatgatgccaagattttaccatcacctgtccagggttcttctgaggacaacctgagtttagtatgcctaccacgaagtgaagatgatgactgtgatgatgatgatgatgatgatgcccagattttaccgtcacgtgtccagggtggctgttaccggtttgatagcagttcttgttcttctgaggacaacctgagtttagtatgcctaccacgaagtgaagatgatgactgtgatgatgatgatgatgatgcccagattttaccgtcacctgtccaggcttgttctgaagatagcctgtttttaagatgctcactgagacacaaagatgaagaagaagaagatgatgatgacatccacataacagctcggatagaaagtgacttgacgctggagagtctaagtgatgaagagattcatccagggtgaagcccttctgtggagctgaccagggtgctgacccaaagggcaggccagcgcgtgctgcagggtccccagctttgcccctggaggtctcaatcctctctacattctgaggaaaactcttggtcccagcagagagaaaaagtccaaggctgcttcccacccaccgccagcactaggtttggcctgtaccatccaggacccagtgcttctgggcctggcatttctcctttggcaagagagtgagaagagacgtgactgtgctccacgagcagaaagtgccattcccacttgaaataaagagactgagtgcattta

SEQ ID NO: 109188 - DNA, 687 bp, Homo sapiens
  Payload ID: 1446
  Gene Symbol: DRICH1
  Gene Name: aspartate-rich 1
  Uniprot ID: Q6PGQ1
  ENST ID: ENST00000614553
  CDS Start-End: 1-687
atggggaatatactgacctgttgtatcaactcccactgtggctggcccagggggaaggacgcaccctgttatgaatctgatactgatatttatgagactgtggctgctgcaacatcagaatccactactgtagagcctggcaagctggatgtgggagccacggagggccaagacctgcagcacatcagcaaccaaaagatgcccacaggtccccctgaggaccgcctgagtttaaaatttctgccatcaagtgaggaagacaatgatgatgccaagattttaccatcacctgtccagggttcttctgaggacaacctgagtttagtatgcctaccacgaagtgaagatgatgactgtgatgatgatgatgatgatgatgcccagattttaccgtcacgtgtccagggtggctgttaccggtttgatagcagttcttgttcttctgaggacaacctgagtttagtatgcctaccacgaagtgaagatgatgactgtgatgatgatgatgatgatgcccagattttaccgtcacctgtccaggcttgttctgaagatagcctgtttttaagatgctcactgagacacaaagatgaagaagaagaagatgatgatgacatccacataacagctcggatagaaagtgacttgacgctggagagtctaagtgatgaagagattcatccaggt

SEQ ID NO: 109189 - DNA, 2177 bp, Homo sapiens
  Payload ID: 1447
  Gene Symbol: ASPRV1
  Gene Name: aspartic peptidase, retroviral-like 1
  Uniprot ID: Q53RT3
  ENST ID: ENST00000320256
  CDS Start-End: 578-1609
gcagcagttgagtccatgtaagatgattgtgcacgtgtgtgtgtgtgtgtgtgtgtgtgtgtgtgtcctcactcacttaaaaaagaccatttctgtgcattctttatgctggaaccctcctctgcctccctctccaggaaatcccataggatcccatacctgctttagaatgtgtgtgagacacttcccagtgcctggcatgtggtaggagctcagtacatgtaaactgttttcctttgaccactcaaagtagtcacttgttggggaggccaatggcggcttccccggtctctgagctgatgggcgtctggtccctgcctccccttccttcactggctgatgacaaatacctgaatgtcatcacatcctccgtgtcctcatctgttattctggaacacaggccagggagggtacagggtagtcccccttcaacagaggctggcctttcttgggatgtgggctggctggtgttggtccaaggatggatgcagagggtgaggcacccatcctgctagtccggccggatgctggcaggagggcggggtgaggaggggcggagcttccagaacaaaggagaatggggagcccaggggccagcctaggcatcaaaaaggctctgcagagtgaacaggccacagcactgcctgcctctgccccagcagtcagccagccgaccgcgcctgctccctcctgcttgcccaaggccgggcaagtcatccccactctgcttcgagaggccccgttttccagcgtgattgcgccgacactgctctgtgggtttctcttcttggcgtgggttgctgctgaggttccagaggagagcagcaggatggccgggagcggagccaggagtgaggaaggccgccggcagcatgccttcgtcccggaaccttttgatggggccaatgtcgtcccaaacctctggctgcacagctttgaagtcatcaatgacctcaaccattgggaccatatcaccaagctaaggttcctgaaagagtccctcagaggagaggccctgggtgtctacaataggctcagtccccaggaccagggagactatgggactgtgaaagaggccctcctgaaggcctttggggtccctggggctgcccccagccacctgcccaaagagatcgtctttgccaacagcatgggtaagggctactatctcaaggggaagattggcaaagtgcccgtgaggttcctggtggactctggggcccaggtctctgtggtccacccaaacttgtgggaggaggtcactgatggcgatctggacaccctgcagccctttgagaatgtggtaaaggtggccaatggtgctgaaatgaagatcctgggtgtctgggatacagcggtgtccctaggcaagctgaagctgaaggcacagttcctagtggccaatgcgagtgccgaggaagccatcattggcactgatgtgctccaggaccacaatgctatcctggactttgagcaccgcacatgcaccctgaaagggaagaagtttcgccttctgcctgtgggagggtccctggaagatgagtttgacctggagctcatagaggaggacccctcctcagaagaagggcggcaggagctatcccactgagaagccaccttttctttaacctcctaaatattggtgggaagacccaccgctgtggggggggttgcatatcctcatgggggtcactgggcttggccagtctgcttatcaactcttgctcttctctcccctttgcctccctctgcaggggccttaatctgcccctggtaggggaggcttccactgaacaggcacaggtgagggagagcaggctggcttagagggacagggtccccatggtcatcaagctgctgttgatgacaaagactcaaaggctggaagagctcccaaggaagctagaaatgcttgtctttgaaagaactgtgggaccccttcagattccctgaggtatggcttggtcactctcaggtcctcaaagcctgtcttagttgggctgggtcctagctgcagggtctttgtgagggtcacagttgctctgggacacctccctgaagagcctttccacctgtacaatcgtattttctttctgtcatttgctttgaagcccattgtgccttatgccaataattcaattgctgcaaacaccaataaagattgattcatggaaaaa

SEQ ID NO: 109190 - DNA, 5431 bp, Homo sapiens
  Payload ID: 1448
  Gene Symbol: ASPA
  Gene Name: aspartoacylase
  Uniprot ID: P45381
  ENST ID: ENST00000263080
  CDS Start-End: 159-1100
ttgtaacagaaaattaaaatatactccactcaagggaattctgtactttgccctttgggtaaagtctcatttacatttctaaacctttcttaagaaaatcgaatttcctttgatctctcttctgaattgcagaaatcagataaaaactacttggtgaaatgacttcttgtcacattgctgaagaacatatacaaaaggttgctatctttggaggaacccatgggaatgagctaaccggagtatttctggttaagcattggctagagaatggcgctgagattcagagaacagggctggaggtaaaaccatttattactaaccccagagcagtgaagaagtgtaccagatatattgactgtgacctgaatcgcatttttgaccttgaaaatcttggcaaaaaaatgtcagaagatttgccatatgaagtgagaagggctcaagaaataaatcatttatttggtccaaaagacagtgaagattcctatgacattatttttgaccttcacaacaccacctctaacatggggtgcactcttattcttgaggattccaggaataactttttaattcagatgtttcattacattaagacttctctggctccactaccctgctacgtttatctgattgagcatccttccctcaaatatgcgaccactcgttccatagccaagtatcctgtgggtatagaagttggtcctcagcctcaaggggttctgagagctgatatcttggatcaaatgagaaaaatgattaaacatgctcttgattttatacatcatttcaatgaaggaaaagaatttcctccctgcgccattgaggtctataaaattatagagaaagttgattacccccgggatgaaaatggagaaattgctgctatcatccatcctaatctgcaggatcaagactggaaaccactgcatcctggggatcccatgtttttaactcttgatgggaagacgatcccactgggcggagactgtaccgtgtaccccgtgtttgtgaatgaggccgcatattacgaaaagaaagaagcttttgcaaagacaactaaactaacgctcaatgcaaaaagtattcgctgctgtttacattagaaatcacttccagcttacatcttacacggtgtcttacaaattctgctagtctgtaagctccttaagagtagggttgtgccttattcaactgcatacatagctcctagcacagtgccttattcggtaggcatctaagcacatttcttaaattaattaatatatctttaaagatatcatattttatgtatgtagcttattcaaagaagtgtttcctatttctatatagtttattatacatgatacttgggtagctcaacattcttaataaacagcctttgtattcagaatataaaattgaaatagatatatataaagttatttgttttattgtgctttgccttactacacttcacggatactgtacttgtactttttttccaaattgaaggtttttggcaaccctgtgtctagaaagtctaacagtgccatgtttccaacagcatgtgctcactccttgtctctgtgtcaccctttgataatatttcaagcttttttatgatttatttattatatctgctatggtgatctgtgatcagtggcctttgatgttactgttgttaagtgttttggggcaccatgaatcgtgcccatgtgagactgcgaacttagtgaatgttgtgtgagttctaactgctctactgaccggccatttccttgtctctctccctgtcctctggcctccctgttccttgagacacaataattaataagtctacagcagactctgtgtgttcaagtgaaagaaagggtcatacttctagaaattaagcttagtaaggaaggcatgtcaaaagctgagacaggctgaaagctaggcctcttgcactggttagccaagttgtgaattcaaagaaaaggatcttgaagaaaattaaaaattctactccagtgcacacacacaaatgataagaaagcaaaacaaccttattgctgatatggagacagttttagtggtctggatagaagatcaaaccagccacacattaagccaaagcatgacccacagcaaggccctaactctcttcaattctgtgaaggctgagagaggtgaggaagctgcaggaagctgggagaggttggttcacaaggtttaaggaaagaagacagctctaaaacctacaagtggaaagcgaaccagcaagttgctgatgtggaagctgtagcaagttatccagaagatgtagctaaaatcattgacaaagatggctacactaaacaacggatcttcagtgtagttgaaacagccttctattggaagaagatgctatctaggactttcctagctagaggggagaaatgaatgcctagcttcaaagcttcaaaggacagcctgactctcttaagagctaacacagctggtgactttgggttaaagccaaagctcattaactgtttcaaaaatcctaaaactcttgttttttgttttttttttgagacggagtcttgctctgtcgtccaggctggagtgcagtggcgcaatctcggctcactgcaagctccgcctcccaggttcatgccattctcctgcctcagcctccccagtagctgagattacaggtgcctgccaccacgcccggctaattttttgcatttttttagtagagatggggtttcactctgctagccaggatggtctcgatctcctgacctcatgatccgcctgcctcggcctcccaaagtgctgggattacaggcatgagccaccacgcccggcccaaaaatcgtaggactctgaagactgatgctaaacctgctgtgtctgagctctataaatggaacaacaaagcctcgctggcagcacatctgtttgcggcatggtttactgtatattttaagcccactgttgagacctactgcttgggaaaaaaaaaaattcctttcaaaatactactgctgattgacaatacaccatgttacccaagagctctgctggagatgtgcgaagagattagcattgttttcgcgcctgctaccacgacatccagccgaagcccatggatcaaggcgtcattgtgactttcaaatctaactatttaagaaatacatttcaggctgggggaggggagaaaaaagaaaaaaaagaaaggaagaaaaaaatcatttcataaggctatagctgccatagatagtgattcctctgatggagctgggcaaagtaaacagaaaacctctggaaaggattcagcattccagatgccattaagaacattcaggatccgtgggaggagatcaaaatatcaacattaacaggagtttggaaaaagtgaattccaaccctcttggatgactctgaggaattcgagacttgagtaaaggaagtcatgcagatgtacagcaagagaatgagaagtggagcctgaagatgtaactgaactgctgcaatctcatgatcacacttgaatggatgaggagtcgcttcttataaatgagcaaaaaagtggtttcttggctgcaatcaactcttgttgcagatgctgtgaacactgttgaaatgacaaaggatttagaatattacgtaaacatagttgataaagcagcagcagggtttaagaggattgactcctattttgaaatgagttcggctgggagaagtggctcatgcctgtcgtcctagcactttgggaggccaaggcagacagagcacctgaggtaaggagttcgagaccagcctggccaacatggtgaaaccccctctctactaaaaataccaacatattagccaggcgtggtggcacgtgcctgtagtcccagctacttgggaggctgaggcagaaggatcacttgaacccaggaggcagaggttgcagtaagccaagactgcgccactgcactccagcctggtggacacagcaagcctccatctcaaaaaaaaaaaaaaaaaaaaaatgagttctactgtgaataaaatgttattaaacagcatttcatgctacagagaaatctttcacgaaaggaagagtcaatcaatgcagcgaacttgttgttttattttaagaaattgtcacggccatcccaaccctcagtgcccaaccaccctgatcaggcagccatcatcaaggcaaggccctccaccagcaaaaagatcatgaattgctgaaagctcaaatgatggttagcttttttagcaataaagcatttttaatgaaggaatgtacatgttttagatataatgctattacacatttaacatactacatatagtgtgagcataacttttacacgtactggaaaatcaaaaaatatgtgtggctcatctgttataatgtttgttttattgtggtgatctggagccaaggctgaaatatctctgaggtatgcctgtaatgtataagtgctagtagaaatgagttgtgcagaattgctatttttttcaatttttatatttgggttaatggtaatatactaagcgtccagtctataaacttcagcattcgttgcgaaatccagaggagacttttaagtgctgttttgtagatgaaatatgaaagagaaacaagggcttaatggtaaagatgacatatgactatattaagaaactgaatggccctttgtccacaaacagtaacccacacagcattgctactgtggcatgcccactgctctgcactgacctcatggagcagagaacctccttcagacacctcacgcaccccctgaggagctaatgtttcttcccaacatggaaaatttggaagaggcctattcttcacagctgtcacttctcattttgaaagaatatgcccacccttattcgcaggcaaggtgtgaggaggtctttgggctccagctgttgccagcagaggtggtgaaagtcaacaacagggcactggacacacatagaaatgtgacccacagctatggtttgcaaatacagtctttcaagaagtcctgccatgtcctaaatgcccaaaccccttgcctcccatgattcttctcctcaaaggaccttctgctggacgccgccccctccctctccagccccaccagggccctccccgccatcctcttaggccacagcagccaataaagagtgtttttattccatgatctgtacccccaatgaatccataatcatagtttcaaatgtatttaccaaaaatactaacattatctggaatgaatgaatgaatgaatgaatgaataaatattatatatttatacattttcattcttccaaagtgaaccccactatgccagttttactccatactcagtgttctggaaagcccatattctttctaaatttttcagcatttttttctatttttgtactttaccaaaattatttacattggaataaactctcttccttctgaattctgtagtaaaaa

SEQ ID NO: 109191 - DNA, 1090 bp, Homo sapiens
  Payload ID: 1448
  Gene Symbol: ASPA
  Gene Name: aspartoacylase
  Uniprot ID: P45381
  ENST ID: ENST00000456349
  CDS Start-End: 149-1090
tttcggaagttaacttggtataagagtatgaaaagcctctgttgctctacttctgaggaaatgctctcctttttcctaataaagctttccacagaagacaaactctgtacacaaaaaacaagaaatcagataaaaactacttggtgaaatgacttcttgtcacattgctgaagaacatatacaaaaggttgctatctttggaggaacccatgggaatgagctaaccggagtatttctggttaagcattggctagagaatggcgctgagattcagagaacagggctggaggtaaaaccatttattactaaccccagagcagtgaagaagtgtaccagatatattgactgtgacctgaatcgcatttttgaccttgaaaatcttggcaaaaaaatgtcagaagatttgccatatgaagtgagaagggctcaagaaataaatcatttatttggtccaaaagacagtgaagattcctatgacattatttttgaccttcacaacaccacctctaacatggggtgcactcttattcttgaggattccaggaataactttttaattcagatgtttcattacattaagacttctctggctccactaccctgctacgtttatctgattgagcatccttccctcaaatatgcgaccactcgttccatagccaagtatcctgtgggtatagaagttggtcctcagcctcaaggggttctgagagctgatatcttggatcaaatgagaaaaatgattaaacatgctcttgattttatacatcatttcaatgaaggaaaagaatttcctccctgcgccattgaggtctataaaattatagagaaagttgattacccccgggatgaaaatggagaaattgctgctatcatccatcctaatctgcaggatcaagactggaaaccactgcatcctggggatcccatgtttttaactcttgatgggaagacgatcccactgggcggagactgtaccgtgtaccccgtgtttgtgaatgaggccgcatattacgaaaagaaagaagcttttgcaaagacaactaaactaacgctcaatgcaaaaagtattcgctgctgtttacattag

SEQ ID NO: 109192 - DNA, 563 bp, Homo sapiens
  Payload ID: 1448
  Gene Symbol: ASPA
  Gene Name: aspartoacylase
  ENST ID: ENST00000577034
  CDS Start-End: 328-563
aggggaagccgcgtggtgtgcgaccctgggcgttgagctccaggcttcctggcaaagaggactgtggattcctggccctgtgaccttgggcaaaaaatgaggaagattcataagtaagttaacacagaattaccaaaaacctcatgagaaagaaatgaagggatgtttcagggtagcttttcgagtcccaagtgatcattgatttggcccttctgtttctgattgtgaaaaagcattctgaaagaatgggcgccggttcaagaggaggtctctgagggtcagcctttggctgtttatagagaaatcagataaaaactacttggtgaaatgacttcttgtcacattgctgaagaacatatacaaaaggttgctatctttggaggaacccatgggaatgagctaaccggagtatttctggttaagcattggctagagaatggcgctgagattcagagaacagggctggaggtaaaaccatttattactaaccccagagcagtgaagaagtgtaccagatatattgactgtgacctgaatcgcatttttgaccttgaaaatcttgg

SEQ ID NO: 109193 - DNA, 584 bp, Homo sapiens
  Payload ID: 1448
  Gene Symbol: ASPA
  Gene Name: aspartoacylase
  ENST ID: ENST00000571278
  CDS Start-End: 137-307
actccactcaagggaattctgtactttgccctttgggtaaagtctcatttacatttctaaacctttcttaagaaaatcgaatttcctttgatctctcttctgaattgcagaaatcagataaaaactacttggtgaaatgacttcttgtcacattgctgaagaacatatacaaaaggttgctatctttggaggaacccatgggaatgagctaaccggagtatttctggttaagcattggctagagaatggcgctgagattcagagaacagggctggagcaaaaaaatgtcagaagatttgccatatgaagtgagaagggctcaagaaataaatcatttatttggtccaaaagacagtgaagattcctatgacattatttttgaccttcacaacaccacctctaacatggggtgcactcttattcttgaggattccaggaataactttttaattcagatgtttcattacattaagacttctctggctccactaccctgctacgtttatctgattgagcatccttccctcaaatatgcgaccactcgttccatagccaagtatcctgtgggtatagaagttggtcct

SEQ ID NO: 109194 - DNA, 2425 bp, Homo sapiens
  Payload ID: 1449
  Gene Symbol: DNPEP
  Gene Name: aspartyl aminopeptidase
  Uniprot ID: Q9ULA0
  ENST ID: ENST00000273075
  CDS Start-End: 222-1679
gcccgccgaggggcggggctgaccgaggtgggcggggcggatgccgaggggcggggagaggtgggcggggaggccaaacatggggcggggcggcgcggccggggaagcgtgatgaaggcctacgagtgcggcgcggcctgaaggggcacgcgggggacctgcaaagctagtgaggggcggggcaggcggcgcggtgggggcgggccgagcccggaggccagatgagcggacacagccccacgcgcggggccatgcaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgcggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaagggcttctttgagctgttcccttctctaagccataatctcttagtggattgagccctcttggaaagacttctctgccatccctttgcacctgagaggggaagttctcagctgagctgaagctggattattaaagtggattgtcactcagactctccgtgctacgcttatttggagactagaggagtgggagttgagcctggcttgaacctttggaaccagaaaagttggggagcaggtggaggaggccacactcctgggagctgatggttttaaatctggttttaaatctcttctctgtctcaagtccatgtctgaagtgggtgaagggtggactggatcctcaagcagaaggtcacttctcccacccctagtcctccacctgggaaatggcctcaacggtcttccctctttccatccccagaatgggtgtcccgctctgccttcagagatcctgttctgcactgggccaccttcagagctgctctgggcagacaaagctgtttctcaccctcccaaaatcccttcccatcccctctcaggagctgcaaagagaagggcacagtctataccttatcacccttcatcatccacttctcagcagtccctggtattacttgattgtgaacatattatcaggaaaaaagattatcattgaaaaaattggaaaagtcaaagtctggccgggtgcagcggctcacatctgtattcccagcattttgggaggccaaggcaggtggatcacttgaggtcagagttcaagaccagccttgccaacatggtgaaacccatctctactt

SEQ ID NO: 109195 - DNA, 925 bp, Homo sapiens
  Payload ID: 1449
  Gene Symbol: DNPEP
  Gene Name: aspartyl aminopeptidase
  ENST ID: ENST00000322176
  CDS Start-End: 114-925
gtgatgaaggcctacgagtgcggcgcggcctgaaggggcacgcgggggacctgcaaagctagtgaggggcggggcaggcggcgcggtgggggcgggccgagcccggaggccagatgagcggacacagccccacgcgcggggccatgcaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctctgtgccctcctcgcaatccccccacaacccacgtctccccacagagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacaccca

SEQ ID NO: 109196 - DNA, 1657 bp, Homo sapiens
  Payload ID: 1449
  Gene Symbol: DNPEP
  Gene Name: aspartyl aminopeptidase
  ENST ID: ENST00000373963
  CDS Start-End: 136-279
ggggcggcgcggccggggaagcgtgatgaaggcctacgagtgcggcgcggcctgaaggggcacgcgggggacctgcaaagctagtgaggggcggggcaggcggcgcggtgggggcgggccgagcccggaggccagatgagcggacacagccccacgcgcggggccatgcaggtggccatgaacggtaaggcccgcaaagaggcggtgcagactgcggctaaggaactcctcaagttcgtgaaccggagtccctctcctttccatggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgcggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaagggcttctttgagctgttcccttctctaagccataatctcttagtggattgagccctcttggaaagacttctctgccatccctttgcacctgagaggggaagttctcagctgagctgaagctggattattaaagtggattgtcactca

SEQ ID NO: 109197 - DNA, 1875 bp, Homo sapiens
  Payload ID: 1449
  Gene Symbol: DNPEP
  Gene Name: aspartyl aminopeptidase
  ENST ID: ENST00000373966
  CDS Start-End: 139-249
ggcggggcggcgcggccggggaagcgtgatgaaggcctacgagtgcggcgcggcctgaaggggcacgcgggggacctgcaaagctagtgaggggcggggcaggcggcgcggtgggggcgggccgagcccggaggccagatgagcggacacagccccacgcgcggggccatgcaggtaagtggctcccgacggccccacttgaatttcgatcccagaccgggtccggcgccctccggggcccaagcttagcgcggtgctgcagtggggccgcctgacccaaagcgaaaccgaaagccccgcggagggtgacctgacgactttcccgggactggaagggggagtcctgcgagagactaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgcggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaagggcttctttgagctgttcccttctctaagccataatctcttagtggattgagccctcttggaaagacttctctgccatccctttgcacctgagaggggaagttctcagctgagctgaagctggattattaaagtggattgtcactca

SEQ ID NO: 109198 - DNA, 1578 bp, Homo sapiens
  Payload ID: 1449
  Gene Symbol: DNPEP
  Gene Name: aspartyl aminopeptidase
  ENST ID: ENST00000373972
  CDS Start-End: 248-1480
taagagtacatagttgatggggcagttgtgaagattaaacgaggtggctgtggcgagagacagcactttgtaccgtacccgtcggacccggtggccatgaacggtaaggcccgcaaagaggcggtgcagactgcggctaaggaactcctcaagttcgtgaaccggagtccctctcctttccatggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgcggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaagggcttctttgagctgttcccttctctaagccataatctcttagtggattgagccctcttggaaagacttctctgccatccctttgcacctgagaggggaagttctcagctgagctgaagctggattattaaagtggattgtcactcaga

SEQ ID NO: 109199 - DNA, 896 bp, Homo sapiens
  Payload ID: 1449
  Gene Symbol: DNPEP
  Gene Name: aspartyl aminopeptidase
  ENST ID: ENST00000429013
  CDS Start-End: 77-896
cgggctgaagctttcaacggagtttcagccctgggtttgggtctctcggtggggacgggcggaagcagaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgcggtcttgggtggtgcctatgatgagttcatctttgctcctcggctggacaatctgcacagctgcttctgtgccctgcaggccttgatag

SEQ ID NO: 109200 - DNA, 1091 bp, Homo sapiens
  Payload ID: 1449
  Gene Symbol: DNPEP
  Gene Name: aspartyl aminopeptidase
  ENST ID: ENST00000457935
  CDS Start-End: 98-1091
tgcaagttggggcccaaggcaggggaaggatccggcaaaaaaggcacacggttcaggcctgtccactccagccttgggaggaggtgagcaggtcaccatggctcggagcctctccatcatgttcgtccccaacagctggctcaatggctaccacaaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatg

SEQ ID NO: 109201 - DNA, 638 bp, Homo sapiens
  Payload ID: 1449
  Gene Symbol: DNPEP
  Gene Name: aspartyl aminopeptidase
  ENST ID: ENST00000434339
  CDS Start-End: 226-638
aaggcaggggaaggatccggcaaaaaaggcacacggttcaggcctgtccactccagccttgggaggaggtggccatgaacggtaaggcccgcaaagaggcggtgcagactgcggctaaggaactcctcaagttcgtgaaccggagtccctctcctttccatggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggac

SEQ ID NO: 109202 - DNA, 577 bp, Homo sapiens
  Payload ID: 1449
  Gene Symbol: DNPEP
  Gene Name: aspartyl aminopeptidase
  ENST ID: ENST00000430206
  CDS Start-End: 227-577
gggctgaagctttcaacggagtttcagccctgggtttgggtctctcggtggggacgggcggaagcagaggtggccatgaacggtaaggcccgcaaagaggcggtgcagactgcggctaaggaactcctcaagttcgtgaaccggagtccctctcctttccatggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaac

SEQ ID NO: 109203 - DNA, 482 bp, Homo sapiens
  Payload ID: 1449
  Gene Symbol: DNPEP
  Gene Name: aspartyl aminopeptidase
  ENST ID: ENST00000519698
  CDS Start-End: 82-219
aggcaggggaaggatccggcaaaaaaggcacacggttcaggcctgtccactccagccttgggaggaggtgagcaggtcaccatggctcggagcctctccatcatgttcgtccccaacagctggctcaatggctaccacaagcacctgttaaaagtggagatccctgggcctcagcccaaatcttccaaatcaggagtttcaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacgg

SEQ ID NO: 109204 - DNA, 673 bp, Homo sapiens
  Payload ID: 1449
  Gene Symbol: DNPEP
  Gene Name: aspartyl aminopeptidase
  ENST ID: ENST00000520694
  CDS Start-End: 3-113
agatgagcggacacagccccacgcgcggggccatgcaggtaagtggctcccgacggccccacttgaatttcgatcccagaccgggtccggcgccctccggggcccaagcttagcgcggtgctgcagtggggccgcctgacccaaagcgaaaccgaaagccccgcggagggtgacctgacgactttcccgggactggaagggggagtcctgcgagagactaggtggccatgaacggtaaggcccgcaaagaggcggtgcagactgcggctaaggaactcctcaagttcgtgaaccggagtccctctcctttccatggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgca

SEQ ID NO: 109205 - DNA, 714 bp, Homo sapiens
  Payload ID: 1449
  Gene Symbol: DNPEP
  Gene Name: aspartyl aminopeptidase
  ENST ID: ENST00000521459
  CDS Start-End: 41-714
gcaggcggcgcggtgggggcgggccgagcccggaggccagatgagcggacacagccccacgcgcggggccatgcaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctgtcttgggtggtgcctatgatgagttcatctttgctcctcggctggacaatctgcacagctgcttctgtgccctgcaggccttg

SEQ ID NO: 109206 - DNA, 576 bp, Homo sapiens
  Payload ID: 1449
  Gene Symbol: DNPEP
  Gene Name: aspartyl aminopeptidase
  ENST ID: ENST00000519905
  CDS Start-End: 308-576
aggcacacggttcaggcctgtccactccagccttgggaggaggtgagcaggtcaccatggctcggagcctctccatcatgttcgtccccaacagctggctcaatggctaccacaagtaaaatgggaaccatggtcctcggctgagagtggggatggaggaagacactggatgaaactctcctccaggaaagcaaagaagcaaatggcccaggagatgcaataggacctctgggcagtacaaagaacacacttaggtggctgtggcgagagacagcactttgtaccgtacccgtcggacccggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggccca

SEQ ID NO: 109207 - DNA, 1662 bp, Homo sapiens
  Payload ID: 1449
  Gene Symbol: DNPEP
  Gene Name: aspartyl aminopeptidase
  ENST ID: ENST00000523282
  CDS Start-End: 83-1564
aaggcaggggaaggatccggcaaaaaaggcacacggttcaggcctgtccactccagccttgggaggaggtgagcaggtcaccatggctcggagcctctccatcatgttcgtccccaacagctggctcaatggctaccacaaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgcggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaagggcttctttgagctgttcccttctctaagccataatctcttagtggattgagccctcttggaaagacttctctgccatccctttgcacctgagaggggaagttctcagctgagctgaagctggattattaaagtggattgtcactcaga

SEQ ID NO: 109208 - DNA, 2107 bp, Homo sapiens
  Payload ID: 1450
  Gene Symbol: AGA
  Gene Name: aspartylglucosaminidase
  Uniprot ID: P20933
  ENST ID: ENST00000264595
  CDS Start-End: 129-1169
agggacgcctgagcgaacccccgagagagcgggcgtgggcgccaggcgggcggggcactggggattaattgttcggcgatcgctggctgccgggacttttctcgcgctggtctcttcggtggtcagggatggcgcggaagtcgaacttgcctgtgcttctcgtgccgtttctgctctgccaggccctagtgcgctgctccagccctctgcccctggtcgtcaacacttggccctttaagaatgcaaccgaagcagcgtggagggcattagcatctggaggctctgccctggatgcagtggagagcggctgtgccatgtgtgagagagagcagtgtgacggctctgtaggctttggaggaagtcctgatgaacttggagaaaccacactagatgccatgatcatggatggcactactatggatgtaggagcagtaggagatctcagacgaattaaaaatgctattggtgtggcacggaaagtactggaacatacaacacacacacttttagtaggagagtcagccaccacatttgctcaaagtatggggtttatcaatgaagacttatctaccactgcttctcaagctcttcattcagattggcttgctcggaattgccagccaaattattggaggaatgttataccagatccctcaaaatactgcggaccctacaaaccacctggtatcttaaagcaggatattcctatccataaagaaacagaagatgatcgtggtcatgacactattggcatggttgtaatccataagacaggacatattgctgctggtacatctacaaatggtataaaattcaaaatacatggccgtgtaggagactcaccaatacctggagctggagcctatgctgacgatactgcaggggcagccgcagccactgggaatggtgatatattgatgcgcttcctgccaagctaccaagctgtagaatacatgagaagaggagaagatccaaccatagcttgccaaaaagtgatttcaagaatccagaagcattttccagaattctttggggctgttatatgtgccaatgtgactggaagttacggtgctgcttgcaataaactttcaacatttactcagtttagtttcatggtttataattccgaaaaaaatcagccaactgaggaaaaagtggactgcatctaatccatctttactgtcaacatctgtatttaaagaagaaagaaacaaaggctgaaaaggctgctcactctcatcatctagtgttcctcatgtgttctaaagtctttttgtaaaataaacacaaaaataaatttatgttgaattggcactttctatatctgaaattgtattatctatttttatttaacctttcttatattatctgaagatgaatatgtatgtggctgtattttgtatatatttaagttttaagtgacacttggatttctgatcagtgttgcaaaaaattgctactttgagatttatttccacagtgatatattaaacccaaaaggaatcatcatatttggatgcttaaaatagagtatacaagttttttagacccaaagaaaaaaacagcagagtctcagcatgatcagtcctgattgaatttcattatgtcacagtgatgcatgtcttagcactgattattggttttacttaatattccctaaaaacttgaggaaggaagatgatagaacatgagatactctttgttttgtacatactagaaaatacagctatcttctgatgagcaattgtgttgattttctttgcttttttcctcttatggagctctcagtgtgtgaaagttctaaagccacaagaatcaatgatgttttagctgctaatatttagtattgatcgtttcttttaaaaatgatttggggaacttgatctgtactgtaattttactaattccttgtgcagaggtgggtatggcaattagaagtcaagaaatgggttgtttagcttggtttgtttccctaacttctgattaactctctgtatgacaactctacagaagttgtgcgcgtgctttctcagcagcatttttccttcaaaatcatctttttaatcaacagtcattaataaatgtacatgtacgatattcaaacttt

SEQ ID NO: 109209 - DNA, 414 bp, Homo sapiens
  Payload ID: 1450
  Gene Symbol: AGA
  Gene Name: aspartylglucosaminidase
  ENST ID: ENST00000510635
  CDS Start-End: 1-414
taggagatctcagacgaattaaaaatgctattggtgtggcacggaaagtactggaacatacaacacacacacttttagtaggagagtcagccaccacatttgctcaaagtatggggtttatcaatgaagacttatctaccactgcttctcaagctcttcattcagattggcttgctcggaattgccagccaaattattggaggaatgttataccagatccctcaaaatactgcggaccctacaaaccacctggtatcttaaagcaggatattcctatccataaagaaacagaagatgatcgtggtcatgacactattggcatggttgtaatccataagacaggacatattgctgctggtacatctacaaatggagactcaccaatacctggagctggagcctatgctgacgata

SEQ ID NO: 109210 - DNA, 464 bp, Homo sapiens
  Payload ID: 1450
  Gene Symbol: AGA
  Gene Name: aspartylglucosaminidase
  ENST ID: ENST00000502310
  CDS Start-End: 1-464
cggaaagtactggaacatacaacacacacacttttagtaggagagtcagccaccacatttgctcaaagtatggggtttatcaatgaagacttatctaccactgcttctcaagctcttcattcagattggcttgctcggaattgccagccaaattattggaggaatgttataccagatccctcaaaatactgcggaccctacaaaccacctggtatcttaaagcaggatattcctatccataaagaaacagaagatgatcgtggtcatgacactattggagactcaccaatacctggagctggagcctatgctgacgatactgcaggggcagccgcagccactgggaatggtgatatattgatgcgcttcctgccaagctaccaagctgtagaatacatgagaagaggagaagatccaaccatagcttgccaaaaagtgatttcaagaatccagaagcattttcc

SEQ ID NO: 109211 - DNA, 2361 bp, Homo sapiens
  Payload ID: 1451
  Gene Symbol: DARS
  Gene Name: aspartyl-tRNA synthetase
  Uniprot ID: P14868
  ENST ID: ENST00000264161
  CDS Start-End: 217-1722
gagaccctgcgcgcggccgccagcgctccgggatctcgagatagccgcagctctcgcgatctttctggagccgcacctccacgcggagtccgagcgcgtgtgctgagaccccagggtcgggagggcggagactgggagggagggagaagcccctttggcctgccttacggaagcctgcgagggagggtggtgtccactgcccagttccgtgtcccgatgcccagcgccagcgccagccgcaagagtcaggagaagccgcgggagatcatggacgcggcggaagattatgctaaagagagatatggaatatcttcaatgatacaatcacaagaaaaaccagatcgagttttggttcgggttagagacttgacaatacaaaaagctgatgaagttgtttgggtacgtgcaagagttcatacaagcagagctaaagggaaacagtgcttcttagtcctacgtcagcagcagtttaatgtccaggctcttgtggcggtgggagaccatgcaagcaagcagatggttaaatttgctgccaacatcaacaaagagagcattgtggatgtagaaggtgttgtgagaaaagtgaatcagaaaattggaagctgtacacagcaagacgttgagttacatgttcagaagatttatgtgatcagtttggctgaaccccgtctgcccctgcagctggatgatgctgttcggcctgaggcagaaggagaagaggaaggaagagctactgttaaccaggatacaagattagacaacagagtcattgatcttaggacatcaactagtcaggcagtcttccgtctccagtctggcatctgccatctcttccgagaaactttaattaacaaaggttttgtggaaatccaaactcctaaaattatttcagctgccagtgaaggaggagccaatgtttttactgtgtcatattttaaaaataatgcatacctggctcagtccccacagctatataagcaaatgtgcatttgtgctgattttgagaaggttttctctattggaccagtattcagagcggaagactctaatacccatagacatctaactgagtttgttggtttggacattgaaatggcttttaattaccattaccacgaagttatggaagaaattgctgacaccatggtacaaatattcaaaggacttcaagaaaggtttcagactgaaattcaaacagtgaataaacagttcccatgtgagccattcaaatttttggagccaactctaagactagaatattgtgaagcattggctatgcttagggaagctggagtcgaaatgggagatgaagacgatctgagcacaccaaatgaaaagctgttgggtcatttggtaaaggaaaagtatgatacagatttttatattcttgataaatatccattggctgtaagacctttctataccatgcctgacccaagaaatcccaaacagtccaactcttacgatatgttcatgagaggagaagaaatattgtcaggagctcaaagaatacatgatcctcaactgctaacagagagagctttacatcatggaattgatttggagaaaattaaggcttacattgattccttccgctttggagcccctcctcatgctggtggaggcattggattggaacgagttactatgctgtttctgggattgcataatgttcgtcagacctccatgttccctcgtgatcccaaacgactcactccttaaattcacactttgccacttaactccagtgtggatgacagagcgagaccctgcctcaaaaaaaaaaaaaaaaaaagaaagccacacttattcttttcagtaacctgctagtgcacaggctgtactttaggtacttaaaatatgcactagaataaatttgcaaggccctaaaatatcactgttatttttggagtaattcagtataggttcgtttaaaagagatttttataacttcagacatgcatcagtaggaaataacttgagaaattcatatggttatgttacaaattcatattctgttactacagtaaacgttaagagttttaaacagttaagattgtacaatttttcttcttttctatattacaagggccccagtgttaatgtcttagattttcagtatttgaacttatttttttaaattctgtcattgagataagaataattcaggtagcatctgaaattttaatgaatgtataattggcatatcatggaaaattaaccagaaagtatcagttcttaaaagttatgcctagaaattatgtaaagctaaactactggttagaaagtattcagtgtaatattgtattaatttgttaaattctaaacttgaatttcaataaaattttaaagctaattgta

SEQ ID NO: 109212 - DNA, 623 bp, Homo sapiens
  Payload ID: 1451
  Gene Symbol: DARS
  Gene Name: aspartyl-tRNA synthetase
  ENST ID: ENST00000422708
  CDS Start-End: 1-567
gttggtttggacattgaaatggcttttaattaccattaccacgaagttatggaagaaattgctgacaccatggtacaaatattcaaaggacttcaagaaaggtttcagactgaaattcaaacagtgaataaacagttcccatgtgagccattcaaatttttggagccaactctaagactagaatattgtgaagcattggctatgcttagggaagctggagtcgaaatgggagatgaagacgatctgagcacaccaaatgaaaagctgttgggtcatttggtaaaggaaaagaaacagtccaactcttacgatatgttcatgagaggagaagaaatattgtcaggagctcaaagaatacatgatcctcaactgctaacagagagagctttacatcatggaattgatttggagaaaattaaggcttacattgattccttccgctttggagcccctcctcatgctggtggaggcattggattggaacgagttactatgctgtttctgggattgcataatgttcgtcagacctccatgttccctcgtgatcccaaacgactcactccttaaattcacactttgccacttaactccagtgtggatgacagagcgagaccctgcctcaa

SEQ ID NO: 109213 - DNA, 543 bp, Homo sapiens
  Payload ID: 1451
  Gene Symbol: DARS
  Gene Name: aspartyl-tRNA synthetase
  ENST ID: ENST00000449218
  CDS Start-End: 138-543
gccgagcggagttgaaagggctgttagaagaatggagcagaagtcgcagttgggacgaagctgaagagagctggcattcgcccaggtctacagccagccacctggattatgctaaagagagatatggaatatcttcaatgatacaatcacaagaaaaaccagatcgagttttggttcgggttagagacttgacaatacaaaaagctgatgaagttgtttgggtacgtgcaagagttcatacaagcagagctaaagggaaacagtgcttcttagtcctacgtcagcagcagtttaatgtccaggctcttgtggcggtgggagaccatgcaagcaagcagatggttaaatttgctgccaacatcaacaaagagagcattgtggatgtagaaggtgttgtgagaaaagtgaatcagaaaattggaagctgtacacagcaagacgttgagttacatgttcagaagatttatgtgatcagtttggctgaaccccgtctgcccctgcagctggatgatgctgttcggcctgaggcagaaggagaagagg

SEQ ID NO: 109214 - DNA, 651 bp, Homo sapiens
  Payload ID: 1451
  Gene Symbol: DARS
  Gene Name: aspartyl-tRNA synthetase
  ENST ID: ENST00000441323
  CDS Start-End: 106-651
gaaagggctgttagaagaatggagcagaagtcgcagttgggacgaagctgaagagagctggcattcgcccaggattatgctaaagagagatatggaatatcttcaatgatacaatcacaagaaaaaccagatcgagttttggttcgggttagagacttgacaatacaaaaagctgatgaagttgtttgggtacgtgcaagagttcatacaagcagagctaaagggaaacagtgcttcttagtcctacgtcagcagcagtttaatgtccaggctcttgtggcggtgggagaccatgcaagcaagcagatggttaaatttgctgccaacatcaacaaagagagcattgtggatgtagaaggtgttgtgagaaaagtgaatcagaaaattggaagctgtacacagcaagacgttgagttacatgttcagaagatttatgtgatcagtttggctgaaccccgtctgcccctgcagctggatgatgctgttcggcctgaggcagaaggagaagaggaaggaagagctactgttaaccaggatacaagattagacaacagagtcattgatcttaggacatcaactagtcaggcagtcttccgtctccagtctggcatctgccatctcttccgagaaactttaattaacaaaggtttt

SEQ ID NO: 109215 - DNA, 731 bp, Homo sapiens
  Payload ID: 1451
  Gene Symbol: DARS
  Gene Name: aspartyl-tRNA synthetase
  ENST ID: ENST00000456565
  CDS Start-End: 205-731
acagggactggtaacccatgctgccttggcaagccaactgcactcctctgtcccaacaagcagggcaatggattgcgaagaggcctcctccgtccccaagcagctacgtcgcccaggggaagagagaaggcgggaaagtccaagagaggagaaaccaaggcccgcgcttaggattatgctaaagagagatatggaatatcttcaatgatacaatcacaagaaaaaccagatcgagttttggttcgggttagagacttgacaatacaaaaagctgatgaagttgtttgggtacgtgcaagagttcatacaagcagagctaaagggaaacagtgcttcttagtcctacgtcagcagcagtttaatgtccaggctcttgtggcggtgggagaccatgcaagcaagcagatggttaaatttgctgccaacatcaacaaagagagcattgtggatgtagaaggtgttgtgagaaaagtgaatcagaaaattggaagctgtacacagcaagacgttgagttacatgttcagaagatttatgtgatcagtttggctgaaccccgtctgcccctgcagctggatgatgctgttcggcctgaggcagaaggagaagaggaaggaagagctactgttaaccaggatacaagattagacaacagagtcattgatcttaggacatcaactagtcaggcagtcttccgtctccagtctggcatctgccatctcttccgagaaac

SEQ ID NO: 109216 - DNA, 717 bp, Homo sapiens
  Payload ID: 1451
  Gene Symbol: DARS
  Gene Name: aspartyl-tRNA synthetase
  ENST ID: ENST00000435076
  CDS Start-End: 1-539
agggcggagactgggagggagggagaagcccctttggcctgccttacggaagcctgcgagggagggtggtgtccactgcccagttccgtgtcccgatgcccagcgccagcgccagccgcaagagtcaggagaagccgcgggagatcatggacgcggcggaagattatgctaaagagagatatggaatatcttcaatgatacaatcacaagaaaaaccagatcgagttttggttcgggttagagacttgacaatacaaaaagctgatgaagttgtttgggtacgtgcaagagttcatacaagcagagctaaagggaaacagtgcttcttagtcctacgtcagcagcagtttaatgtccaggctcttgtggcggtgggagaccatgcaagcaagcagatggttaaatttgctgccaacatcaacaaagagagcattgtggatgtagaaggtgttgtgagaaaagtgaatcagaaaattggaagctgtacacagcaagacgttgagttacatgttcagaaggtaagttttttcaaaatataaaatcgcatatagaaatagatttgggttctaatagttttcatgtcaaatttatatgttcttactaattaatgtaaaatactgaggtttataaattagttactgaatcaattagcttttgttatataacaaatcaccccagtacttagtgacttgaaacaacaaacatttatttgcttac

SEQ ID NO: 109217 - DNA, 3506 bp, Homo sapiens
  Payload ID: 1452
  Gene Symbol: DARS2
  Gene Name: aspartyl-tRNA synthetase 2, mitochondrial
  Uniprot ID: Q6PI48
  ENST ID: ENST00000361951
  CDS Start-End: 728-2665
cacttaaccactatcgtcaacctttccaatcgtgctcggttgctcctcagttttcctaccggtgcgaagctttctctcaaatttccgcccgtagtaggcatggcggcggcacctcaccactgattcgttgaattccttcccggtaatcttgggcactagcgggcggagttgaagggcgcttggaccccagcggcgatctgtgtttgggttcgcgctctgggagaattttggctttgctcgccttcctctttcagaagactcgaaatcggccagcaggtctgcgagatttgaaacgcgactgttactccttgttttccggttctggccgcgggagcctctcgagaagcgtggaaagaggagaagggcgtataccttgtgaccgcctctggttgtcttgggctcgcgcctggcgccgctacgtggagtcgctctctcgtcgtcacttttggctgccgacttgttgagtagaagtgcagactgatgctttaagactcagggagaggtctttcccttatctccaccccagcaagcaccccagagaccttggagatttgtcttgtttctagacacgtgtactccaatgttgtgcggaggaggccttaaatattcgagaagagagtgggaactcctggaattttaagggatttctgtgtatttccaaaactgacttttaactaccggcagcgtgggatttcgtgattgtttttcgccatcgtgtggctccaacatgtacttcccttcttggttaagtcagctgtacaggggtttatccagacccatcagaaggaccacccaaccgatctggggttctctctacagaagtctgttgcagagttcacagaggagaattccagaattcagtagctttgttgtccggaccaacacatgtggagagttgcgttcgtctcacttaggccaagaagtcaccttgtgtggatggattcagtaccgaaggcaaaacacattcttggtcctaagagatttcgatgggcttgttcaagttatcattccccaggatgagtcggcagcctctgtgaagaagattttatgtgaagcccctgtggaatctgtggtgcaagtgtctggtacagtcatttcccgtcctgcaggacaagagaatccaaaaatgccaacaggtgagattgaaatcaaagttaaaacagctgagcttctgaatgcctgcaagaagctgccctttgaaattaagaacttcgtgaagaaaacagaggctcttcggttgcagtatcgctacttagacttgcgtagtttccaaatgcagtataacctgcgactgaggtcccagatggtcatgaaaatgcgggaatatctctgtaatctgcatgggtttgtggatatagaaacccccacattgtttaagaggaccccagggggtgccaaagagtttttagtaccatccagggaacctggaaagttttattctctccctcagagtcctcaacagtttaagcaacttctgatggttggcggtttagacagatattttcaggttgcccgatgttatcgagatgaaggttcaagaccagacagacagcctgagtttactcagattgacatagagatgtcatttgtagaccagactgggatccagagtttaattgagggtttgctccagtattcctggcccaatgacaaagatcctgtggttgttccttttcctactatgacttttgctgaggtgctggccacctatggaactgataaacctgacactcgctttggaatgaagattatagatatcagtgatgtgtttagaaacacagagattggatttcttcaagatgcacttagtaagccccatggaactgtgaaagccatatgtatccctgaaggagcaaaatacttaaaaaggaaagacattgaatccattagaaactttgcagctgaccattttaatcaggaaatcttacctgtattccttaacgccaatagaaactggaattctccagttgctaatttcataatggagtcacaaagactggaattaatcagactaatggagacccaagaggaagatgtggtcctactaactgctggagagcacaataaagcatgctctttgttaggaaaattacgactggaatgtgctgaccttctagaaacaagaggagtggtgctccgtgaccccactctgttctctttcctttgggtggtagatttcccactcttcctgcccaaggaggaaaatcccagagagctggaatcggcccaccacccatttactgctccccaccccagtgacatacatctcctgtacactgagcccaaaaaggcccgtagccaacactatgacttggttttaaatggcaatgaaataggaggtggttcaattcgaattcacaatgcagagctgcagcgttatatcctggcaaccttactaaaggaggatgtgaaaatgctctcccatctgctccaggctttagattatggggcaccccctcatggaggaattgccttagggttagacagactgatatgccttgtcactggatctccaagcatcagagatgtcatagccttcccaaagtccttccggggacatgacctcatgagcaataccccagattctgtccctcctgaggaactgaagccctatcatatccgagtctccaagccaacagactccaaagcagaaagagctcattgaatcatgcataccatgcagaaagttgagcttttaggttttgtcctctttgcttccccaaggctaaagtcagatctagagttctgccacaggtctaacaatcaagtctttagatggaaggaatccaggcaacattcttcaccacaacgaagaaacagataaaagatacccaattttgacttgatttcatgcatcatttggattttttttggttaggactttttttgaagttcctttttacttaggtgtgaaagatggttctttgttgaaataatatagtggtttagtgttttcaaatcatgtttctcatacccagatagtagattattcacttaggacagaggtaatcaaattatgtgtgaaatgtaggaaaatgcttgcccctgtaaactagtgagttgatggagcatttgcttcatcatcctcatcaagagaatcatataaattaagctttataatgacatttcaaccatcaacataatatagtgaggagtagcataatattttttaataatgcagaaaacatcactgaaatgagagtcacaaatttttcttcagtgtttcagcctgagtaagttacataaacctcgcttagcctcccttcctgctaatgtgtaaaatacatacttgccctggctacctcaccgggctgttattgctggaatcagaggagataacatatatggaagataaagtgaataaaagtactttgaaaaactataaagcattccacaaatatgagatgatggtattatccatccataaataggtagatatatctctattttatagtttcagattaaacaaaactgatatcaatagtaaaagtcattttacttatcaa

SEQ ID NO: 109218 - DNA, 2237 bp, Homo sapiens
  Payload ID: 1453
  Gene Symbol: ASPN
  Gene Name: asporin
  ENST ID: ENST00000375543
  CDS Start-End: 245-976
agtactaacatggactaatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgatgaggacaactctctttttccaacaagagagccaagaagccatttttttccatttgatctgtttccaatgtgtccatttggatgtcagtgctattcacgagttgtacattgctcagatttaggtttgacctcagtcccaaccaacattccatttgatactcgaatgcttgatcttcaaaacaataaaattaaggaaatcaaagaaaatgattttaaaggactcacttcactttatggtctgatcctgaacaacaacaagctaacgaagattcacccaaaagcctttctaaccacaaagaagttgcgaaggctgtatctgtcccacaatcaactaagtgaaataccacttaatcttcccaaatcattagcagaactcagaattcatgaaaataaagttaagaaaatacaaaaggacacattcaaaggaatgaatgctttacacgttttggaaatgagtgcaaaccctcttgataataatgggatagagccaggggcatttgaaggggtgacggtgttccatatcagaattgcagaagcaaaactgacctcagttcctaaagataatcttccttcattctaattcaattgcaagagtgggagtaaatgacttctgtccaacagtgccaaagatgaagaaatctttatacagtgcaataagtttattcaacaacccggtgaaatactgggaaatgcaacctgcaacatttcgttgtgttttgagcagaatgagcgttcagcttgggaactttggaatgtaataattagtaattggtaatgtccatttaatataagattcaaaaatccctacatttggaatacttgaactctattaataatggtagtattatatatacaagcaaatatctattctcaagtggtaagtccactgacttattttatgacaagaaatttcaacggaattttgccaaactattgatacataagggttgagagaaacaagcatctattgcagtttctttttgcgtacaaatgatcttacataaatctcatgcttgaccattcctttcttcataacaaaaaagtaagatattcggtatttaacactttgttatcaagcatattttaaaaagaactgtactgtaaatggaatgcttgacttagcaaaatttgtgctctttcatttgctgttagaaaaacagaattaacaaagacagtaatgtgaagagtgcattacactattcttattctttagtaacttgggtagtactgtaatatttttaatcatcttaaagtatgatttgatataatcttattgaaattaccttatcatgtcttagagcccgtctttatgtttaaaactaatttcttaaaataaagccttcagtaaatgttcattaccaacttgataaatgctactcataagagctggtttggggctatagcatatgcttttttttttttaattattacctgatttaaaaatctctgtaaaaacgtgtagtgtttcataaaatctgtaactcgcattttaatgatccgctattataagcttttaatagcatgaaaattgttaggctatataacattgccacttcaactctaaggaatatttttgagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagttctttatgtatttcttattggcattcaacatatgtaaaatcagaaaacagggaaattttcattaaaaatattggtttgaaataaaa

SEQ ID NO: 109219 - DNA, 2470 bp, Homo sapiens
  Payload ID: 1453
  Gene Symbol: ASPN
  Gene Name: asporin
  Uniprot ID: Q9BXN1
  ENST ID: ENST00000375544
  CDS Start-End: 245-1387
agtactaacatggactaatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgatgaggacaactctctttttccaacaagagagccaagaagccatttttttccatttgatctgtttccaatgtgtccatttggatgtcagtgctattcacgagttgtacattgctcagatttaggtttgacctcagtcccaaccaacattccatttgatactcgaatgcttgatcttcaaaacaataaaattaaggaaatcaaagaaaatgattttaaaggactcacttcactttatggtctgatcctgaacaacaacaagctaacgaagattcacccaaaagcctttctaaccacaaagaagttgcgaaggctgtatctgtcccacaatcaactaagtgaaataccacttaatcttcccaaatcattagcagaactcagaattcatgaaaataaagttaagaaaatacaaaaggacacattcaaaggaatgaatgctttacacgttttggaaatgagtgcaaaccctcttgataataatgggatagagccaggggcatttgaaggggtgacggtgttccatatcagaattgcagaagcaaaactgacctcagttcctaaaggcttaccaccaactttattggagcttcacttagattataataaaatttcaacagtggaacttgaggattttaaacgatacaaagaactacaaaggctgggcctaggaaacaacaaaatcacagatatcgaaaatgggagtcttgctaacataccacgtgtgagagaaatacatttggaaaacaataaactaaaaaaaatcccttcaggattaccagagttgaaatacctccagataatcttccttcattctaattcaattgcaagagtgggagtaaatgacttctgtccaacagtgccaaagatgaagaaatctttatacagtgcaataagtttattcaacaacccggtgaaatactgggaaatgcaacctgcaacatttcgttgtgttttgagcagaatgagcgttcagcttgggaactttggaatgtaataattagtaattggtaatgtccatttaatataagattcaaaaatccctacatttggaatacttgaactctattaataatggtagtattatatatacaagcaaatatctattctcaagtggtaagtccactgacttattttatgacaagaaatttcaacggaattttgccaaactattgatacataagggttgagagaaacaagcatctattgcagtttctttttgcgtacaaatgatcttacataaatctcatgcttgaccattcctttcttcataacaaaaaagtaagatattcggtatttaacactttgttatcaagcatattttaaaaagaactgtactgtaaatggaatgcttgacttagcaaaatttgtgctctttcatttgctgttagaaaaacagaattaacaaagacagtaatgtgaagagtgcattacactattcttattctttagtaacttgggtagtactgtaatatttttaatcatcttaaagtatgatttgatataatcttattgaaattaccttatcatgtcttagagcccgtctttatgtttaaaactaatttcttaaaataaagccttcagtaaatgttcattaccaacttgataaatgctactcataagagctggtttggggctatagcatatgcttttttttttttaattattacctgatttaaaaatctctgtaaaaacgtgtagtgtttcataaaatctgtaactcgcattttaatgatccgctattataagcttttaatagcatgaaaattgttaggctatataacattgccacttcaactctaaggaatatttttgagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagttctttatgtatttcttattggcattcaacatatgtaaaatcagaaaacagggaaattttcattaaaaatattggtttgaaataaaa

SEQ ID NO: 109220 - DNA, 1296 bp, Homo sapiens
  Payload ID: 1454
  Gene Symbol: ASTL
  Gene Name: astacin-like metallo-endopeptidase (M12 family)
  Uniprot ID: Q6HA08
  ENST ID: ENST00000342380
  CDS Start-End: 1-1296
atggagggtgtagggggtctctggccttgggtgctgggtctgctctccttgccaggtgtgatcctaggagcgcccctggcctccagctgcgcaggagcctgtggtaccagcttcccagatggcctcacccctgagggaacccaggcctccggggacaaggacattcctgcaattaaccaagggctcatcctggaagaaaccccagagagcagcttcctcatcgagggggacatcatccggccgagtcccttccgactgctgtcagcaaccagcaacaaatggcccatgggtggtagtggtgtcgtggaggtccccttcctgctctccagcaagtacgatgagcccagccgccaggtcatcctggaggctcttgcggagtttgaacgttccacgtgcatcaggtttgtcacctatcaggaccagagagacttcatttccatcatccccatgtatgggtgcttctcgagtgtggggcgcagtggagggatgcaggtggtctccctggcgcccacgtgtctccagaagggccggggcattgtccttcatgagctcatgcatgtgctgggcttctggcacgagcacacgcgggccgaccgggaccgctatatccgtgtcaactggaacgagatcctgccaggctttgaaatcaacttcatcaagtctcagagcagcaacatgctgacgccctatgactactcctctgtgatgcactatgggaggctcgccttcagccggcgtgggctgcccaccatcacaccactttgggcccccagtgtccacatcggccagcgatggaacctgagtgcctcggacatcacccgggtcctcaaactctacggctgcagcccaagtggccccaggccccgtgggagagggtcccatgcccacagcactggtaggagccccgctccggcctccctatctctgcagcggcttttggaggcactgtcggcggaatccaggagccccgaccccagtggttccagtgcgggaggccagcccgttcctgcagggcctggggagagcccacatgggtgggagtcccctgccctgaaaaagctcagtgcagaggcctcggcaaggcagcctcagaccctagcttcctccccaagatcaaggcctggagcaggtgcccccggtgttgctcaggagcagtcctggctggccggagtgtccaccaagcccacagtcccatcttcagaagcaggaatccagccagtccctgtccagggaagcccagctctgccagggggctgtgtacctagaaatcatttcaaggggatgtccgaagattaa

SEQ ID NO: 109221 - DNA, 2664 bp, Homo sapiens
  Payload ID: 1455
  Gene Symbol: ASTE1
  Gene Name: asteroid homolog 1 (Drosophila)
  Uniprot ID: Q2TB18
  ENST ID: ENST00000264992
  CDS Start-End: 443-2482
aagtaggcggagaaagcagaggaggaccggcgggccaagctttcctagcctgacagcagccatttcggaacgtacgtcccagccctctttagctacttagcgcctctgggcccgagaacacctgctccttggctcagtctggcgccaccggcatcacggaactgtacttcccagagacgtcacaccgggagacttccgattcccgctcttgagattggactctcacgtgcaggagccagtcctcgctgggctctagcgggcttctgatggaggagctactcctctgggaggacagaaattagcagcagcctctgtcaccatccaaagattacaacccatgaaaccattgaatttgtgccttgtatcagaaagcaaaggagaatgaaaaagcacagctaacattgcttgaggatctaggcgattaattctttagactgtcatcatgggtatccgaggactaatgagttttgtggaagatcatagtaatgagttcttcactgatttgaagttgcgggacacaaaaattgtcattgatggttatgctcttttccaccgtctttgcttcagttcaaacttggatctccggtatggaggggactatgattcttttgcagatgttgtacaaaaattctttgaatcactgtttgcttgtaatatatgcccatatgttgtattagatggaggatgtgacatttcagataaaaagcttacaactttaaaggatagagctagagagaagatccagatggcccattccctttctgttggtgggagtgggtacgtatgtcccttactcatccgggaagtattcatacaggttttgatcaagctgcgggtgtgttttgtccagtgcttttcagaagcagatcgggacattatgacacttgctaaccattggaattgccctgtgttatcatcagatagtgacttttgcatttttgacctgaaaactgggttttgcccattgaatagctttcagtggagaaatatgaacactattaagggcacacaaaactatatccctgccaaatgcttttcccttgatgcattctgccatcacttcagcaatatgaataaagctctactacctctctttgcggtgctatgtggaaatgaccatgttaatctacccatcatggagacattcttaagtaaagcgcgtcttcctcttggagctaccagttctaaagggaggagacaccaccgaatcctgggacttctgaattggttgtctcattttgccaaccctaccgaagcactagataatgttctgaaatacctcccaaaaaaggatcgagaaaatgttaaggaacttctctgctgttccatggaagaataccaacagtcccaggtgaagctacaggacttcttccagtgtggtacttatgtctgtccagatgccttgaatcttggtttaccagaatgggtattagtggctttagctaaaggccagctatctcctttcatcagtgatgctttggtcctaagacggaccattcttcccacacaggtggaaaacatgcagcaaccaaatgcccacagaatatctcagcccatcaggcaaatcatctatgggcttcttttaaatgcctcaccacatctggacaagacatcctggaatgcattgcctcctcagcctctagctttcagtgaagtggaaaggattaataaaaatatcagaacctcaatcattgatgcagtagaactggccaaggatcattctgacttaagcagattgactgagctctccttgaggaggcggcagatgcttctgttagaaaccctgaaggtgaaacagaccattctggagccaatccctacttcactgaagttgcccattgctgtcagttgctactggttgcagcacaccgagaccaaagcaaagctacatcatctacaatccttactgctcacaatgctagtggggcccttgattgccataatcaacagccctggtaaggaagagctgcaggaagatggtgctaagatgttgtatgcagagttccaaagagtgaaggcgcagacacggctgggcacaagactggacttagacacagctcacatcttctgtcagtggcagtcctgtctccagatggggatgtatctcaaccagctgctgtccactcctctcccagagccagacctaactcgactgtacagtggaagcctggtgcacggactatgccagcaactgctagcatcgacctctgtagaaagtctcctgagcatatgtcctgaggctaagcaactttatgaatatctattcaatgccacaaggtcatatgcccccgctgaaatattcctaccaaaaggtagatcaaattcaaaaaaaaaaaggcagaagaaacagaataccagctgttctaagaacagagggagaaccactgcacacaccaagtgttggtatgagggaaacaaccggtttgggttgttaatggttgaaaacttagaggaacatagtgaggcctccaacattgaataaaactcagtttgcatcaaactagatgtatttaatataatccttacttaaaattcttccgttaccacccttgaaacaattagctttttctttaggactgacctgttaggggataaacatcacaataatctgaattccaagttattttgtattttgtttttaataaatacaacctgatttaagaa

SEQ ID NO: 109222 - DNA, 2669 bp, Homo sapiens
  Payload ID: 1455
  Gene Symbol: ASTE1
  Gene Name: asteroid homolog 1 (Drosophila)
  Uniprot ID: Q2TB18
  ENST ID: ENST00000507978
  CDS Start-End: 495-2057
atactgggaagtcggggcgaggcggcaccaaggcggaagtgttcgccgacccaagtaggcggagaaagcagaggaggaccggcgggccaagctttcctagcctgacagcagccatttcggaacgtacgtcccagccctctttagctacttagcgcctctgggcccgagaacacctgctccttggctcagtctggcgccaccggcatcacggaactgtacttcccagagacgtcacaccgggagacttccgattcccgctcttgagattggactctcacgtgcaggagccagtcctcgctgggctctagcgggcttctgatggaggagctactcctctgggaggacagaaattagcagcagcctctgtcaccatccaaagattacaacccatgaaaccattgaatttgtgccttgtatcagaaagcaaaggagaatgaaaaagcacagctaacattgcttgaggatctaggcgattaattctttagactgtcatcatgggtatccgaggactaatgagttttgtggaagatcatagtaatgagttcttcactgatttgaagttgcgggacacaaaaattgtcattgatggttatgctcttttccaccgtctttgcttcagttcaaacttggatctccggtatggaggggactatgattcttttgcagatgttgtacaaaaattctttgaatcactgtttgcttgtaatatatgcccatatgttgtattagatggaggatgtgacatttcagataaaaagcttacaactttaaaggatagagctagagagaagatccagatggcccattccctttctgttggtgggagtgggtacgtatgtcccttactcatccgggaagtattcatacaggttttgatcaagctgcgggtgtgttttgtccagtgcttttcagaagcagatcgggacattatgacacttgctaaccattggaattgccctgtgttatcatcagatagtgacttttgcatttttgacctgaaaactgggttttgcccattgaatagctttcagtggagaaatatgaacactattaagggcacacaaaactatatccctgccaaatgcttttcccttgatgcattctgccatcacttcagcaatatgaataaagctctactacctctctttgcggtgctatgtggaaatgaccatgttaatctacccatcatggagacattcttaagtaaagcgcgtcttcctcttggagctaccagttctaaagggaggagacaccaccgaatcctgggacttctgaattggttgtctcattttgccaaccctaccgaagcactagataatgttctgaaatacctcccaaaaaaggatcgagaaaatgttaaggaacttctctgctgttccatggaagaataccaacagtcccaggtgaagctacaggacttcttccagtgtggtacttatgtctgtccagatgccttgaatcttggtttaccagaatgggtattagtggctttagctaaaggccagctatctcctttcatcagtgatgctttggtcctaagacggaccattcttcccacacaggtggaaaacatgcagcaaccaaatgcccacagaatatctcagcccatcaggcaaatcatctatgggcttcttttaaatgcctcaccacatctggacaagacatcctggaatgcattgcctcctcagcctctagctttcagtgaagtggaaaggattaataaaaatatcagaacctcaatcattgatgcagtagaactggccaaggatcattctgacttaagcagattgactgagctctccttgaggaggcggcagatgcttctgttagaaaccctgaaggtgaaacagaccattctggagccaatccctacttcactgaagttgcccattgctgtcagttgctactggttgcagcacaccgagaccaaagcaaagctacatcatctacaatccttactgctcacaatgctagtggggcccttgattgccataatcaacagccctggaaatgtggaccctgtacccaggcaggctcagtgtcttgctcctcgctagttggtaaaaggtaaggaagagctgcaggaagatggtgctaagatgttgtatgcagagttccaaagagtgaaggcgcagacacggctgggcacaagactggacttagacacagctcacatcttctgtcagtggcagtcctgtctccagatggggatgtatctcaaccagctgctgtccactcctctcccagagccagacctaactcgactgtacagtggaagcctggtgcacggactatgccagcaactgctagcatcgacctctgtagaaagtctcctgagcatatgtcctgaggctaagcaactttatgaatatctattcaatgccacaaggtcatatgcccccgctgaaatattcctaccaaaaggtagatcaaattcaaaaaaaaaaaggcagaagaaacagaataccagctgttctaagaacagagggagaaccactgcacacaccaagtgttggtatgagggaaacaaccggtttgggttgttaatggttgaaaacttagaggaacatagtgaggcctccaacattgaataaaactcagtttgcatcaaactagatgtatttaatataatccttacttaaaattcttccgttaccacccttgaaaca

SEQ ID NO: 109223 - DNA, 569 bp, Homo sapiens
  Payload ID: 1455
  Gene Symbol: ASTE1
  Gene Name: asteroid homolog 1 (Drosophila)
  ENST ID: ENST00000504725
  CDS Start-End: 425-569
ggactctcacgtgcaggagccagtcctcgctgggctctagcgggcttctgatggaggagctactcctctgggaggacagagtaggtgggctctgctgcaggtccgggcggcgggttgtgagggccgaggtggcacggtgtatgaaggcctgtgtttgaagacttaggtcagaccttttgcccgcctttcccctatgcagctctatgcaactgtctgtgcaaggtcctgtaatttgcgtaggacgccttgacacagtctctgcttatggacgctttacaaaactatcttgcaaagaaataagtactatacaggataaggttctgagatactgacagggctggaactagggtgagataagtgtaaaatgtaaatggatgccaataaaattcagtaatcaaggcgattaattctttagactgtcatcatgggtatccgaggactaatgagttttgtggaagatcatagtaatgagttcttcactgatttgaagttgcgggacacaaaaattgtcattgatggttatgctcttttccaccgtctttgcttcagttcaaacttggatctccggt

SEQ ID NO: 109224 - DNA, 292 bp, Homo sapiens
  Payload ID: 1455
  Gene Symbol: ASTE1
  Gene Name: asteroid homolog 1 (Drosophila)
  ENST ID: ENST00000505290
  CDS Start-End: 1-292
aaaatgttaaggaacttctctgctgttccatggaagaataccaacagtcccagatgcttctgttagaaaccctgaaggtgaaacagaccattctggagccaatccctacttcactgaagttgcccattgctgtcagttgctactggttgcagcacaccgagaccaaagcaaagctacatcatctacaatccttactgctcacaatgctagtggggcccttgattgccataatcaacagccctggtaaggaagagctgcaggaagatggtgctaagatgttgtatgcagagtt

SEQ ID NO: 109225 - DNA, 551 bp, Homo sapiens
  Payload ID: 1455
  Gene Symbol: ASTE1
  Gene Name: asteroid homolog 1 (Drosophila)
  ENST ID: ENST00000505545
  CDS Start-End: 403-551
acttgacaacacgctccccctcgaggtttgagtgaacttgggcactgcgaacacatcttctttatttctgcatccccaatccctggcatacctcctggcatatactaggtgtttaacaaaccttgttaaggcaagtaagtgtccagcagatcaactgccgcccaaaggagagaaaaaaggtaataagaggaaggcaatttgtcaccagtttctgctacagcacaaatctacctttaaagtaaatcttaaccttaagaattagcagcagcctctgtcaccatccaaagattacaacccatgaaaccattgaatttgtgccttgtatcagaaagcaaaggagaatgaaaaagcacagctaacattgcttgaggatctaggcgattaattctttagactgtcatcatgggtatccgaggactaatgagttttgtggaagatcatagtaatgagttcttcactgatttgaagttgcgggacacaaaaattgtcattgatggttatgctcttttccaccgtctttgcttcagttcaaacttggatctccggtatgg

SEQ ID NO: 109226 - DNA, 680 bp, Homo sapiens
  Payload ID: 1455
  Gene Symbol: ASTE1
  Gene Name: asteroid homolog 1 (Drosophila)
  ENST ID: ENST00000504964
  CDS Start-End: 92-310
tttgtgccttgtatcagaaagcaaaggagaatgaaaaagcacagctaacattgcttgaggatctaggcgattaattctttagactgtcatcatgggtatccgaggactaatgagttttgtggaagatcatagtaatgagttcttcactgatttgaagttgcgggacacaaaaattgtcattgatggttatgctcttttccaccgtctttgcttcagttcaaacttggatctccggtggaaaacatgcagcaaccaaatgcccacagaatatctcagcccatcaggcaaatcatctatgggcttcttttaaatgcctcaccacatctggacaagacatcctggaatgcattgcctcctcagcctctagctttcagtgaagtggaaaggattaataaaaatatcagaacctcaatcattgatgcagtagaactggccaaggatcattctgacttaagcagattgactgagctctccttgaggaggcggcagatgcttctgttagaaaccctgaaggtgaaacagaccattctggagccaatccctacttcactgaagttgcccattgctgtcagttgctactggttgcagcacaccgagaccaaagcaaagctacatcatctacaatccttactgctcacaatgctagtggggcccttgattgccataatcaacagccctgg

SEQ ID NO: 109227 - DNA, 2504 bp, Homo sapiens
  Payload ID: 1455
  Gene Symbol: ASTE1
  Gene Name: asteroid homolog 1 (Drosophila)
  ENST ID: ENST00000514044
  CDS Start-End: 208-2322
agaaagcagaggaggaccggcgggccaagctttcctagcctgacagcagccatttcggaacaattagcagcagcctctgtcaccatccaaagattacaacccatgaaaccattgaatttgtgccttgtatcagaaagcaaaggagaatgaaaaagcacagctaacattgcttgaggatctaggcgattaattctttagactgtcatcatgggtatccgaggactaatgagttttgtggaagatcatagtaatgagttcttcactgatttgaagttgcgggacacaaaaattgtcattgatggttatgctcttttccaccgtctttgcttcagttcaaacttggatctccggtatggaggggactatgattcttttgcagatgttgtacaaaaattctttgaatcactgtttgcttgtaatatatgcccatatgttgtattagatggaggatgtgacatttcagataaaaagcttacaactttaaaggatagagctagagagaagatccagatggcccattccctttctgttggtgggagtgggtacgtatgtcccttactcatccgggaagtattcatacaggttttgatcaagctgcgggtgtgttttgtccagtgcttttcagaagcagatcgggacattatgacacttgctaaccattggaattgccctgtgttatcatcagatagtgacttttgcatttttgacctgaaaactgggttttgcccattgaatagctttcagtggagaaatatgaacactattaagggcacacaaaactatatccctgccaaatgcttttcccttgatgcattctgccatcacttcagcaatatgaataaagctctactacctctctttgcggtgctatgtggaaatgaccatgttaatctacccatcatggagacattcttaagtaaagcgcgtcttcctcttggagctaccagttctaaagggaggagacaccaccgaatcctgggacttctgaattggttgtctcattttgccaaccctaccgaagcactagataatgttctgaaatacctcccaaaaaaggatcgagaaaatgttaaggaacttctctgctgttccatggaagaataccaacagtcccaggtgaagctacaggacttcttccagtgtggtacttatgtctgtccagatgccttgaatcttggtttaccagaatgggtattagtggctttagctaaaggccagctatctcctttcatcagtgatgctttggtcctaagacggaccattcttcccacacaggtggaaaacatgcagcaaccaaatgcccacagaatatctcagcccatcaggcaaatcatctatgggcttcttttaaatgcctcaccacatctggacaagacatcctggaatgcattgcctcctcagcctctagctttcagtgaagtggaaaggattaataaaaatatcagaacctcaatcattgatgcagtagaactggccaaggatcattctgacttaagcagattgactgagctctccttgaggaggcggcagatgcttctgttagaaaccctgaaggtgaaacagaccattctggagccaatccctacttcactgaagttgcccattgctgtcagttgctactggttgcagcacaccgagaccaaagcaaagctacatcatctacaatccttactgctcacaatgctagtggggcccttgattgccataatcaacagccctggtaaggaagagctgcaggaagatggtgctaagatgttgtatgcagagttccaaagagtgaaggcgcagacacggctgggcacaagactggacttagacacagctcacatcttctgtcagtggcagtcctgtctccagatggggatgtatctcaaccagctgctgtccactcctctcccagagccagacctaactcgccccagtgccttcaatactttgaatgaggatatatggacgcatacaaaatatggtgggactttacatgtttcaagactgtacagtggaagcctggtgcacggactatgccagcaactgctagcatcgacctctgtagaaagtctcctgagcatatgtcctgaggctaagcaactttatgaatatctattcaatgccacaaggtcatatgcccccgctgaaatattcctaccaaaaggtagatcaaattcaaaaaaaaaaaggcagaagaaacagaataccagctgttctaagaacagagggagaaccactgcacacaccaagtgttggtatgagggaaacaaccggtttgggttgttaatggttgaaaacttagaggaacatagtgaggcctccaacattgaataaaactcagtttgcatcaaactagatgtatttaatataatccttacttaaaattcttccgttaccacccttgaaacaattagctttttctttaggactgacctgttaggggataaacatcacaataatctgaattccaagttattttgtattttgtttttaataaatacaacctgatttaagaa

SEQ ID NO: 109228 - DNA, 589 bp, Homo sapiens
  Payload ID: 1455
  Gene Symbol: ASTE1
  Gene Name: asteroid homolog 1 (Drosophila)
  ENST ID: ENST00000509060
  CDS Start-End: 569-589
ttccgattcccgctcttgagattggactctcacgtgcaggagccagtcctcgctgggctctagcgggcttctgatggaggagctactcctctgggaggacagagtaggtgggctctgctgcaggtccgggcggcgggttgtgagggccgaggtggcacggtgtatgaaggcctgtgtttgaagacttaggtcagaccttttgcccgcctttcccctatgcagctctatgcaactgtctgtgcaaggtcctgtaatttgcgtaggacgccttgacacagtctctgcttatggacgctttacaaaactatcttgcaaagaaataagtactatacaggataaggttctgagatactgacagggctggaactagggtgagataagtgtaaaatgtaaatggatgccaataaaattcagtaatcaagaattagcagcagcctctgtcaccatccaaagattacaacccatgaaaccattgaatttgtgccttgtatcagaaagcaaaggagaatgaaaaagcacagctaacattgcttgaggatctaggcgattaattctttagactgtcatcatgggtatccgaggactaatg

SEQ ID NO: 109229 - DNA, 7116 bp, Homo sapiens
  Payload ID: 1456
  Gene Symbol: ASTN1
  Gene Name: astrotactin 1
  Uniprot ID: O14525
  ENST ID: ENST00000361833
  CDS Start-End: 15-3899
ggccggggctcaagatggctttagccgggctctgcgccctgctcgcctgctgctgggggccggcggcggtgctggccacggccgccggcgacgtggatccatccaaggagctggagtgcaagctcaaaagcatcacggtgtcggcactgcccttcctgcgcgagaacgacctgagcatcatgcacagcccctcggcctcggagcccaagctcctcttctcggtgcgcaacgacttcccgggagaaatggtcgtggtggacgacctggagaacacggagctgccctacttcgtgctggagatctcagggaacacagaggatatccctttggtgcgctggaggcagcagtggctggagaatggcactttgctttttcacattcatcaccaagatggtgccccaagccttcctggacaagaccccactgaagaaccccaacatgagtcggcagaagaggagctgaggatcctccacatctcagtcatgggtggcatgatcgctctgctgctgtccatcttgtgcctggtgatgatcctgtatactcgccggcgctggtgcaaacgccgccgggtcccgcagccccagaagagtgccagtgctgaggcagccaatgagattcactacattccttctgtgctgatcggcgggcacggacgggagagcctgcgcaatgcccgcgtgcagggccacaactccagtggcaccctgagcatccgggagacacctatcctggacggctatgagtatgacatcactgatctgcgccaccatctgcagagggagtgcatgaacggaggggaggactttgccagccaggtcacgcgcaccctcgactccctgcagggctgcaatgaaaagtcggggatggacctcacaccaggaagtgacaatgccaagctgtcactgatgaacaagtataaagataatattatagccactagccctgtggactccaaccaccagcaagccacccttctctctcacacctccagcagccagagaaagcggatcaacaacaaagcaagagctggttccgccttcttgaaccctgaaggggattctggcacagaggcagaaaacgacccccagctgaccttttacacggatccttcaaggagcaggaggcgtagtagagtgggttctccccgaagtcctgtgaataagaccaccttgaccctgatcagcatcaccagctgtgtgattggcctcgtgtgctcctctcacgtcaactgccctctcgttgtcaagatcaccctgcatgtccctgagcacctgattgctgatgggagccgcttcatcttgctggaggggagccagctggatgccagtgactggctgaaccctgcccaagtggttctcttctctcagcagaactccagcggaccctgggccatggacctctgtgcccggcggctcctggacccctgtgaacaccaatgtgaccccgaaactggggaatgcctctgctatgaaggctacatgaaggatccagtacataagcacctttgcattcggaacgaatgggggacaaaccaggggccatggccttacacaatatttcagcgaggctttgacctggttttgggagagcagccctctgataaaatatttagattcacctacactcttggggagggcatgtggttgcccctcagcaagagctttgtgattccaccagccgaactggccatcaatccatcagcaaagtgcaagacggacatgactgtgatggaggatgctgtggaggtcagagaggagctgatgacttcatcctccttcgacagcctggaggttctcttagattcctttgggccggtgcgcgactgcagcaaagataacgggggctgcagtaagaatttccgctgtatttcagatcgcaagctggactccactggttgcgtgtgcccatctggactcagtcccatgaaggacagctctggctgctatgaccgccacatcggggtggactgttccgacggcttcaacggcggctgtgagcagctgtgcctccagcagatggcgcccttcccggacgaccccaccttgtataacatcctcatgttctgtgggtgcatcgaggactacaagcttggtgtggatggacgctcttgccaactcatcacggagacctgtccagagggaagtgactgtggggaaagcagggagcttcccatgaaccagaccctctttggggagatgttctttggttacaacaaccattccaaggaagtggctgccggacaggtgctgaaaggaacattcaggcaaaacaactttgctcgtggtttagaccagcaactgccagatggtcttgtggtggccactgtgcccctggagaatcaatgcctagaggagatctcggagcccacccctgaccctgacttcctgactgggatggtgaacttcagtgaagtgtctgggtaccctgtgctgcagcactggaaggtccggtctgtgatgtaccacatcaaactcaaccaagtggccatctctcaggccctcagcaatgctctccactcgctggatggggctacatctcgtgcagattttgtggcgctgttggaccagttcggcaaccattacatccaggaagctatctacggctttgaggagtcctgttctatctggtacccaaacaagcaggtccagcggcgactctggctggagtatgaagacatcagtaaaggcaactccccatcagatgagtctgaggagcgggaaagagaccccaaggtgctgacattcccagaatacatcaccagcttgtcagactccggcaccaagcacatggcggctggagtccgcatggagtgccacagcaagggacgatgcccctcgtcctgccccctgtgtcatgtgacatccagccctgacacccctgctgagccggttctgctggaggtgaccaaagcagcccccatctatgaactagtgaccaacaaccagacccagaggctcttgcaggaggctaccatgagctctctctggtgctcagggactggagatgtcatcgaggactggtgtcgatgtgactccactgcttttggagctgatggactccccacctgtgcgcctctcccacagcctgtgctgagactctccacggttcacgagcccagcagcactcttgtggtcctggagtgggaacactcagagccaccaatcggggtgcagattgtagattacctcctccgtcaagagaaagtcactgacaggatggaccactccaaagtggagacagaaacagtgctgagctttgtggacgacatcatctctggagcaaagtctccttgtgcaatgccatctcaggtgccggacaagcagctcaccaccatctctctgatcatacgatgcctggaacctgacaccatttacatgttcacgctgtggggagtggacaacacaggacggcgctccaggccaagcgacgtgatcgtgaagaccccatgccccgtggtggatgatgtcaaggctcaagaaatagcagacaagatctacaatctcttcaatggctacactagtgggaaggagcagcagaccgcctacaacaccctcctggatctgggttcccccaccttacaccgggtcctctaccactataaccagcactatgagagttttggggaattcacctggcgatgtgaggatgagttaggtcccaggaaagctggtctcatcctttcccagcttggggacctcagcagttggtgcaatggactccttcaggaacccaagataagcttgcggcgcagctcactcaagtacctggggtgccgctacagcgagatcaaaccctacggacttgactgggcggagctcagccgggacctcaggaagacgtgtgaggagcagaccctgagtatcccctacaacgactatggggacagcaaagagatctagcaccataaggccagggagctgctgccagaatgaagtaggaaagaggagggatccatctgggttggtctgtggatttttaatattttttaatggaacatgaaaacctccacagcaacatcgaaaccagggagaaagtgatccttgctccctgcagaacttcttcagtatgatgttctccatctgcatgattgggaaatctgccagccagtggcttcatgcagtgccatatttctttagaggattactttggggtttgctttgccattaatttgttccattcatttttttttccctgagaagtttaccaaaatgctcaagagctctgccgtgctccccatgaaaagtctattaagtaggcaccctgtgctcactcagttcctaaatccattgcaactgggagcagaggtgaggccagaaagttgttaggcctgccgcaggccccaccctcaagcattcctcaggaagcgtctcactctgggagccttggccctgctcacagagagagacaatagaaaattgaggaaggtggcccttgtctgtgtctcctggttttcttcctaggccttgctatcactatttccatacccgaaaggtgaaaccagctttcattataggccccagtgggccacttgggttttgagatccttccttattttaagccaggactgggattaaatctccctctgtcagatctctgtcccttcctctgaacaacatgatctttgagagggaacaagatgccatctgtcaactgcaccttcagaaaagtctacctgggagactagttagcagtccacattcaagaggagacttggagtttattgttttttaaaaaaaccatgcttcctttggatagacttctccagcctaccaatatatatccatgtgcctggattatctttaacccccacacctcttaccttggacaggtaaggcttggccgatgtctgattgggaccaggaggggtcaacactttcatatcagtgttacagtgaactaaagctattattgatcacaaaaaacttctgttcatccccaccttgctaaatttgcttgtgttgctagttttgcaaatcgtttctctgatgaccataagcaggaggattccaccatggtcactgcccatccagtcacagggattctgtgtagggaagcaccactgattgcagttaacatctagagtgttgtttccatcccactgcccaagcattggcatggtcatgaatggtggcccagccaacaggaagcccagcctttcagaaagagcctggcaaggccctgttgactagcaatggccttagctgtcccacacaactcagtggcctgaacacacaccttcagccaccatgcctttgaccagggctcctcatctggaaacatatgagaaaggtcagcaaacagatgcaagacctataaggctagtcattgagctatattggttttttttctaaatagtagtagtgacagataacatttattgagtgcttgctgtatgccaggcgctgatgtaagcactttaggtatcattgaattctcacagcaactcctgaggaaagtgctattcttgtctccattttagtgttgaggaaaacgaggcaaagagaggttatacaacttgcctcaaatcccttgtgcactgtaactcacactgagtttcagtgtgatttcaggctgttggtctccagggcacaggatcttagctactctgggatacccagttctgttttcagtatcatctggcacacaactgtccaagctctcagccccacagggaacctgcccagagagctttacctttcccaagcatctgtggcatggacatgtcctctgtgcagtggaaggaggaggggcgaaagtacgcccttagcctttggagctagagcacccttgggacccctagttccactgcacatggccctcctccccaccctcatgactgggaaggaagcctgtgatgaggctgagataaagcacagggtggtttcactctcctctctccttctttccaaacactgaaggatttatttcaaactctctaatgcacctgcctcagagattcccctactttcaaagcaaagatcagcagaaaaattggctgtcccacctgtggcaaatgctggagcctcagttaaagtgcctcaaggggcaaatatttcaccattgccagagaagatgtgacaggccaatcagacagggcccagagcatctctttgctgctactgttttgccatccttctattcatatctgtgcagaacacggtgttttaagcttgagtgaaaggagggtgaggctgccgatgccttcctgcccagaagtggatgatgtgggagttgacaggccagggagagggtgaagcaggtatcagagtcactcctctgtaccctctccttctgtttttattttaggcacactatcttcctctctcctatctttccctcagtctcccaagttcctctaccttctttatctttgtcttttacttcttctttctgtgaccctccttttttggcctcctctttccccaagactttcttcctcctgtttctcgttgagttctccccactgaatgtgtgtatgtatgtacacacacacacacgtgtgcacacacaatgcacacaactcctatgactggctcctacttacattcaagttaaaaaggctgatatgaacagggcaggggaaaatcttaggatggttgtacaattgactggaggattttttccccttggaagacactattgatctcaacctgctgacttttcctaatgcttacctgaaggaacccatcctggctagaaagggtgatggtactggaccggtattcaaccttgagttttcaagctgccaaacaggtcttaagggaggtgcttatatcccaccaacactctcccagctcccatgtccccaagacctctggagtttcctcttgaatgtacatgaaccactgtaatagcattagacttttaattgagtgtgcaatcgttttccatggagtttggtccgttcattattttttagttaactacacttcttgatattcaaatgttctattaaaaaaactgagtatgaagaaaaacactttactactgcagaaggaagaaagaatataatatgaccatcttcaggtataacagtgttgtttaaaagagaattattgtatgattataaaagatgaaataattaactgaataataaaacaaagctattagtaagca

SEQ ID NO: 109230 - DNA, 4187 bp, Homo sapiens
  Payload ID: 1456
  Gene Symbol: ASTN1
  Gene Name: astrotactin 1
  ENST ID: ENST00000367657
  CDS Start-End: 192-3878
ggggctctccagacatcagagcttaaacccaggactctgcaagcggcatctcattccggggtccagggctctcccggctctccatcccctccctaacctcccccgcctcccgcgctcgctccctcgctccctccccgctcgcttcctcccccaccatcgcagcgctaggaggaaggcggccggggctcaagatggctttagccgggctctgcgccctgctcgcctgctgctgggggccggcggcggtgctggccacggccgccggcgacgtggatccatccaaggagctggagtgcaagctcaaaagcatcacggtgtcggcactgcccttcctgcgcgagaacgacctgagcatcatgcacagcccctcggcctcggagcccaagctcctcttctcggtgcgcaacgacttcccgggagaaatggtcgtggtggacgacctggagaacacggagctgccctacttcgtgctggagatctcagggaacacagaggatatccctttggtgcgctggaggcagcagtggctggagaatggcactttgctttttcacattcatcaccaagatggtgccccaagccttcctggacaagaccccactgaagaaccccaacatgagtcggcagaagaggagctgaggatcctccacatctcagtcatgggtggcatgatcgctctgctgctgtccatcttgtgcctggtgatgatcctgtatactcgccggcgctggtgcaaacgccgccgggtcccgcagccccagaagagtgccagtgctgaggcagccaatgagattcactacattccttctgtgctgatcggcgggcacggacgggagagcctgcgcaatgcccgcgtgcagggccacaactccagtggcaccctgagcatccgggagacacctatcctggacggctatgagtatgacatcactgatctgcgccaccatctgcagagggagtgcatgaacggaggggaggactttgccagccaggtcacgcgcaccctcgactccctgcagggctgcaatgaaaagtcggggatggacctcacaccaggaagtgacaatgccaagctgtcactgatgaacaagtataaagataatattatagccactagccctgtggactccaaccaccagcaagccacccttctctctcacacctccagcagccagagaaagcggatcaacaacaaagcaagagctggttccgccttcttgaaccctgaaggggattctggcacagaggcagaaaacgacccccagctgaccttttacacggatccttcaaggagcaggaggcgtagtagagtgggttctccccgaagtcctgtgaataagaccaccttgaccctgatcagcatcaccagctgtgtgattggcctcgtgtgctcctctcacgtcaactgccctctcgttgtcaagatcaccctgcatgtccctgagcacctgattgctgatgggagccgcttcatcttgctggaggggagccagctggatgccagtgactggctgaaccctgcccaagtggttctcttctctcagcagaactccagcggaccctgggccatggacctctgtgcccggcggctcctggacccctgtgaacaccaatgtgaccccgaaactggggaatgcctctgctatgaaggctacatgaaggatccagtacataagcacctttgcattcggaacgaatgggggacaaaccaggggccatggccttacacaatatttcagcgaggctttgacctggttttgggagagcagccctctgataaaatatttagattcacctacactcttggggagggcatgtggttgcccctcagcaagagctttgtgattccaccagccgaactggccatcaatccatcagcaaagtgcaagacggacatgactgtgatggaggatgctgtggaggtcagagaggagctgatgacttcatcctccttcgacagcctggaggttctcttagattcctttgggccggtgcgcgactgcagcaaagataacgggggctgcagtaagaatttccgctgtatttcagatcgcaagctggactccactggttgcgtgtgcccatctggactcagtcccatgaaggacagctctggctgctatgaccgccacatcggggtggactgttccgacggcttcaacggcggctgtgagcagctgtgcctccagcagatggcgcccttcccggacgaccccaccttgtataacatcctcatgttctgtgggtgcatcgaggactacaagcttggtgtggatggacgctcttgccaactcatcacggagacctgtccagagggaagtgactgtggggaaagcagggagcttcccatgaaccagaccctctttggggagatgttctttggttacaacaaccattccaaggaagtggctgccggacaggtgctgaaaggaacattcaggcaaaacaactttgctcgtggtttagaccagcaactgccagatggtcttgtggtggccactgtgcccctggagaatcaatgcctagaggagatctcggagcccacccctgaccctgacttcctgactgggatggtgaacttcagtgaagtgtctgggtaccctgtgctgcagcactggaaggtccggtctgtgatgtaccacatcaaactcaaccaagtggccatctctcaggccctcagcaatgctctccactcgctggatggggctacatctcgtgcagattttgtggcgctgttggaccagttcggcaaccattacatccaggaagctatctacggctttgaggagtcctgttctatctggtacccaaacaagcaggtccagcggcgactctggctggagtatgaagacatcagtaaaggcaactccccatcagatgagtctgaggagcgggaaagagaccccaaggtgctgacattcccagaatacatcaccagcttgtcagactccggcaccaagcacatggcggctggagtccgcatggagtgccacagcaagggacgatgcccctcgtcctgccccctgtgtcatgtgacatccagccctgacacccctgctgagccggttctgctggaggtgaccaaagcagcccccatctatgaactagtgaccaacaaccagacccagaggctcttgcaggaggctaccatgagctctctctggtgctcagggactggagatgtcatcgaggactggtgtcgatgtgactccactgcttttggagctgatggactccccacctgtgcgcctctcccacagcctgtgctgagactctccacggttcacgagcccagcagcactcttgtggtcctggagtgggaacactcagagccaccaatcggggtgcagattgtagattacctcctccgtcaagagaaagtcactgacaggatggaccactccaaagtggagacagaaacagtgctgagctttgtggacgacatcatctctggagcaaagtctccttgtgcaatgccatctcaggtgccggacaagcagctcaccaccatctctctgatcatacgatgcctggaacctgacaccatttacatgttcacgctgtggggagtggacaacacaggacggcgctccaggccaagcgacgtgatcgtgaagaccccatgccccgtggtggatgatgtcaaggctcaagaaatagcagacaagatctacaatctcttcaatggctacactagtgggaaggagcagcagaccgcctacaacaccctcctggatctgggttcccccaccttacaccgggtcctctaccactataaccagcactatgagagttttggggaattcacctggcgatgtgaggatgagttaggtcccaggcttccagcgtgttgggacagtcagaggagttgtagatgattggaggaaaggaagaagacggcagccagggtatttccccttctccctgcctcagatggcatctccagcatctccttcatgacctctgtctcctccgtgtgaccttccatcccctcaaagcaggagctgcgccctgatgttgctaatctgataggttgctcctatttgtccttctataatcccaaagtcttcctaattggtttctcatcttgaacttcctctgtggaattacctaaaatgtattttgctttcctgactaggtcttgattaatatatacttcaaactaaaagttagtacatatcgtctga

SEQ ID NO: 109231 - DNA, 3685 bp, Homo sapiens
  Payload ID: 1456
  Gene Symbol: ASTN1
  Gene Name: astrotactin 1
  Uniprot ID: O14525
  ENST ID: ENST00000424564
  CDS Start-End: 8-3658
gctcaagatggctttagccgggctctgcgccctgctcgcctgctgctgggggccggcggcggtgctggccacggccgccggcgacgtggatccatccaaggagctggagtgcaagctcaaaagcatcacggtgtcggcactgcccttcctgcgcgagaacgacctgagcatcatgcacagcccctcggcctcggagcccaagctcctcttctcggtgcgcaacgacttcccgggagaaatggtcgtggtggacgacctggagaacacggagctgccctacttcgtgctggagatctcagggaacacagaggatatccctttggtgcgctggaggcagcagtggctggagaatggcactttgctttttcacattcatcaccaagatggtgccccaagccttcctggacaagaccccactgaagaaccccaacatgagtcggcagaagaggagctgaggatcctccacatctcagtcatgggtggcatgatcgctctgctgctgtccatcttgtgcctggtgatgatcctgtatactcgccggcgctggtgcaaacgccgccgggtcccgcagccccagaagagtgccagtgctgaggcagccaatgagattcactacattccttctgtgctgatcggcgggcacggacgggagagcctgcgcaatgcccgcgtgcagggccacaactccagtggcaccctgagcatccgggagacacctatcctggacggctatgagtatgacatcactgatctgcgccaccatctgcagagggagtgcatgaacggaggggaggactttgccagccaggtcacgcgcaccctcgactccctgcagggctgcaatgaaaagtcggggatggacctcacaccaggaagtgacaatgccaagctgtcactgatgaacaagtataaagataatattatagccactagccctgtggactccaaccaccagcaagccacccttctctctcacacctccagcagccagagaaagcggatcaacaacaaagcaagagctggttccgccttcttgaaccctgaaggggattctggcacagaggcagaaaacgacccccagctgaccttttacacggatccttcaaggagcaggaggcgtagtagagtgggttctccccgaagtcctgtgaataagaccaccttgaccctgatcagcatcaccagctgtgtgattggcctcgtgtgctcctctcacgtcaactgccctctcgttgtcaagatcaccctgcatgtccctgagcacctgattgctgatgggagccgcttcatcttgctggaggggagccagctggatgccagtgactggctgaaccctgcccaagtggttctcttctctcagcagaactccagcggaccctgggccatggacctctgtgcccggcggctcctggacccctgtgaacaccaatgtgaccccgaaactggggaatgcctctgctatgaaggctacatgaaggatccagtacataagcacctttgcattcggaacgaatgggggacaaaccaggggccatggccttacacaatatttcagcgaggctttgacctggttttgggagagcagccctctgataaaatatttagattcacctacactcttggggagggcatgtggttgcccctcagcaagagctttgtgattccaccagccgaactggccatcaatccatcagcaaagtgcaagacggacatgactgtgatggaggatgctgtggaggtcagagaggagctgatgacttcatcctccttcgacagcctggaggttctcttagattcctttgggccggtgcgcgactgcagcaaagataacgggggctgcagtaagaatttccgctgtatttcagatcgcaagctggactccactggttgcgtgtgcccatctggactcagtcccatgaaggacagctctggctgctatgaccgccacatcggggtggactgttccgacggcttcaacggcggctgtgagcagctgtgcctccagcagatggcgcccttcccggacgaccccaccttgtataacatcctcatgttctgtgggtgcatcgaggactacaagcttggtgtggatggacgctcttgccaactcatcacggagacctgtccagagggaagtgactgtggggaaagcagggagcttcccatgaaccagaccctctttggggagatgttctttggttacaacaaccattccaaggaagtggctgccggacaggtgctgaaaggaacattcaggcaaaacaactttgctcgtggtttagaccagcaactgccagatggtcttgtggtggccactgtgcccctggagaatcaatgcctagaggagatctcggagcccacccctgaccctgacttcctgactgggatggtgaacttcagtgaagtgtctgggtaccctgtgctgcagcactggaaggtccggtctgtgatgtaccacatcaaactcaaccaagtggccatctctcaggccctcagcaatgctctccactcgctggatggggctacatctcgtgcagattttgtggcgctgttggaccagttcggcaaccattacatccaggaagctatctacggctttgaggagtcctgttctatctggtacccaaacaagcaggtccagcggcgactctggctggagtatgaagacatcagtaaaggcaactccccatcagatgagtctgaggagcgggaaagagaccccaaggtgctgacattcccagaatacatcaccagcttgtcagactccggcaccaagcacatggcggctggagtccgcatggagtgccacagcaagggacgatgcccctcgtcctgccccctgtgtcatgtgacatccagccctgacacccctgctgagccggttctgctggaggtgaccaaagcagcccccatctatgaactagtgaccaacaaccagacccagaggctcttgcaggaggctaccatgagctctctctggtgctcagggactggagatgtcatcgaggactggtgtcgatgtgactccactgcttttggagctgatggactccccacctgtgcgcctctcccacagcctgtgctgagactctccacggttcacgagcccagcagcactcttgtggtcctggagtgggaacactcagagccaccaatcggggtgcagattgtagattacctcctccgtcaagagaaagtcactgacaggatggaccactccaaagtggagacagaaacagtgctgagctttgtggacgacatcatctctggagcaaagtctccttgtgcaatgccatctcaggtgccggacaagcagctcaccaccatctctctgatcatacgatgcctggaacctgacaccatttacatgttcacgctgtggggagtggacaacacaggacggcgctccaggccaagcgacgtgatcgtgaagaccccatgccccgtggtggatgatgtcaaggctcaagaaatagcagacaagatctacaatctcttcaatggctacactagtgggaaggagcagcagaccgcctacaacaccctcctggatctgggttcccccaccttacaccgggtcctctaccactataaccagcactatgagagttttggggaattcacctggcgatgtgaggatgagttaggtcccaggtaatcaataaactaagtcaacccttttaaa

SEQ ID NO: 109232 - DNA, 2356 bp, Homo sapiens
  Payload ID: 1457
  Gene Symbol: ASTN2
  Gene Name: astrotactin 2
  Uniprot ID: O75129
  ENST ID: ENST00000288520
  CDS Start-End: 411-1733
ccaagcgcgcggggcaaggcggccctgcaggggtgagctttcctctgagaacccggggccttagcgacacgtaatccagttttccgtctccttggtgcagatgaagaaaccgacgcccatgggcgaaagggacctgctcaagttcactcagtaagtcaggagataagccagaatgcgtatctgactccagtctcaatgtctaccccttcacaaaacggtagcctccagggtagtcctcagcaaagcgttggcaccttactgaatctgtttttccatctgagaaatgggccaacggaaaaatcaaacttccattctggggaagtcgagaaccgggactccctaggaagggcagtgctttggcctcatgttctgtgctctgacagagagctgcactagagacaagtttatccatgaacacattgctctgtaaaggaatgttttgcctactcagctgggaggccgacagcagaggcagacttggggagtacactctgcagcccctgtccctgcagactgaagagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacgtacggggagtccaagggccggtgagggagggtattgccctccgtgagcacagagactctccatgggagggggagcagtattctcctggatcctggggcctgggtgggctgggggacagctgaggatgggcctagcagatgaagcttgccagcaaggccaaagcaaacggtttctcctgtggatagtggacagagacctttgtaaccaatggaattattcatttttctctatcttttattttttcaaagatattatttgactctatcaaaagtctctcctttttaaaccttttcttatggatggctgtcaatcccgaggcagaagttttcaggtggagaccaagcggcctttgctcttcttccttcttcctgccacactctgctttcttcctgccatggacccctggaggagacctatggagggacagttttgacctgacccctagaggagacagttttgacctcttcagcaccaggaaggaagctctgaggatggttgcagtgaggaagcatgggtctttaaggacttctctctcttttttgctggacattattgagtttgtgggaccctgcctcttcctgctacctgtgggtctgcccagagtccctgcaggcctgtccatgcattaaaaattcctattgtctctc

SEQ ID NO: 109233 - DNA, 4747 bp, Homo sapiens
  Payload ID: 1457
  Gene Symbol: ASTN2
  Gene Name: astrotactin 2
  Uniprot ID: O75129
  ENST ID: ENST00000313400
  CDS Start-End: 102-4121
ggttcgcttcggcgtccgccgtctccgcagctgcctcctcttcctccttcgccaccgccgccaccgccgccgccgcccgcagcaccgcagcccctcccgccatggccgccgccggcgcccggctcagccccggccccggctcggggctccgggggcggccgaggctctgcttccacccggggccgccgccactgctgccgctgctgctgctgttcctgctcctgctgccgccgccgccgctgctggccggcgccaccgccgctgcctcgcgggagcccgacagcccgtgccggctgaagaccgtcacggtgtccacactgcccgccctgcgggagagcgacatcggctggagcggcgcccgcgccggggccggggctgggaccggggccggagccgccgccgccgccgcgtccccgggctctcctggctctgccggcaccgccgccgagtcgcgcctcctgctctttgtgcgtaacgagctgccggggcgcatcgcggtgcaggacgacctggacaacaccgagctgcccttcttcaccctggagatgtctggcacagcagcggacatctcgctggtgcactggagacagcagtggctggagaatggcaccttgtacttccacgtctccatgagcagctccgggcagctggcccaagccaccgcccccactctccaggagccctcggagattgttgaggagcagatgcacatcctccacatttctgtgatgggtggcctcatcgcgctgctgctgctgctgctggtgttcaccgtggcgctgtacgcccagcgacgttggcagaagcgtcgccgcatcccccagaagagcgcaagcacagaagccactcatgagatccactacatcccatctgtgctgctgggtccccaggcgcgggagagcttccgttcatcccggctgcaaacccacaattccgtcattggcgtgcccatccgggagactcccatcctggatgactatgactgtgaggaggatgaggagccacctaggcgggccaaccatgtctcccgcgaggacgagtttggcagccaggtgacccacactctggacagtctgggacatccaggggaagagaaggtggactttgagaagaaagcagcagctgaggcgactcaggagacagtggagtccctgatgcagaagttcaaggagagtttccgcgctaacacgcccatcgagatcggtcagctgcaaccacccctgcgcagcacatcggcagggaagaggaagcggaggagcaagtctcgaggaggaatcagctttgggagagccaaggggacgtcgggctcagaggcagacgatgaaactcagctgacattctacacggagcagtaccgcagtcgccgccgcagcaaaggtttgctgaaaagcccagtgaacaagacagccctgacactgattgctgtgagttcctgcatcctggccatggtgtgtggcagccagatgtcttgtccactcactgtgaaggtgactctgcatgtgcccgagcacttcatagcagatggaagcagcttcgtggtgagtgaagggagctacctggacatctccgactggttaaacccggccaagctttccctgtattaccagatcaatgccacctccccatgggtgagggacctctgtggacaaaggacgacagatgcctgtgagcagctctgcgacccagaaaccggagagtgcagctgtcatgaaggctatgcccctgaccctgttcacagacacctgtgtgtgcgcagtgactggggacagagtgaaggaccttggccctacacgacacttgagaggggctatgatctggtgacaggggagcaagcccctgaaaagattctcaggtctactttcagcttgggccaaggcctctggcttcctgtcagcaaaagctttgtggttccgcctgtggagctgtccatcaaccccctggccagctgcaagaccgatgtgctcgtcacggaagaccctgcagatgtcagggaagaagcgatgctgtccacatactttgaaaccatcaatgacctgctgtcttccttcgggccagttcgtgactgctctcggaacaatgggggctgcactcgcaacttcaagtgtgtgtctgaccggcaggtggattcctcgggatgtgtgtgccctgaggagctgaaacccatgaaggatggctctggctgctacgaccactccaaaggcattgactgctctgatggctttaatggcggctgtgagcagctgtgcctgcagcagacgctgcccctgccctacgatgccacttcgagcaccatcttcatgttctgcggttgcgtggaggagtacaaactggctcctgatggaaaatcctgcttaatgctctcagatgtctgcgagggccccaagtgcctcaaacctgactccaaattcaatgataccctctttggagagatgctacatggttacaacaaccggacccagcatgtgaaccaaggccaagtcttccagatgacctttagggagaacaacttcatcaaggactttccccagctggccgatgggctgttggtgatcccgctgccggtggaggagcagtgccggggggtcctctccgagccccttccagacctccaactgctcactggagatatcaggtatgatgaggccatgggttaccccatggtgcagcagtggcgggtccggagcaacctctaccgtgtgaagctcagcaccatcaccctcgcagcaggcttcactaatgttctcaagatcctgaccaaggagagcagtcgggaggagctgctgtccttcatccagcactatggctcccactacatcgcagaggccctctatggctcagagctcacctgcatcatccactttcccagcaagaaggtccagcagcagctgtggctccagtatcagaaagagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacgtacggggagtccaagggccggtgagggagggtattgccctccgtgagcacagagactctccatgggagggggagcagtattctcctggatcctggggcctgggtgggctgggggacagctgaggatgggcctagcagatgaagcttgccagcaaggccaaagcaaacggtttctcctgtggatagtggacagagacctttgtaaccaatggaattattcatttttctctatcttttattttttcaaagatattatttgactctatcaaaagtctctcctttttaaaccttttcttatggatggctgtcaatcccgaggcagaagttttcaggtggagaccaagcggcctttgctcttcttccttcttcctgccacactctgctttcttcctgccatggacccctggaggagacctatggagggacagttttgacctgacccctagaggagacagttttgacctcttcagcaccaggaaggaagctctgaggatggttgcagtgaggaagcatgggtctttaaggacttctctctcttttttgctggacattattgagtttgtgggaccctgcctcttcctgctacctgtgggtctgcccagagtccctgcaggcctgtccatgcattaaaaattcctattgtctctcttt

SEQ ID NO: 109234 - DNA, 1757 bp, Homo sapiens
  Payload ID: 1457
  Gene Symbol: ASTN2
  Gene Name: astrotactin 2
  Uniprot ID: O75129
  ENST ID: ENST00000341734
  CDS Start-End: 208-1395
gcttgtcgtgcagctggccccaagcgcgcggggcaaggcggccctgcaggggtgagctttcctctgagaacccggggccttagcgacacgtaatccagttttccgtctccttggtgcagatgaagaaaccgacgcccatgggcgaaagggacctgctcaagttcactcaagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacatattatttgactctatcaaaagtctctcctttttaaaccttttcttatggatggctgtcaatcccgaggcagaagttttcaggtggagaccaagcggcctttgctcttcttccttcttcctgccacactctgctttcttcctgccatggacccctggaggagacctatggagggacagttttgacctgacccctagaggagacagttttgacctcttcagcaccaggaaggaagctctgaggatggttgcagtgaggaagcatgggtctttaaggacttctctctcttttttgctggacattattgagtttgtgggaccctgcctcttcctgctacctgtgggtctgcccagagtccctgcaggcctgtccatgcattaaaaattcctattgtctctc

SEQ ID NO: 109235 - DNA, 3411 bp, Homo sapiens
  Payload ID: 1457
  Gene Symbol: ASTN2
  Gene Name: astrotactin 2
  ENST ID: ENST00000358637
  CDS Start-End: 195-779
ctggccccaagcgcgcggggcaaggcggccctgcaggggtgagctttcctctgagaacccggggccttagcgacacgtaatccagttttccgtctccttggtgcagatgaagaaaccgacgcccatgggcgaaagggacctgctcaagttcactcaagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacagtttattgctggattacatttattgatttgcggatattgaaccagccttgcatcccagggatgaagccaacttgattgtggtggataagctttttgatgtgctgctggatttggtttgccaatattttattgaagatttttgcatcgatgttcatcagggatattggtctaaaattctctttttttgttgtgtctctgccaggctttggtatcaggatgatgttggcctcataaaatgaattagggaggattccctctttttctattgatttgaatagtttcagaaggaatggtaccagctcatctttgtacctctggtagaattcggctgtgaatccatctggtcctggacttattttggttagtaggctattaattatggcctcaatttcagaacctgttattggtctattcagggattcaacttcttcctggtttagtcttgggaggaggctgtatgtgtccaggaatttatccatttcttctagattttctagtttatttgcatagaggtgtttatagtattctctaatggtagtttgtatttctgtgggatcggtggtgatatcccctttatcattttttattgcgtctatttgattcttctctcttttattctttatgagtcttgctagtagtctatcaattttgttgattttttcaaaaaaccagctcctggattcattgattttttgaagggtttttttttttttgtctctatctccttcagttctgctctcatcttagttatttcttgccttctgctagcttttgtgtgtttgctcttgcttctctagttcttttaattatgatgttagggtgtcagtttcagatctttcttgctttctcctgtgggcatttagtgctataaatctccctctacacactgctttaaatgtgtcccagagattctggtatgttgtgtcctgttctcattggtttcaaagaacatctttatttccgctttcatttcgttatgtacccagtagtcattcaggagcaagttgttcagtttccatgtagttgagcggttttgagtgagtttcttaatcctgagttctagtttgattgcactgtgttctgagagacagtttgttataatttctttcttttacatttgctgaggagtgctttacttcccactgtgtgatcaattttggaataactgcgatgtggtgctgagaagaatgtatattctgttgattggggtggatagttctgtagatgtctattaggtccgcttggtgcagagctgagttcaattcctggatatccttgttaactttctgtctcattgatctatctaatgttgacagtggggtgttaaagtctcccattattattgtgtgggagtctaagtctctttgtaagtctctaaggacttgctttatgaatctgggtgctcctatattgggtgcatatatatttaggatagttagctcgaagaaggtatcttctatttctagtctgctgcaaaggctctgttttgtttccattggaaacagatgttgaattttctgtgtctattaaaatgattgtatagtttatctctctaaatttgttaatatgataagtcacattgatagattttcatattataaaacaacctactatgtgagatttatcccaggaatgtgtaggttgttttatctgtttgttttaattaggatcattctggtctcacaaaatgaattataaaatattttctccttttcagttttctgaagtgtatctgtcttctcagagaatcactgtggttaaaattgatagtatttttttcttaatcattttttagaattcaccagtgaaggcatctgggcttagaccttttcttgcaagaaggtttttaactactaatttagttatttaatagatatagatttacttagattatctgtttcttcttgagtgatctttggcagcttgtgtgttttaaggaacttgttcattccatgtaaattatcaaatttattggaaaaagttgtttatgacattccgttactattcttttgaaatctgttgagattatagtgatattagtctcatcttgatattggtaatgtgtgtctcctctgttttttttctagatcagtttggctagatagctatgacatttatttgtattttcaaagaatcaactttcggttttatctgtttttgcttattgtttcctatttcattgatttatcctctaatttttattataattttctttgtttggcttactttgagtttggttttctccgcattttaatttttgaaatggtagctgaggctattgatttgagacctttcttgtaatgtagtcattccctcttaactactgctttagtagtatctcaaagattgtgttatgttgcgttttcattttcattcagttcaaagtatttccaatttcacttttgttttcttctttgacttatgagttatttagaggcatgccacttcgttttcaaatatttgggagttttttcagaaatttttgttgttgatttttgattccgctatagtcagaaaatatgtttttatgactttaaacattttaaatttattgagactagtttttggtctagatggtctattgctgtattcagtgttcactttaaaataatgtgtatccacttatttatgggtattttataaatgcctgttagataaaatcggttaattatgttattcaagtcttctggagcctttctgattttct

SEQ ID NO: 109236 - DNA, 4622 bp, Homo sapiens
  Payload ID: 1457
  Gene Symbol: ASTN2
  Gene Name: astrotactin 2
  Uniprot ID: O75129
  ENST ID: ENST00000361209
  CDS Start-End: 133-3999
ggctctctccgctccttagctcgggcgtcctggttcgcttcggcgtccgccgtctccgcagctgcctcctcttcctccttcgccaccgccgccaccgccgccgccgcccgcagcaccgcagcccctcccgccatggccgccgccggcgcccggctcagccccggccccggctcggggctccgggggcggccgaggctctgcttccacccggggccgccgccactgctgccgctgctgctgctgttcctgctcctgctgccgccgccgccgctgctggccggcgccaccgccgctgcctcgcgggagcccgacagcccgtgccggctgaagaccgtcacggtgtccacactgcccgccctgcgggagagcgacatcggctggagcggcgcccgcgccggggccggggctgggaccggggccggagccgccgccgccgccgcgtccccgggctctcctggctctgccggcaccgccgccgagtcgcgcctcctgctctttgtgcgtaacgagctgccggggcgcatcgcggtgcaggacgacctggacaacaccgagctgcccttcttcaccctggagatgtctggcacagcagcggacatctcgctggtgcactggagacagcagtggctggagaatggcaccttgtacttccacgtctccatgagcagctccgggcagctggcccaagccaccgcccccactctccaggagccctcggagattgttgaggagcagatgcacatcctccacatttctgtgatgggtggcctcatcgcgctgctgctgctgctgctggtgttcaccgtggcgctgtacgcccagcgacgttggcagaagcgtcgccgcatcccccagaagagcgcaagcacagaagccactcatgagatccactacatcccatctgtgctgctgggtccccaggcgcgggagagcttccgttcatcccggctgcaaacccacaattccgtcattggcgtgcccatccgggagactcccatcctggatgactatgactgtgaggaggatgaggagccacctaggcgggccaaccatgtctcccgcgaggacgagtttggcagccaggtgacccacactctggacagtctgggacatccaggggaagagaaggtggactttgagaagaaaggaggaatcagctttgggagagccaaggggacgtcgggctcagaggcagacgatgaaactcagctgacattctacacggagcagtaccgcagtcgccgccgcagcaaaggtttgctgaaaagcccagtgaacaagacagccctgacactgattgctgtgagttcctgcatcctggccatggtgtgtggcagccagatgtcttgtccactcactgtgaaggtgactctgcatgtgcccgagcacttcatagcagatggaagcagcttcgtggtgagtgaagggagctacctggacatctccgactggttaaacccggccaagctttccctgtattaccagatcaatgccacctccccatgggtgagggacctctgtggacaaaggacgacagatgcctgtgagcagctctgcgacccagaaaccggagagtgcagctgtcatgaaggctatgcccctgaccctgttcacagacacctgtgtgtgcgcagtgactggggacagagtgaaggaccttggccctacacgacacttgagaggggctatgatctggtgacaggggagcaagcccctgaaaagattctcaggtctactttcagcttgggccaaggcctctggcttcctgtcagcaaaagctttgtggttccgcctgtggagctgtccatcaaccccctggccagctgcaagaccgatgtgctcgtcacggaagaccctgcagatgtcagggaagaagcgatgctgtccacatactttgaaaccatcaatgacctgctgtcttccttcgggccagttcgtgactgctctcggaacaatgggggctgcactcgcaacttcaagtgtgtgtctgaccggcaggtggattcctcgggatgtgtgtgccctgaggagctgaaacccatgaaggatggctctggctgctacgaccactccaaaggcattgactgctctgatggctttaatggcggctgtgagcagctgtgcctgcagcagacgctgcccctgccctacgatgccacttcgagcaccatcttcatgttctgcggttgcgtggaggagtacaaactggctcctgatggaaaatcctgcttaatgctctcagatgtctgcgagggccccaagtgcctcaaacctgactccaaattcaatgataccctctttggagagatgctacatggttacaacaaccggacccagcatgtgaaccaaggccaagtcttccagatgacctttagggagaacaacttcatcaaggactttccccagctggccgatgggctgttggtgatcccgctgccggtggaggagcagtgccggggggtcctctccgagccccttccagacctccaactgctcactggagatatcaggtatgatgaggccatgggttaccccatggtgcagcagtggcgggtccggagcaacctctaccgtgtgaagctcagcaccatcaccctcgcagcaggcttcactaatgttctcaagatcctgaccaaggagagcagtcgggaggagctgctgtccttcatccagcactatggctcccactacatcgcagaggccctctatggctcagagctcacctgcatcatccactttcccagcaagaaggtccagcagcagctgtggctccagtatcagaaagagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacgtacggggagtccaagggccggtgagggagggtattgccctccgtgagcacagagactctccatgggagggggagcagtattctcctggatcctggggcctgggtgggctgggggacagctgaggatgggcctagcagatgaagcttgccagcaaggccaaagcaaacggtttctcctgtggatagtggacagagacctttgtaaccaatggaattattcatttttctctatcttttattttttcaaagatattatttgactctatcaaaagtctctcctttttaaaccttttcttatggatggctgtcaatcccgaggcagaagttttcaggtggagaccaagcggcctttgctcttcttccttcttcctgccacactctgctttcttcctgccatggacccctggaggagacctatggagggacagttttgacctgacccctagaggagacagttttgacctcttcagcaccaggaaggaagctctgaggatggttgcagtgaggaagcatgggtctttaaggacttctctctcttttttgctggacattattgagtttgtgggaccctgcctcttcctgctacctgtgggtctgcccagagtccctgcaggcctgtccatgcattaaaaattcctattgtctctc

SEQ ID NO: 109237 - DNA, 4001 bp, Homo sapiens
  Payload ID: 1457
  Gene Symbol: ASTN2
  Gene Name: astrotactin 2
  ENST ID: ENST00000361477
  CDS Start-End: 2793-4001
ggttcgcttcggcgtccgccgtctccgcagctgcctcctcttcctccttcgccaccgccgccaccgccgccgccgcccgcagcaccgcagcccctcccgccatggccgccgccggcgcccggctcagccccggccccggctcggggctccgggggcggccgaggctctgcttccacccggggccgccgccactgctgccgctgctgctgctgttcctgctcctgctgccgccgccgccgctgctggccggcgccaccgccgctgcctcgcgggagcccgacagcccgtgccggctgaagaccgtcacggtgtccacactgcccgccctgcgggagagcgacatcggctggagcggcgcccgcgccggggccggggctgggaccggggccggagccgccgccgccgccgcgtccccgggctctcctggctctgccggcaccgccgccgagtcgcgcctcctgctctttgtgcgtaacgagctgccggggcgcatcgcggtgcaggacgacctggacaacaccgagctgcccttcttcaccctggagatgtctggcacagcagcggacatctcgctggtgcactggagacagcagtggctggagaatggcaccttgtacttccacgtctccatgagcagctccgggcagctggcccaagccaccgcccccactctccaggagccctcggagattgttgaggagcagatgcacatcctccacatttctgtgatgggtggcctcatcgcgctgctgctgctgctgctggtgttcaccgtggcgctgtacgcccagcgacgttggcagaagcgtcgccgcatcccccagaagagcgcaagcacagaagccactcatgagatccactacatcccatctgtgctgctgggtccccaggcgcgggagagcttccgttcatcccggctgcaaacccacaattccgtcattggcgtgcccatccgggagactcccatcctggatgactatgactgtgaggaggatgaggagccacctaggcgggccaaccatgtctcccgcgaggacgagtttggcagccaggtgacccacactctggacagtctgggacatccaggggaagagaaggtggactttgagaagaaaggaggaatcagctttgggagagccaaggggacgtcgggctcagaggcagacgatgaaactcagctgacattctacacggagcagtaccgcagtcgccgccgcagcaaaggtttgctgaaaagcccagtgaacaagacagccctgacactgattgctgtgagttcctgcatcctggccatggtgtgtggcagccagatgtcttgtccactcactgtgaaggtgactctgcatgtgcccgagcacttcatagcagatggaagcagcttcgtggtgagtgaagggagctacctggacatctccgactggttaaacccggccaagctttccctgtattaccagatcaatgccacctccccatgggtgagggacctctgtggacaaaggacgacagatgcctgtgagcagctctgcgacccagaaaccggagagtgcagctgtcatgaaggctatgcccctgaccctgttcacagacacctgtgtgtgcgcagtgactggggacagagtgaaggaccttggccctacacgacacttgagaggggctatgatctggtgacaggggagcaagcccctgaaaagattctcaggtctactttcagcttgggccaaggcctctggcttcctgtcagcaaaagctttgtggttccgcctgtggagctgtccatcaaccccctggccagctgcaagaccgatgtgctcgtcacggaagaccctgcagatgtcagggaagaagcgatgctgtccacatactttgaaaccatcaatgacctgctgtcttccttcgggccagttcgtgactgctctcggaacaatgggggctgcactcgcaacttcaagtgtgtgtctgaccggcaggtggattcctcgggatgtgtgtgccctgaggagctgaaacccatgaaggatggctctggctgctacgaccactccaaaggcattgactgctctgatggctttaatggcggctgtgagcagctgtgcctgcagcagacgctgcccctgccctacgatgccacttcgagcaccatcttcatgttctgcggttgcgtggaggagtacaaactggctcctgatggaaaatcctgcttaatgctctcagatgtctgcgagggccccaagtgcctcaaacctgactccaaattcaatgataccctctttggagagatgctacatggttacaacaaccggacccagcatgtgaaccaaggccaagtcttccagatgacctttagggagaacaacttcatcaaggactttccccagctggccgatgggctgttggtgatcccgctgccggtggaggagcagtgccggggggtcctctccgagccccttccagacctccaactgctcactggagatatcaggtatgatgaggccatgggttaccccatggtgcagcagtggcgggtccggagcaacctctaccgtgtgaagctcagcaccatcaccctcgcagcaggcttcactaatgttctcaagatcctgaccaaggagagcagtcgggaggagctgctgtccttcatccagcactatggctcccactacatcgcagaggccctctatggctcagagctcacctgcatcatccactttcccagcaagaaggtccagcagcagctgtggctccagtatcagaaagagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacgtacggggagtccaagggccgatattatttgactctatcaaaagtctctcctttttaa

SEQ ID NO: 109238 - DNA, 3812 bp, Homo sapiens
  Payload ID: 1457
  Gene Symbol: ASTN2
  Gene Name: astrotactin 2
  ENST ID: ENST00000373986
  CDS Start-End: 1-3189
caaacccacaattccgtcattggcgtgcccatccgggagactcccatcctggatgactatgactgtgaggaggatgaggagccacctaggcgggccaaccatgtctcccgcgaggacgagtttggcagccaggtgacccacactctggacagtctgggacatccaggggaagagaaggtggactttgagaagaaagcagcagctgaggcgactcaggagacagtggagtccctgatgcagaagttcaaggagagtttccgcgctaacacgcccatcgagatcggtcagctgcaaccacccctgcgcagcacatcggcagggaagaggaagcggaggagcaagtctcgaggaggaatcagctttgggagagccaaggggacgtcgggctcagaggcagacgatgaaactcagctgacattctacacggagcagtaccgcagtcgccgccgcagcaaaggtttgctgaaaagcccagtgaacaagacagccctgacactgattgctgtgagttcctgcatcctggccatggtgtgtggcagccagatgtcttgtccactcactgtgaaggtgactctgcatgtgcccgagcacttcatagcagatggaagcagcttcgtggtgagtgaagggagctacctggacatctccgactggttaaacccggccaagctttccctgtattaccagatcaatgccacctccccatgggtgagggacctctgtggacaaaggacgacagatgcctgtgagcagctctgcgacccagaaaccggagagtgcagctgtcatgaaggctatgcccctgaccctgttcacagacacctgtgtgtgcgcagtgactggggacagagtgaaggaccttggccctacacgacacttgagaggggctatgatctggtgacaggggagcaagcccctgaaaagattctcagcttgggccaaggcctctggcttcctgtcagcaaaagctttgtggttccgcctgtggagctgtccatcaaccccctggccagctgcaagaccgatgtgctcgtcacggaagaccctgcagatgtcagggaagaagcgatgctgtccacatactttgaaaccatcaatgacctgctgtcttccttcgggccagttcgtgactgctctcggaacaatgggggctgcactcgcaacttcaagtgtgtgtctgaccggcaggtggattcctcgggatgtgtgtgccctgaggagctgaaacccatgaaggatggctctggctgctacgaccactccaaaggcattgactgctctgatggctttaatggcggctgtgagcagctgtgcctgcagcagacgctgcccctgccctacgatgccacttcgagcaccatcttcatgttctgcggttgcgtggaggagtacaaactggctcctgatggaaaatcctgcttaatgctctcagatgtctgcgagggccccaagtgcctcaaacctgactccaaattcaatgataccctctttggagagatgctacatggttacaacaaccggacccagcatgtgaaccaaggccaagtcttccagatgacctttagggagaacaacttcatcaaggactttccccagctggccgatgggctgttggtgatcccgctgccggtggaggagcagtgccggggggtcctctccgagccccttccagacctccaactgctcactggagatatcaggtatgatgaggccatgggttaccccatggtgcagcagtggcgggtccggagcaacctctaccgtgtgaagctcagcaccatcaccctcgcagcaggcttcactaatgttctcaagatcctgaccaaggagagcagtcgggaggagctgctgtccttcatccagcactatggctcccactacatcgcagaggccctctatggctcagagctcacctgcatcatccactttcccagcaagaaggtccagcagcagctgtggctccagtatcagaaagagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacgtacggggagtccaagggccggtgagggagggtattgccctccgtgagcacagagactctccatgggagggggagcagtattctcctggatcctggggcctgggtgggctgggggacagctgaggatgggcctagcagatgaagcttgccagcaaggccaaagcaaacggtttctcctgtggatagtggacagagacctttgtaaccaatggaattattcatttttctctatcttttattttttcaaagatattatttgactctatcaaaagtctctcctttttaaaccttttcttatggatggctgtcaatcccgaggcagaagttttcaggtggagaccaagcggcctttgctcttcttccttcttcctgccacactctgctttcttcctgccatggacccctggaggagacctatggagggacagttttgacctgacccctagaggagacagttttgacctcttcagcaccaggaaggaagctctgaggatggttgcagtgaggaagcatgggtctttaaggacttctctctcttttttgctggacattattgagtttgtgggaccctgcctcttcctgctacctgtgggtctgcccagagtccctgcaggcctgtccatgcattaaaaattcctattgtctctc

SEQ ID NO: 109239 - DNA, 395 bp, Homo sapiens
  Payload ID: 1457
  Gene Symbol: ASTN2
  Gene Name: astrotactin 2
  ENST ID: ENST00000417725
  CDS Start-End: 1-296
agatggcctacaacacactgatggaggtctcagcctcgatgctgttccgagtccagcaccactacaactctcactatgaaaagtttggcgacttcgtctggagaagtgaggatgagctggggcccagcctcctggaatcctttatgagcctccaggacataaatcttctggaaaggcggccgggccgcccacagaggccaggcaatccactcagtaatgtctcctggaggatatctgagattgctccaacatcccacactgatatgtcagcaggaatcaaggaaactgcctcctaatctatcctggtgctgctaataagctcactgtgcaaccctgggctctgccgctttctggccctcagtctcctcacctataacatgataaggacgaactag

SEQ ID NO: 109240 - DNA, 2974 bp, Homo sapiens
  Payload ID: 1458
  Gene Symbol: ASUN
  Gene Name: asunder spermatogenesis regulator
  Uniprot ID: Q9NVM9
  ENST ID: ENST00000261191
  CDS Start-End: 538-2658
gagtttttccaggggaaaccggcctgggtggagagacagagaaggggagaccgggtgggtgggtcgtacgcttagggggccgtggttggtacttcgctgttggggaggctttcaggtcgcccagatcctgcttcccaatgggtgactgggaaaattagcgggtggaaaatctcgaggggtggaggctttttttttcctccttggccccgccctcttcctgttcggcgactgggacgcctggccctacgagggggaagggaggcttggccgggctatcggagagcgctgtgcgcacgcgcgagcccgagtgcgtgtgtgtgtgtgcacgcgcacgcgcgctcctgctcttaggaagcctgggaaggaccggtgtgctaggagatgatcggggaaagcatagtcccctgtctgtggcaccagacactcccgactgtgcgctgactctccccgcccagccagcagccttttccagagaggctgtggtccatagcctctgttcgttttcactgcaggaccaggcacgaaagttaaaacaaaatgaagattttttctgaatctcataaaacagtgtttgttgtggatcactgcccttatatggcagaatcttgcaggcagcatgtcgagtttgatatgctggtgaagaatagaacccaaggaatcattcctttggcccccatatctaaatcattgtggacttgctcagtagaatcttccatggaatattgtagaataatgtatgatatatttcctttcaaaaagctggtgaattttattgtgagtgactctggagcacatgttttaaattcttggactcaagaagaccaaaatttacaggagctaatggcagcattagccgctgttgggcctcctaatcctcgggcagatccagagtgctgcagtattctgcatggccttgttgcagcagtggaaactctctgcaaaattactgaataccaacatgaggctcgtactctactcatggagaatgcagaacgtgttggaaatagaggacgaataatctgtattactaatgcaaaaagtgatagtcatgtgcgaatgcttgaagactgtgtccaggaaacgattcatgaacataacaagcttgctgcaaattcagatcatctcatgcagattcaaaaatgtgagttggtcttgatccacacctacccagttggtgaagacagccttgtatctgatcgttctaaaaaagagttgtccccggttttaaccagtgaagttcatagtgttcgtgcaggacggcatcttgctaccaaattgaatattttagtacagcaacattttgacttggcttcaactactattacaaatattccaatgaaggaagaacagcatgctaacacatctgccaattatgatgtggagctacttcatcacaaagatgcacatgtagatttcctgaaaagtggtgattcgcatctaggtggcggcagtcgagaaggctcgtttaaagaaacaataacattaaagtggtgtacaccaaggacaaataacattgaattacactattgtactggagcttatcggatttcacctgtagatgtaaatagtagaccttcctcctgccttactaattttcttctaaatggtcgttctgttttattggaacaaccacgaaagtcaggttctaaagtcattagtcatatgcttagtagccatggaggagagatttttttgcacgtccttagcagttctcgatccattctagaagatccaccttcaattagtgaaggatgtggaggaagagttacagactaccggattacagattttggtgaatttatgagggaaaacagattaactccttttctagaccccagatataaaatcgatggaagtcttgaggtccctttggaacgagcaaaagatcagttagaaaaacatacccgttactggcctatgatcatttcacaaaccaccatttttaacatgcaagcggtagttccattagccagtgttattgtgaaagaatctctgacagaagaagatgtgttaaactgtcaaaaaacaatatacaacttagttgatatggaaagaaaaaatgatcctctacctatttccacagttggtacaagaggaaagggccctaaaagagatgaacaataccgtatcatgtggaatgaattagaaacccttgtcagagcccatatcaacaactcagagaaacatcaaagagtcttggaatgtctgatggcatgcaggagcaaacccccagaagaggaagaacgaaagaaacgaggaagaaagagggaagacaaagaggacaagtcagagaaagcagtgaaagattatgaacaggaaaagtcttggcaagactcagagagattaaaaggaatcttagagcgtggaaaagaagaattggctgaagctgagattataaaagattcgcctgattccccagaacctccaaacaaaaaaccccttgttgaaatggatgaaactccacaagtggaaaaatcaaaagggccagtgtcgttattatccttgtggagtaatagaatcaatactgccaattccagaaaacatcaggaatttgctggacgtttgaactctgttaataacagagctgaactatatcaacatcttaaagaggaaaatgggatggagacaacagaaaatggaaaagccagccggcagtgaagagtgacttgaagaactaaatttagcatattgcaaaaatattttgtgcggaattcgatataagtacttttacagcaagatggtatagttatgttgcctggactggtttttacatttttaaaatatttcagctgtcatttttgtactaattataaaattggcacataattcaaaaatatacatttgagatgatttgtcctcccaaattatacaagtttattttatggtataaagtgttctctctggaaatgtttttaaaaaaattcttaggcttctctttgcgaaataaaactattaaaatatttgaaatgcaaaa

SEQ ID NO: 109241 - DNA, 560 bp, Homo sapiens
  Payload ID: 1458
  Gene Symbol: ASUN
  Gene Name: asunder spermatogenesis regulator
  ENST ID: ENST00000537336
  CDS Start-End: 71-560
ctcgcgagtttttccaggggaaaccggcctgggtggagagacagagaaggggagaccgggttaaaacaaaatgaagattttttctgaatctcataaaacagtgtttgttgtggatcactgcccttatatggcagaatcttgcaggcagcatgtcgagtttgatatgctggtgaagaatagaacccaaggaatcattcctttggcccccatatctaaatcattgtggacttgctcagtagaatcttccatggaatattgtagaataatgtatgatatatttcctttcaaaaagctggtgaattttattgtgagtgactctggagcacatgttttaaattcttggactcaagaagaccaaaatttacaggagctaatggcagcattagccgctgttgggcctcctaatcctcgggcagatccagagtgctgcagtattctgcatggccttgttgcagcagtggaaactctctgcaaaattactgaataccaacatgaggctcgtactctactcatggagaatgcagaacgtgttggaaatagaggacgaataatctgtatta

SEQ ID NO: 109242 - DNA, 1378 bp, Homo sapiens
  Payload ID: 1458
  Gene Symbol: ASUN
  Gene Name: asunder spermatogenesis regulator
  ENST ID: ENST00000538155
  CDS Start-End: 1-1062
ggtgattcgcatctaggtggcggcagtcgagaaggctcgtttaaagaaacaataacattaaagtggtgtacaccaaggacaaataacattgaattacactattgtactggagcttatcggatttcacctgtagatgtaaatagtagaccttcctcctgccttactaattttcttctaaatggtcgttctgttttattggaacaaccacgaaagtcaggttctaaagtcattagtcatatgcttagtagccatggaggagagatttttttgcacgtccttagcagttctcgatccattctagaagatccaccttcaattagtgaaggatgtggaggaagagttacagactaccggattacagtagttccattagccagtgttattgtgaaagaatctctgacagaagaagatgtgttaaactgtcaaaaaacaatatacaacttagttgatatggaaagaaaaaatgatcctctacctatttccacagttggtacaagaggaaagggccctaaaagagatgaacaataccgtatcatgtggaatgaattagaaacccttgtcagagcccatatcaacaactcagagaaacatcaaagagtcttggaatgtctgatggcatgcaggagcaaacccccagaagaggaagaacgaaagaaacgaggaagaaagagggaagacaaagaggacaagtcagagaaagcagtgaaagattatgaacaggaaaagtcttggcaagactcagagagattaaaaggaatcttagagcgtggaaaagaagaattggctgaagctgagattataaaagattcgcctgattccccagaacctccaaacaaaaaaccccttgttgaaatggatgaaactccacaagtggaaaaatcaaaagggccagtgtcgttattatccttgtggagtaatagaatcaatactgccaattccagaaaacatcaggaatttgctggacgtttgaactctgttaataacagagctgaactatatcaacatcttaaagaggaaaatgggatggagacaacagaaaatggaaaagccagccggcagtgaagagtgacttgaagaactaaatttagcatattgcaaaaatattttgtgcggaattcgatataagtacttttacagcaagatggtatagttatgttgcctggactggtttttacatttttaaaatatttcagctgtcatttttgtactaattataaaattggcacataattcaaaaatatacatttgagatgatttgtcctcccaaattatacaagtttattttatggtataaagtgttctctctggaaatgtttttaaaaaaattcttaggcttctctttgcgaaataaaactattaaaatatttgaaatgcaaaa

SEQ ID NO: 109243 - DNA, 875 bp, Homo sapiens
  Payload ID: 1458
  Gene Symbol: ASUN
  Gene Name: asunder spermatogenesis regulator
  ENST ID: ENST00000544548
  CDS Start-End: 201-875
accggcctgggtggagagacagagaaggggagaccgggaccaggcacgaaagtaagcgaacctcgatcctgaggtcttccctatccactcaccttgtattttccaccccccaccctccagcaaagtgggtctagaaggtttctcaaagagagttttgcatgaaggggagatgcgtcttgaaagcaagaggttaaaacaaaatgaagattttttctgaatctcataaaacagtgtttgttgtggatcactgcccttatatggcagaatcttgcaggcagcatgtcgagtttgatatgctggtgaagaatagaacccaaggaatcattcctttggcccccatatctaaatcattgtggacttgctcagtagaatcttccatggaatattgtagaataatgtatgatatatttcctttcaaaaagctggtgaattttattgtgagtgactctggagcacatgttttaaattcttggactcaagaagaccaaaatttacaggagctaatggcagcattagccgctgttgggcctcctaatcctcgggcagatccagagtgctgcagtattctgcatggccttgttgcagcagtggaaactctctgcaaaattactgaataccaacatgaggctcgtactctactcatggagaatgcagaacgtgttggaaatagaggacgaataatctgtattactaatgcaaaaagtgatagtcatgtgcgaatgcttgaagactgtgtccaggaaacgattcatgaacataacaagcttgctgcaaattcagatcatctcatgcagattcaaaaatgtgagttggtcttgatccacacctacccagttggtgaagacagccttgtatctgatcgttctaaaaaagag

SEQ ID NO: 109244 - DNA, 552 bp, Homo sapiens
  Payload ID: 1458
  Gene Symbol: ASUN
  Gene Name: asunder spermatogenesis regulator
  ENST ID: ENST00000538727
  CDS Start-End: 181-552
aggaagcctgggaaggaccggtgtgctaggagatgatcggggaaagcatagtcccctgtctgtggcaccagacactcccgactgtgcgctgactctccccgcccagccagcagccttttccagagaggctgtggtccatagcctctgttcgttttcactgcaggaccaggcacgaaactaatggcagcattagccgctgttgggcctcctaatcctcgggcagatccagagtgctgcagtattctgcatggccttgttgcagcagtggaaactctctgcaaaattactgaataccaacatgaggctcgtactctactcatggagaatgcagaacgtgttggaaatagaggacgaataatctgtattactaatgcaaaaagtgatagtcatgtgcgaatgcttgaagactgtgtccaggaaacgattcatgaacataacaagcttgctgcaaattcagatcatctcatgcagattcaaaaatgtgagttggtcttgatccacacctacccagttggtgaagacagccttgtatctgatcgttctaaaaaagag

SEQ ID NO: 109245 - DNA, 460 bp, Homo sapiens
  Payload ID: 1458
  Gene Symbol: ASUN
  Gene Name: asunder spermatogenesis regulator
  ENST ID: ENST00000536232
  CDS Start-End: 1-460
ttgctaccaaattgaatattttagtacagcaacattttgacttggcttcaactactattacaaatattccaatgaaggaagaacagcatgctaacacatctgccaattatgatgtggagctacttcatcacaaagatgcacatgtagatttcctgaaaagtgaattacactattgtactggagcttatcggatttcacctgtagatgtaaatagtagaccttcctcctgccttactaattttcttctaaatgaccccagatataaaatcgatggaagtcttgaggtccctttggaacgagcaaaagatcagttagaaaaacatacccgttactggcctatgatcatttcacaaaccaccatttttaacatgcaagcggtagttccattagccagtgttattgtgaaagaatctctgacagaagaagatgtgttaaactgtcaaaaaacaatatacaactt

SEQ ID NO: 109246 - DNA, 8751 bp, Homo sapiens
  Payload ID: 1459
  Gene Symbol: AHCTF1
  Gene Name: AT hook containing transcription factor 1
  Uniprot ID: Q8WYP5
  ENST ID: ENST00000366508
  CDS Start-End: 138-7043
tcgttacataatctcggaccggaggagcggcggcacatggcggcggagcggcgctggtggttcgcgtcctgcgccggcagtcgggtccctttacggacggccggggccgcgaccctttcccactgttctcccacgcgatggactcgttggcgggcctttccccgagggaagcggccggcgtgctgagcctgtcctgtgttggcgtgtgttccacatgcgcttgggcctggccacatggaagtatgcgagacttaagagctcaagtgactagtggtctcctgccatttccagaagtgactcttcaagcccttggagaagacgaaataacattagaatctgtgcttcgtggaaagtttgctgcagggaaaaatggacttgcttgcttggcttgtggtccacaacttgaggtagtaaactctataacaggagagcgattgtctgcttacagattcagtggagtcaatgaacagcctcctgtagttttagctgtgaaagaattctcttggcagaagagaactggattattaataggattggaagaaacagaagggagtgttctctgtctttatgaccttggaatatcaaaagtagttaaagcagttgttcttcctggaagggtaacagctattgaacctataattaatcatggaggagccagtgcaagcactcagcatttacatccaagtctgcgatggctttttggagtggcagctgtggtcactgatgttggacagatccttcttgttgacctatgtttggatgacttgtcatgcaatcaaaatgaagttgaagcatcagatcttgaagttctaactggtatcccagctgaagtaccacacattagagaaagtgtaatgagacaagggcgccatctgtgtttccagttagtaagtccaacaggaacagctgtttcaactcttagttacataagcaggacaaatcagcttgctgtaggtttttctgatggctatctagcactttggaacatgaaaagcatgaaaagagaatattacatacaattggaaagtggacaagttcctgtatatgctgtcacttttcaagaacctgagaatgatcctcggaattgctgttacttgtgggctgttcagtctacacaagatagtgaaggggatgttttgagtttgcatctgctgcagctggcctttggtaatagaaagtgtttggcatcaggacaaatcttatatgaggggttagaatactgtgaagaaagatacaccctggacctgacaggtggcatgttccctttgaggggacagacgagtaataccaaattgttgggatgccagagtatagagaaatttcgatctcatggtgacagggaggaaggcgtgaatgaagctctatcgcctgacactagtgtttcagtctttacctggcaggtgaatatatatggacagggaaagccttctgtatatttggggctttttgatataaatcgttggtatcatgcacaaatgccagattcgttaaggtcaggagaatatctacataattgctcttattttgcactgtggtcattggagtctgttgtaagtaggacttctccacatggcatcttggatatattagtacatgagagaagtttaaatagaggagtccctccttcatatccacctcccgagcagttttttaatccaagcacttataattttgatgccacttgtttgttaaactcgggagttgttcatttaacttgtactggctttcagaaggagactttgacttttttaaagaaatcaggtccatcactcaatgaactcattcctgatggttataatcgatgtcttgtagctggccttctttccccaagatttgttgatgttcagccttccagtttaagccaagaagaacagttagaagctatattgtcagcagcaattcagactagttccctgggacttttgactggttatatccgaagatggataacagaagaacaaccaaattctgccactaatttgcgctttgttcttgaatggacgtggaataaagtggttctcacaaaagaggaatttgacagactatgtgtgccattatttgatggttcgtgtcatttcatggatccacaaactatacagtctatccagcaatgctatttgcttcttagcaatcttaatatagtcttgagctgttttgcatcagaagcccgagagatcactgagagaggactgatagacttaagcaataagtttgtggtttcccacctcatctgtcagtatgcacaagtggttctttggttctctcattctgggcttttaccagaaggcatagatgattctgtgcagttgtcaaggttatgctacaactaccctgtaattcagaactactacaccagtcgtcgacagaagtttgagcgtttatcaagagggaagtggaatcccgattgcttgatgattgatggactggtttctcagttaggagagcgaattgagaagttgtggaaacgagatgaaggaggcacaggaaaatatcctcctgctagtctgcatgcagtacttgatatgtacctattagacggcgttactgaagcagccaaacactctattaccatttatttgctacttgatattatgtattcctttcccaacaaaacagacactcccattgaatctttcccaactgtatttgccatttcttggggccaagttaaacttattcaggggttttggttgatagatcataatgactatgagagtggtttggatcttttgtttcatccagctactgcaaaacctttgtcatggcaacattcaaagattattcaggcattcatgagtcagggcgagcacagacaagccctcagatatattcagacaatgaagccaacagtgtccagtggtaacgatgttatccttcacctcactgttttgctttttaataggtgtatggttgaagcctggaattttttgcggcaacattgcaataggttgaatatagaggagttactgaagcacatgtatgaagtctgtcaggaaatgggcttgatggaagatttactgaagttaccatttacagacactgagcaggaatgtttagtgaaatttttgcagtccagtgccagcgttcagaatcatgaattccttttagtgcaccatttgcagcgtgccaattatgtgcctgccttgaagctgaaccaaactctgaagattaatgttatgaatgatcgtgatcctcgtttgcgggagagatcactggctcgaaattctatattagaccagtatggaaaaatccttcctagagtccatcgaaaattagccattgaacgagctaagccttatcatctgtcaacatcatcagtttttcgattagtttctagacccaaaccattatcagcagttccaaagcaagttgtaacaggaactgtgttgacaagatctgttttcatcaacaatgtgttatctaaaattggagaagtttgggcaagcaaagaacctataaatagcaccacacctttcaatagttctaaaatagaagaaccatctcctatagtgtattcgctcccagctccagagctgcctgaggcattttttggaacaccaatttcaaaagcatcacaaaaaatttctagactgctagatttggttgttcagcctgtcccccggccttctcagtgttcggagtttattcagcaaagctccatgaaatctcctttgtacctagtatcccgttcactgccctcaagttcgcaattaaaaggatcgcctcaggccatctccagggcttcagaattacatttgcttgaaactcctcttgtagttaagaaagctaaaagtttggccatgtcagttactacttctggattttctgagttcactcctcagtccatcctgaggtctactcttcgatcaacacctttagcatctccctctccatcacctggaaggtctcctcaacgacttaaagaaactagaatttcatttgtggaagaagatgtccacccaaaatggattcctggggctgcagatgatagcaaattagaagtatttactacacctaaaaaatgtgcagttccagtggaaactgaatggctgaagagcaaagataggaccacatcttttttcctgaacagccctgaaaaggagcatcaagaaatggatgaggggtcacaaagtttagagaaactggatgtgagcaaaggaaacagcagtgtttcaatcacatccgatgagactaccttagagtatcaggatgcaccgtcaccggaagaccttgaagagactgttttcacggcctctaagcccaaaagctcttccactgcactaactactaatgtaactgaacaaactgaaaaggatggagataaagatgtatttgcatcagaagtaactccttcagacctacagaaacaaatgggcaatttagaagatgcagaaacaaaggatctcttagttgcagcagaggcattttcagaattgaatcacttaagcccggttcaaggaactgaagcttctctttgtgcaccatcagtctatgaagggaaaatcttcacccagaagtccaaggtaccagtgttggacgaaggattaacatctgttgaaacctacacccctgcaattagagcaaatgacaataaatctatggctgatgtccttggtgatggtggaaactcctcgctcactatctctgaaggtcctattgtctctgagcgcaggcttaaccaggaagtagcgctgaacttaaaagaagatcatgaagtagaagttggtgtactaaaagaaagtgttgacttaccagaagaaaagcttccaatttctgacagccctcctgatactcaagaaattcatgtgattgaacaagaaaagcttgaagctcaagattcaggagaagaggctaggaatctttcatttaatgagttatatccctctggaacacttaagcttcagtacaattttgatactattgaccaacagttttgtgacttagctgataacaaagacactgctgaatgtgacattgctgaagtagatggggaactttttgtggctcaaagcaactttaccttgatattggaaggtgaagaaggagaagttgagccaggtgattttgcatcatctgatgtgttacctaaagcagctaacacagcaactgaagaaaaacttgtatgcagtggggaaaatgataatcatggacaaattgcaaatttgccatctgccgtaactagtgaccaaaagtcccaaaaagtagacactttaccatatgtgcctgaacctattaaagtagcaattgcagaaaatttactagatgtaattaaagacacaagaagtaaagaaattacttcagatacaatggaacagtccattcatgaaacaatacctttagtgagccaaaacataatgtgtcccactaaattggtcaaatctgcatttaagactgctcaggaaacaagcacaatgactatgaatgtcagccaggttgatgacgtggtttcctccaaaactcgtacgagaggtcaacgtatccaaaacgtgaatgtcaaatcagcacaacaggaagcatcagcagatgttgctactcctaagatgccagggcagtcagtcaggaagaaaactaggaaggcaaaagaaatttctgaagcttctgaaaacatctattctgatgtcagaggactatctcagaaccagcaaatacctcaaaattctgttacgcctaggagaggaaggagaaagaaagaagttaatcaggacatactagaaaacaccagttctgtggaacaagaattacagatcactacaggtagggaatcaaaaagattaaaatcatctcagctgttggaaccagcagttgaagaaactactaaaaaagaagttaaggtttcatctgttacaaaaaggactcctagaagaattaaaagatctgtagaaaatcaggaaagtgttgaaattataaatgatctaaaagttagtacggtaacaagtcctagcagaatgatcagaaaattgagaagtactaatttagatgcttctgaaaatacaggaaataagcaagatgataaatccagtgacaagcagctgcgtattaaacatgttagaagggtcagagggagagaagttagtccatcagatgtgagagaagactccaaccttgagtcatctcagttgactgttcaagcagaatttgatatgtctgccatacctagaaaacgtggtagaccaagaaaaatcaatccatctgaagatgtaggatctaaggctgttaaggaagagagaagccccaagaagaaagaagctcccagcattagaaggagatctacaagaaataccccagctaaaagtgaaaatgttgatgttggaaaaccagctttaggaaaatccattttagtgccaaacgaggaactttcgatggtgatgagctctaagaaaaaacttacaaaaaagactgaaagtcaaagccaaaaacgttcattgcactcagtatcagaagaacgcacagatgaaatgacacataaagaaacaaatgagcaggaagaaagattgctcgccacagcttccttcactaaatcatcccgcagcagcaggactcggtctagcaaggccatcttgttgccggacctttctgaaccaaacaatgagcctttattttctccagcgtcagaagttccaaggaaagcaaaagctaaaaaaatagaggttcctgcacagctgaaagaattagtttcggatttatcttctcagtttgtcatctcacctcctgctttaaggagcagacaaaaaaacacatccaataagaacaagcttgaagatgaactgaaagatgatgcacaatcagtagaaactctgggaaagccaaaagcgaaacgaatcaggacgtcaaaaacaaaacaagcaagcaaaaacacagaaaaagaaagtgcttggtcacctcctcccatagaaattcggctgatttcccccttggctagcccagctgacggagtcaagagcaaaccaagaaaaactacagaagtgacaggaacaggtcttggaaggaacagaaagaaactgtcttcctatccaaagcaaattttacgcagaaaaatgctgtaatttcttgggaagattttaatgtacacctatttgtaaagtcatcagaatagtgtggattattaaatatctagtttggaagaaaataatttatataaattattgtaaatttttatgtaaacagaaggtcttcaataagtaaagtaactccatatggagtgattgtttcagtccaggcaatttttctattttatattaagacttcatacatttatatatgtaaatatggcttattaatggaatgttaaataaaatgtatacttcacagtcgtttgtgtcttggatttttgaaagggaggggatatctgtttaaatagttttatatgctcattggtctcattttctctataattaaaatactagaccagtcttaaaatggggatgattgaagtattgatatttctttttacagttactattttataatttatgcactttgattctgtgattcagatttctaatcagaaaatgtatttttttgtttttggctgttactatgttaaaattgaattatgggcatgtcattttgccatctttgtagtttcacaaattttgtgtaatctacctcaaatgaataatccaagtattggttaactataatgttggcatctcttattcggcaagcttaaaggctctttaaagtcttaattagtcaaagactaatccaggttagattgaccggttcactgctcacttgcaaccttatcaaagggtttgacaaagggaaatgtaaaataaatctgtttatggatattgagtgcatcttgtatgtgcctaatattgataggatgagatgtctgaacaaatttttataatattgctgtgaaggagcttgctattgaaccacagaaatcccttaatattcaggttttaaaactggcaaattctcacaggacctcaggcacagattattgaggttgggagagagtgagtagatgtagaaaaggagaaaaacaacacacgccctgttctctacagtacaactgtgtgcaattaagcaatggtacttgatgtaggctctaacactcatcaataaataagtgttgtaaaataatttataacaggtaatcgatagtgtgtaatgaatggactattaataattgattatctagaaacgaactgctttcgtgggcttttaatattttaatgtgaagcatatgcagtgtgctttctgcatttatttttctaccaaataatacagataatgagaaattggtgaaaatgcctacgcaaagtgttgacagtgtgaaagcagtgcgagtgcggccttttagtcaggttagtgatggatgttacgctgccttgttgaaaatttcactgactttgattttattacttttttaatgatagttatcaaacttgtatttaagctgcttgtcatttatggaatattgaacttatttaaatgaacttgttaaatgaataaagagctaaacataattcagtaaacaattcctttgcgcaagtagcacaataaacatggatgcaacgtatgtcaagttaatacttttttaaaccaacgcaatttggtgaatatagatgtgtggtacctgtttttaataagtgtactttttttcccccctccgtgaatgtagatcataagcaaacaaattgcctgttctaaatgaactttacatatattttaaatgaatgtatgtacttacgtataaatgtctttatatagcttgaataaaaacactgctcattaaaa

SEQ ID NO: 109247 - DNA, 8633 bp, Homo sapiens
  Payload ID: 1459
  Gene Symbol: AHCTF1
  Gene Name: AT hook containing transcription factor 1
  Uniprot ID: Q8WYP5
  ENST ID: ENST00000326225
  CDS Start-End: 98-6925
tggggctcgagggggcgagcggtggcggtggcgggtacggcaggctcgcgggcgccgggcttcgttacataatctcggaccggaggagcggcggcacatggcggcggagcggcgctgtggaagtatgcgagacttaagagctcaagtgactagtggtctcctgccatttccagaagtgactcttcaagcccttggagaagacgaaataacattagaatctgtgcttcgtggaaagtttgctgcagggaaaaatggacttgcttgcttggcttgtggtccacaacttgaggtagtaaactctataacaggagagcgattgtctgcttacagattcagtggagtcaatgaacagcctcctgtagttttagctgtgaaagaattctcttggcagaagagaactggattattaataggattggaagaaacagaagggagtgttctctgtctttatgaccttggaatatcaaaagtagttaaagcagttgttcttcctggaagggtaacagctattgaacctataattaatcatggaggagccagtgcaagcactcagcatttacatccaagtctgcgatggctttttggagtggcagctgtggtcactgatgttggacagatccttcttgttgacctatgtttggatgacttgtcatgcaatcaaaatgaagttgaagcatcagatcttgaagttctaactggtatcccagctgaagtaccacacattagagaaagtgtaatgagacaagggcgccatctgtgtttccagttagtaagtccaacaggaacagctgtttcaactcttagttacataagcaggacaaatcagcttgctgtaggtttttctgatggctatctagcactttggaacatgaaaagcatgaaaagagaatattacatacaattggaaagtggacaagttcctgtatatgctgtcacttttcaagaacctgagaatgatcctcggaattgctgttacttgtgggctgttcagtctacacaagatagtgaaggggatgttttgagtttgcatctgctgcagctggcctttggtaatagaaagtgtttggcatcaggacaaatcttatatgaggggttagaatactgtgaagaaagatacaccctggacctgacaggtggcatgttccctttgaggggacagacgagtaataccaaattgttgggatgccagagtatagagaaatttcgatctcatggtgacagggaggaaggcgtgaatgaagctctatcgcctgacactagtgtttcagtctttacctggcaggtgaatatatatggacagggaaagccttctgtatatttggggctttttgatataaatcgttggtatcatgcacaaatgccagattcgttaaggtcaggagaatatctacataattgctcttattttgcactgtggtcattggagtctgttgtaagtaggacttctccacatggcatcttggatatattagtacatgagagaagtttaaatagaggagtccctccttcatatccacctcccgagcagttttttaatccaagcacttataattttgatgccacttgtttgttaaactcgggagttgttcatttaacttgtactggctttcagaaggagactttgacttttttaaagaaatcaggtccatcactcaatgaactcattcctgatggttataatcgatgtcttgtagctggccttctttccccaagatttgttgatgttcagccttccagtttaagccaagaagaacagttagaagctatattgtcagcagcaattcagactagttccctgggacttttgactggttatatccgaagatggataacagaagaacaaccaaattctgccactaatttgcgctttgttcttgaatggacgtggaataaagtggttctcacaaaagaggaatttgacagactatgtgtgccattatttgatggttcgtgtcatttcatggatccacaaactatacagtctatccagcaatgctatttgcttcttagcaatcttaatatagtcttgagctgttttgcatcagaagcccgagagatcactgagagaggactgatagacttaagcaataagtttgtggtttcccacctcatctgtcagtatgcacaagtggttctttggttctctcattctgggcttttaccagaaggcatagatgattctgtgcagttgtcaaggttatgctacaactaccctgtaattcagaactactacaccagtcgtcgacagaagtttgagcgtttatcaagagggaagtggaatcccgattgcttgatgattgatggactggtttctcagttaggagagcgaattgagaagttgtggaaacgagatgaaggaggcacaggaaaatatcctcctgctagtctgcatgcagtacttgatatgtacctattagacggcgttactgaagcagccaaacactctattaccatttatttgctacttgatattatgtattcctttcccaacaaaacagacactcccattgaatctttcccaactgtatttgccatttcttggggccaagttaaacttattcaggggttttggttgatagatcataatgactatgagagtggtttggatcttttgtttcatccagctactgcaaaacctttgtcatggcaacattcaaagattattcaggcattcatgagtcagggcgagcacagacaagccctcagatatattcagacaatgaagccaacagtgtccagtggtaacgatgttatccttcacctcactgttttgctttttaataggtgtatggttgaagcctggaattttttgcggcaacattgcaataggttgaatatagaggagttactgaagcacatgtatgaagtctgtcaggaaatgggcttgatggaagatttactgaagttaccatttacagacactgagcaggaatgtttagtgaaatttttgcagtccagtgccagcgttcagaatcatgaattccttttagtgcaccatttgcagcgtgccaattatgtgcctgccttgaagctgaaccaaactctgaagattaatgttatgaatgatcgtgatcctcgtttgcgggagagatcactggctcgaaattctatattagaccagtatggaaaaatccttcctagagtccatcgaaaattagccattgaacgagctaagccttatcatctgtcaacatcatcagtttttcgattagtttctagacccaaaccattatcagcagttccaaagcaagttgtaacaggaactgtgttgacaagatctgttttcatcaacaatgtgttatctaaaattggagaagtttgggcaagcaaagaacctataaatagcaccacacctttcaatagttctaaaatagaagaaccatctcctatagtgtattcgctcccagctccagagctgcctgaggcattttttggaacaccaatttcaaaagcatcacaaaaaatttctagactgctagatttggttgttcagcctgtcccccggccttctcagtgttcggagtttattcagcaaagctccatgaaatctcctttgtacctagtatcccgttcactgccctcaagttcgcaattaaaaggatcgcctcaggccatctccagggcttcagaattacatttgcttgaaactcctcttgtagttaagaaagctaaaagtttggccatgtcagttactacttctggattttctgagttcactcctcagtccatcctgaggtctactcttcgatcaacacctttagcatctccctctccatcacctggaaggtctcctcaacgacttaaagaaactagaatttcatttgtggaagaagatgtccacccaaaatggattcctggggctgcagatgatagcaaattagaagtatttactacacctaaaaaatgtgcagttccagtggaaactgaatggctgaagagcaaagataggaccacatcttttttcctgaacagccctgaaaaggagcatcaagaaatggatgaggggtcacaaagtttagagaaactggatgtgagcaaaggaaacagcagtgtttcaatcacatccgatgagactaccttagagtatcaggatgcaccgtcaccggaagaccttgaagagactgttttcacggcctctaagcccaaaagctcttccactgcactaactactaatgtaactgaacaaactgaaaaggatggagataaagatgtatttgcatcagaagtaactccttcagacctacagaaacaaatgggcaatttagaagatgcagaaacaaaggatctcttagttgcagcagaggcattttcagaattgaatcacttaagcccggttcaaggaactgaagcttctctttgtgcaccatcagtctatgaagggaaaatcttcacccagaagtccaaggtaccagtgttggacgaaggattaacatctgttgaaacctacacccctgcaattagagcaaatgacaataaatctatggctgatgtccttggtgatggtggaaactcctcgctcactatctctgaaggtcctattgtctctgagcgcaggcttaaccaggaagtagcgctgaacttaaaagaagatcatgaagtagaagttggtgtactaaaagaaagtgttgacttaccagaagaaaagcttccaatttctgacagccctcctgatactcaagaaattcatgtgattgaacaagaaaagcttgaagctcaagattcaggagaagaggctaggaatctttcatttaatgagttatatccctctggaacacttaagcttcagtacaattttgatactattgaccaacagttttgtgacttagctgataacaaagacactgctgaatgtgacattgctgaagtagatggggaactttttgtggctcaaagcaactttaccttgatattggaaggtgaagaaggagaagttgagccaggtgattttgcatcatctgatgtgttacctaaagcagctaacacagcaactgaagaaaaacttgtatgcagtggggaaaatgataatcatggacaaattgcaaatttgccatctgccgtaactagtgaccaaaagtcccaaaaagtagacactttaccatatgtgcctgaacctattaaagtagcaattgcagaaaatttactagatgtaattaaagacacaagaagtaaagaaattacttcagatacaatggaacagtccattcatgaaacaatacctttagtgagccaaaacataatgtgtcccactaaattggtcaaatctgcatttaagactgctcaggaaacaagcacaatgactatgaatgtcagccaggttgatgacgtggtttcctccaaaactcgtacgagaggtcaacgtatccaaaacgtgaatgtcaaatcagcacaacaggaagcatcagcagatgttgctactcctaagatgccagggcagtcagtcaggaagaaaactaggaaggcaaaagaaatttctgaagcttctgaaaacatctattctgatgtcagaggactatctcagaaccagcaaatacctcaaaattctgttacgcctaggagaggaaggagaaagaaagaagttaatcaggacatactagaaaacaccagttctgtggaacaagaattacagatcactacaggtagggaatcaaaaagattaaaatcatctcagctgttggaaccagcagttgaagaaactactaaaaaagaagttaaggtttcatctgttacaaaaaggactcctagaagaattaaaagatctgtagaaaatcaggaaagtgttgaaattataaatgatctaaaagttagtacggtaacaagtcctagcagaatgatcagaaaattgagaagtactaatttagatgcttctgaaaatacaggaaataagcaagatgataaatccagtgacaagcagctgcgtattaaacatgttagaagggtcagagggagagaagttagtccatcagatgtgagagaagactccaaccttgagtcatctcagttgactgttcaagcagaatttgatatgtctgccatacctagaaaacgtggtagaccaagaaaaatcaatccatctgaagatgtaggatctaaggctgttaaggaagagagaagccccaagaagaaagaagctcccagcattagaaggagatctacaagaaataccccagctaaaagtgaaaatgttgatgttggaaaaccagctttaggaaaatccattttagtgccaaacgaggaactttcgatggtgatgagctctaagaaaaaacttacaaaaaagactgaaagtcaaagccaaaaacgttcattgcactcagtatcagaagaacgcacagatgaaatgacacataaagaaacaaatgagcaggaagaaagattgctcgccacagcttccttcactaaatcatcccgcagcagcaggactcggtctagcaaggccatcttgttgccggacctttctgaaccaaacaatgagcctttattttctccagcgtcagaagttccaaggaaagcaaaagctaaaaaaatagaggttcctgcacagctgaaagaattagtttcggatttatcttctcagtttgtcatctcacctcctgctttaaggagcagacaaaaaaacacatccaataagaacaagcttgaagatgaactgaaagatgatgcacaatcagtagaaactctgggaaagccaaaagcgaaacgaatcaggacgtcaaaaacaaaacaagcaagcaaaaacacagaaaaagaaagtgcttggtcacctcctcccatagaaattcggctgatttcccccttggctagcccagctgacggagtcaagagcaaaccaagaaaaactacagaagtgacaggaacaggtcttggaaggaacagaaagaaactgtcttcctatccaaagcaaattttacgcagaaaaatgctgtaatttcttgggaagattttaatgtacacctatttgtaaagtcatcagaatagtgtggattattaaatatctagtttggaagaaaataatttatataaattattgtaaatttttatgtaaacagaaggtcttcaataagtaaagtaactccatatggagtgattgtttcagtccaggcaatttttctattttatattaagacttcatacatttatatatgtaaatatggcttattaatggaatgttaaataaaatgtatacttcacagtcgtttgtgtcttggatttttgaaagggaggggatatctgtttaaatagttttatatgctcattggtctcattttctctataattaaaatactagaccagtcttaaaatggggatgattgaagtattgatatttctttttacagttactattttataatttatgcactttgattctgtgattcagatttctaatcagaaaatgtatttttttgtttttggctgttactatgttaaaattgaattatgggcatgtcattttgccatctttgtagtttcacaaattttgtgtaatctacctcaaatgaataatccaagtattggttaactataatgttggcatctcttattcggcaagcttaaaggctctttaaagtcttaattagtcaaagactaatccaggttagattgaccggttcactgctcacttgcaaccttatcaaagggtttgacaaagggaaatgtaaaataaatctgtttatggatattgagtgcatcttgtatgtgcctaatattgataggatgagatgtctgaacaaatttttataatattgctgtgaaggagcttgctattgaaccacagaaatcccttaatattcaggttttaaaactggcaaattctcacaggacctcaggcacagattattgaggttgggagagagtgagtagatgtagaaaaggagaaaaacaacacacgccctgttctctacagtacaactgtgtgcaattaagcaatggtacttgatgtaggctctaacactcatcaataaataagtgttgtaaaataatttataacaggtaatcgatagtgtgtaatgaatggactattaataattgattatctagaaacgaactgctttcgtgggcttttaatattttaatgtgaagcatatgcagtgtgctttctgcatttatttttctaccaaataatacagataatgagaaattggtgaaaatgcctacgcaaagtgttgacagtgtgaaagcagtgcgagtgcggccttttagtcaggttagtgatggatgttacgctgccttgttgaaaatttcactgactttgattttattacttttttaatgatagttatcaaacttgtatttaagctgcttgtcatttatggaatattgaacttatttaaatgaacttgttaaatgaataaagagctaaacataattcagtaaacaattcctttgcgcaagtagcacaataaacatggatgcaacgtatgtcaagttaatacttttttaaaccaacgcaatttggtgaatatagatgtgtggtacctgtttttaataagtgtactttttttcccccctccgtgaatgtagatcataagcaaacaaattgcctgttctaaatgaactttacatatattttaaatgaatgtatgtacttacgtataaatgtctttatatagcttgaataaaaacactgctcattaaaa

SEQ ID NO: 109248 - DNA, 611 bp, Homo sapiens
  Payload ID: 1459
  Gene Symbol: AHCTF1
  Gene Name: AT hook containing transcription factor 1
  ENST ID: ENST00000478568
  CDS Start-End: 409-611
gctccctcccttccggggcgtgtggaactcggttttgtcggcgcagggtaatgcgcagagcggggccggcgctgtccgaggcgagcaggcagcgttgcaaggggaaggacccagaagcgcggcgggagcagcgactgcgttttagccgctgagcggtctgcaggcctacagcccgcgaaggcactctcgggggcgtgtggctctgaggtggccggggaggtcgcaggcggcggccggagcgcagaggagcggcttcagccgggcggaggggtgtgagcccggcccgtggcggccacgtctcccgggagatgctgtgacggacccgcacgggaggagctcgcgcctggcctggcgacccggtggactcggcccgcggcggcgcgctcacccgccccgttcagtggaagtatgcgagacttaagagctcaagtgactagtggtctcctgccatttccagaagtgactcttcaagcccttggagaagacgaaataacattagaatctgtgcttcgtggaaagtttgctgcagggaaaaatggacttgcttgcttggcttgtggtccacaacttgaggtagtaaactctataacaggagagcgattgtctgctta

SEQ ID NO: 109249 - DNA, 355 bp, Homo sapiens
  Payload ID: 1459
  Gene Symbol: AHCTF1
  Gene Name: AT hook containing transcription factor 1
  ENST ID: ENST00000498601
  CDS Start-End: 1-243
gaaagtcaaagccaaaaacgttcattgcactcagtatcagaagaacgcacagatgaaatgacacataaagaaacaaatgagcaggaagaaagattgctcgccacagcttccttcactaaatcatcccgcagcagcaggactcggtctagcaaggccatcttgttgccggacctttctgaaccaaacaatgagcctttattttctccagcgtcagaagttccaaggaaagcaaaagaaagatgatgcacaatcagtagaaactctgggaaagccaaaagcgaaacgaatcaggacgtcaaaaacaaaacaagcaagcaaaaacacagaaaaagaaagtgcttggtcacctcctccc

SEQ ID NO: 109250 - DNA, 6334 bp, Homo sapiens
  Payload ID: 1460
  Gene Symbol: AHDC1
  Gene Name: AT hook, DNA binding motif, containing 1
  Uniprot ID: Q5TGY3
  ENST ID: ENST00000247087
  CDS Start-End: 598-5409
ccagcggagttagcggcggagaatgtgagccgaggcgcgagccatgctgtcagcgacggcgggcggctcagggctcctccacgactcctctcctcagcagccgggcgcccgcgtcgctgccaccgccggaagacagacgtcccccaaaacccctcgcctggctcggacccacggagccggcagcccagcactccgatgggagcttgcctgattgtcaacccatcggcctggaccccagagcccacccagttgagcgtgtgcagagggccccgagtgcggggcgacgctcaggccgttgcagagaccaccctggagatgctgatgaagacaggcctttcctgctgagcccagcctatcttcgcagcctgctcaggcgctgtccacgccccgaggcctgggctcaggccgaagttgctccacagcacccccagctgacagccagcgactggcagagcccccaggcacgggggccctctctcttccagagatctccagtgtgacagcccaggcggcagagccgagggtcctggtcccggcttctcgcaccctcatgtcagccccggccccgcccggcggcctgcggaggacaaggtcaggatgcgtgtgaagccccagggcctggtggtgacttccagtgccgtgtgcagctctcctgactacctccgggaacccaagtactaccccggcggcccccccaccccccggcccctgcttcccacccggccccctgccagcccacctgacaaggccttctccacccacgccttctccgagaacccacgcccacccccacgccgggaccccagcacccggcgcccaccagtccttgccaagggggacgacccgctgcccccacgggcagcccgtcctgtctcacaggcccgctgccccacaccggtcggagacggcagcagctcccgacgctgctgggacaacgggcgggtgaacctgcgaccagtggtgcagctgattgacatcatgaaggacctgacacgcctctcccaggacctgcagcacagtggtgtacacctggactgtggtgggctccgactgagccgcccgcctgcaccgccacccggcgacctacagtacagcttcttctcctcacccagtttggccaacagcatccgtagccctgaggagcgggccaccccacacgccaagtcggagcggcccagccatcccctctacgagcctgagcctgagcctagggacagtccccagcctggccaaggccatagtcccggagccacggctgcggccacgggtctgcccccagagcctgagccagacagcactgattactcagaacttgctgacgccgacatccttagtgagctggcctccctcacttgcccagaggcccagctgctagaggcccaggccctcgagccaccatcgcccgagccggagcctcagctcctggacccccagccccgcttcctggacccgcaggcactagagccgctcggggaagctctggagctgccacccctgcaacctcttgctgatcctctggggctgccgggcctggctctccaggccctggacaccctgcctgactccttggagtcgcagctgcttgacccccaggcactcgaccccctgcccaagctgcttgacgtcccaggtcgccgtctggagccccagcagcccctggggcactgcccactggccgagcccttgcgcctggacttgtgctcaccgcacggcccccccgggcctgagggtcaccccaagtacgccttgcggcgcactgataggccaaagatcctgtgtcgccggcggaaagccggacggggacgcaaggcagacgccggacccgagggccgcctactgcccctgcctatgcccacggggctggtggctgccctggccgaacccccaccaccaccgcctcctccaccccctgccctgccaggcccaggcccggtctcagtcccagagttgaagccggaatcttcccagaccccagtggtctctacccgcaaaggcaagtgccggggcgtgcggcgcatggtggtgaagatggccaagatccccgtatcgctggggcggcggaacaagaccacatacaaagtgtcttccttgagcagcagcctgagcgtggagggcaaggagctgggcctgcgcgtgtcggctgagcccaccccgctgctgaagatgaagaacaatgggcggaacgtggtagtggtcttcccacccggtgagatgcccattattctcaaacgtaagcgcggccgccctcctaagaacctgctgctgggtcccggcaagcccaaggagccagctgtggtggcggccgaggcagccactgtggcagcggccaccatggccatgccagaggtaaaaaaacgacggcggcggaagcagaagctggcatctccccagccatcctatgcagcagacgccaacgacagcaaggccgagtactcagacgtcctggccaagctggccttcctgaaccgccagagccagtgcgctggacggtgctcaccgccccgctgctggacacccagtgagccggagtcggtgcaccaggcccccgacacccagagcatctcccacttcctgcatcgtgtgcagggcttccggcggcgtgggggcaaagcaggcggttttggtggccggggtgggggccatgcggccaagtcagcccgatgctccttcagtgacttctttgagggcatcggcaagaaaaagaaggtggtggccgtggcagccgctggggtcgggggcccgggccttactgagttggggcacccacgcaaacggggccggggggaggtagacgctgtgactgggaagccaaagcgcaagagacggtcccggaagaatgggactctgttcccagagcaggtgcccagtggcccaggctttggggaggcaggtgctgagtgggccggggataagggtggtggctgggcccctcaccatgggcacccaggcggacaagctggccgaaactgtgggtttcaggggaccgaggcccgggcctttgcctccactgggctggagagtggagcctcaggccgtggcagctactacagcacgggtgcaccctcaggccagaccgagctcagccaggagcgccaaaacctcttcaccggctactttcgctcgctgctcgattcggatgactcctccgatctcttggactttgccctctcagcctctcgcccagagtcccggaaggcatcgggcacctatgcagggccacccaccagtgccctgcctgcccagcggggcctggccaccttccctagccggggagccaaggccagcccagtggcagtgggtagcagcggggctggggcggacccctcctttcagcctgtcctgtccgcgcgccagaccttcccaccaggacgagcagcaagctatgggctaactccagccgcttcagactgccgggcagccgagaccttccccaagctggtgcccccgccctcagccatggcccgctcacctaccacccacccgcctgccaacacctacctgccccagtacggcggctatggggccggacaaagcgtattcgccccaactaagccctttacaggccaggactgcgctaacagcaaggactgcagcttcgcctatggcagtggcaacagcctccctgcctcacccagcagcgcccacagcgccggctatgccccaccgcctaccgggggcccctgcctgccaccaagcaaggcctccttcttcagcagctctgagggggcccccttctctggttcagcccccacgcccctgcgctgtgacagccgggccagcacagtctcgcccggtggctacatggtacccaagggcaccacagcctctgccacctctgcagcctctgccgcctcctcctcctcctcctccttccagccctcgcccgagaactgtcggcagtttgcgggggcttctcagtggcctttccggcagggctatggaggcctggactgggcctcagaggcctttagtcagctctacaatcccagttttgactgccacgtcagcgagcccaacgtgatcctggacatctccaactacacaccgcagaaggtgaagcagcagacggctgtgtcggagaccttctctgagtcatcctccgacagcacccagttcaatcagccggttggtggcggggggtttcggcgtgccaacagcgaggcctcaagtagtgagggccagtcgagcctgtccagcctggagaaactgatgatggactggaacgaggcatcatctgcccccggctacaactggaaccagagtgtcctctttcagagtagctccaagccgggccgtggacggcggaagaaggtggacctgttcgaggcctcacatctgggcttcccgacatccgcctctgccgctgcctcaggctacccatccaaacggagcactgggccccggcagccgcgaggtggacggggcggtggggcctgctcagccaagaaggagcggggtggcgcagcggccaaagccaagttcatccccaagccacagccagtcaacccactgttccaggacagtcctgacctcggcctggactactatagcggggacagcagcatgtcaccactgccctcacagtcgagggccttcggcgtgggagagcgagacccctgtgacttcataggaccctactccatgaacccgtccacgccttccgatggcacctttggccaaggcttccactgcgactcgcccagcctgggtgctcccgagcttgatggcaagcatttcccaccgctggcccacccacccacggtgtttgacgccggcctgcagaaggcatactcgcccacctgctcgcctacactgggcttcaaggaagagctgcggccaccgcccacaaagctggctgcctgcgagcccctcaagcatggactccagggggccagcctgggccacgcagctgcagcccaggcccacctgagctgccgggacctgccgctgggccagccccactacgattcccccagctgcaagggcacagcctattggtaccctccaggctcagctgcccgcagcccgccctatgaaggcaaggtgggtacagggctgctggctgacttcctgggcaggacggaggccgcgtgcctcagtgcccctcacctggctagcccaccagccacgcccaaggccgacaaggagccactggaaatggcccggccccctggcccaccccgtggccctgctgcagccgctgctggctatggctgcccactccttagtgacttgaccctgtcccccgtgccgagggactcgctgctgcccctgcaggacaccgcctacaggtacccaggctttatgccccaggcgcatcctggcctgggtgggggccccaagagcggcttcctggggcccatggcggaacctcaccccgaggacacattcaccgtcacatccctgtagtgccaactgaagtgccgactggaccgcgaggttttgttcctggctttcagaaaaccaacgccaagatccctcccagcgtccacatcgtcctctggcaggagctcctgcccctctgcctcccaccctgccccctacaccccctgcagacccatctccctccaccccctcccacccatctcctccacgcagaagccgaaggtgagccctttctgcacaaaaccagcaattgtaaatactttttaaaaatgtacaaaacttaaaaacaaaacacagttttagaaaaagacaaaaaaaaaaaagagagagagagagcgagagagcgagcgtgtgcaagaggttgcgagcggggccccgaggtgtccagagcccctgcaagtatgcactgagaaatttatctacaggtcgtttgacaaaaatgaacaatatcctatttattgtatatactgttttattataaatcgtggattgtatattgcattctgtaaacctgctgtggtcccgtggtgtgcaaattcgcatggtgggggggagggagaagaacctcttgcgggagctttttttttctttcttatttttcactcttttgggttttctcttctgttgttgttgttgttgttttctgttggcaggacacacccaaagatccaagtttgtattaaaaagaaatgaaaaaaagcaaaaaaaaaacaaaaaaaaaacaaaaaaaaaaaaccaaccttgtgtcttgtgaaagggggagtgagggtggagggaatggaagggacaccgctgggttttgtcaccagctactggttctccagaggagttgaaatacctacacgtgttcctggccactgagttttcccttctgcctgagatctgggttccccctcatttcactccaggccctgcgtctcccctgcctctgagctccccactctgctgc

SEQ ID NO: 109251 - DNA, 6438 bp, Homo sapiens
  Payload ID: 1460
  Gene Symbol: AHDC1
  Gene Name: AT hook, DNA binding motif, containing 1
  Uniprot ID: Q5TGY3
  ENST ID: ENST00000374011
  CDS Start-End: 970-5781
tgatcgaggtgggggggcgccgcgggagcggggggccgtgtccagcggagttagcggcggagaatgtgagccgaggcgcgagccatgctgtcagcgacggcgggcggctcagggctcctccacgactcctctcctcagcagccgggcgcccgcgtcgctgccaccgccggaagacagacgtcccccaaaacccctcgcctggctcggacccacggagccggcagcccagcactccgatgggagcttgcctgattgtcaacccatcggcctggaccccagagcccacccagttgagcgtgtgcagagggccccgagtgcggggcgacgctcaggccgttgcagagaccaccctggagatgctgatgaagacaggcctttcctgctgagcccagcctatcttcgcagcctgctcagaaaggggaactgaggctcatggatatacagtgagtcctacctcctagcctgaggactcttccctgcgccttgatgacctgagagaactgggaggagaaaggggttgtgacaatgaccaggactcagggcagaggtggaaaccagagtgcctgatgtgtgcagctgctgacccccccaggacacctctctaccggagtctgtggaagcagagaactgggaggccaaggattggtatgaagaattaaatgaaacgatgcctggacagcttccagcccagtacctggcgcgcagtaggtgctcactaaacctgagctgcgatggtcctttccaggcgctgtccacgccccgaggcctgggctcaggccgaagttgctccacagcacccccagctgacagccagcgactggcagagcccccaggcacgggggccctctctcttccagagatctccagtgtgacagcccaggcggcagagccgagggtcctggtcccggcttctcgcaccctcatgtcagccccggccccgcccggcggcctgcggaggacaaggtcaggatgcgtgtgaagccccagggcctggtggtgacttccagtgccgtgtgcagctctcctgactacctccgggaacccaagtactaccccggcggcccccccaccccccggcccctgcttcccacccggccccctgccagcccacctgacaaggccttctccacccacgccttctccgagaacccacgcccacccccacgccgggaccccagcacccggcgcccaccagtccttgccaagggggacgacccgctgcccccacgggcagcccgtcctgtctcacaggcccgctgccccacaccggtcggagacggcagcagctcccgacgctgctgggacaacgggcgggtgaacctgcgaccagtggtgcagctgattgacatcatgaaggacctgacacgcctctcccaggacctgcagcacagtggtgtacacctggactgtggtgggctccgactgagccgcccgcctgcaccgccacccggcgacctacagtacagcttcttctcctcacccagtttggccaacagcatccgtagccctgaggagcgggccaccccacacgccaagtcggagcggcccagccatcccctctacgagcctgagcctgagcctagggacagtccccagcctggccaaggccatagtcccggagccacggctgcggccacgggtctgcccccagagcctgagccagacagcactgattactcagaacttgctgacgccgacatccttagtgagctggcctccctcacttgcccagaggcccagctgctagaggcccaggccctcgagccaccatcgcccgagccggagcctcagctcctggacccccagccccgcttcctggacccgcaggcactagagccgctcggggaagctctggagctgccacccctgcaacctcttgctgatcctctggggctgccgggcctggctctccaggccctggacaccctgcctgactccttggagtcgcagctgcttgacccccaggcactcgaccccctgcccaagctgcttgacgtcccaggtcgccgtctggagccccagcagcccctggggcactgcccactggccgagcccttgcgcctggacttgtgctcaccgcacggcccccccgggcctgagggtcaccccaagtacgccttgcggcgcactgataggccaaagatcctgtgtcgccggcggaaagccggacggggacgcaaggcagacgccggacccgagggccgcctactgcccctgcctatgcccacggggctggtggctgccctggccgaacccccaccaccaccgcctcctccaccccctgccctgccaggcccaggcccggtctcagtcccagagttgaagccggaatcttcccagaccccagtggtctctacccgcaaaggcaagtgccggggcgtgcggcgcatggtggtgaagatggccaagatccccgtatcgctggggcggcggaacaagaccacatacaaagtgtcttccttgagcagcagcctgagcgtggagggcaaggagctgggcctgcgcgtgtcggctgagcccaccccgctgctgaagatgaagaacaatgggcggaacgtggtagtggtcttcccacccggtgagatgcccattattctcaaacgtaagcgcggccgccctcctaagaacctgctgctgggtcccggcaagcccaaggagccagctgtggtggcggccgaggcagccactgtggcagcggccaccatggccatgccagaggtaaaaaaacgacggcggcggaagcagaagctggcatctccccagccatcctatgcagcagacgccaacgacagcaaggccgagtactcagacgtcctggccaagctggccttcctgaaccgccagagccagtgcgctggacggtgctcaccgccccgctgctggacacccagtgagccggagtcggtgcaccaggcccccgacacccagagcatctcccacttcctgcatcgtgtgcagggcttccggcggcgtgggggcaaagcaggcggttttggtggccggggtgggggccatgcggccaagtcagcccgatgctccttcagtgacttctttgagggcatcggcaagaaaaagaaggtggtggccgtggcagccgctggggtcgggggcccgggccttactgagttggggcacccacgcaaacggggccggggggaggtagacgctgtgactgggaagccaaagcgcaagagacggtcccggaagaatgggactctgttcccagagcaggtgcccagtggcccaggctttggggaggcaggtgctgagtgggccggggataagggtggtggctgggcccctcaccatgggcacccaggcggacaagctggccgaaactgtgggtttcaggggaccgaggcccgggcctttgcctccactgggctggagagtggagcctcaggccgtggcagctactacagcacgggtgcaccctcaggccagaccgagctcagccaggagcgccaaaacctcttcaccggctactttcgctcgctgctcgattcggatgactcctccgatctcttggactttgccctctcagcctctcgcccagagtcccggaaggcatcgggcacctatgcagggccacccaccagtgccctgcctgcccagcggggcctggccaccttccctagccggggagccaaggccagcccagtggcagtgggtagcagcggggctggggcggacccctcctttcagcctgtcctgtccgcgcgccagaccttcccaccaggacgagcagcaagctatgggctaactccagccgcttcagactgccgggcagccgagaccttccccaagctggtgcccccgccctcagccatggcccgctcacctaccacccacccgcctgccaacacctacctgccccagtacggcggctatggggccggacaaagcgtattcgccccaactaagccctttacaggccaggactgcgctaacagcaaggactgcagcttcgcctatggcagtggcaacagcctccctgcctcacccagcagcgcccacagcgccggctatgccccaccgcctaccgggggcccctgcctgccaccaagcaaggcctccttcttcagcagctctgagggggcccccttctctggttcagcccccacgcccctgcgctgtgacagccgggccagcacagtctcgcccggtggctacatggtacccaagggcaccacagcctctgccacctctgcagcctctgccgcctcctcctcctcctcctccttccagccctcgcccgagaactgtcggcagtttgcgggggcttctcagtggcctttccggcagggctatggaggcctggactgggcctcagaggcctttagtcagctctacaatcccagttttgactgccacgtcagcgagcccaacgtgatcctggacatctccaactacacaccgcagaaggtgaagcagcagacggctgtgtcggagaccttctctgagtcatcctccgacagcacccagttcaatcagccggttggtggcggggggtttcggcgtgccaacagcgaggcctcaagtagtgagggccagtcgagcctgtccagcctggagaaactgatgatggactggaacgaggcatcatctgcccccggctacaactggaaccagagtgtcctctttcagagtagctccaagccgggccgtggacggcggaagaaggtggacctgttcgaggcctcacatctgggcttcccgacatccgcctctgccgctgcctcaggctacccatccaaacggagcactgggccccggcagccgcgaggtggacggggcggtggggcctgctcagccaagaaggagcggggtggcgcagcggccaaagccaagttcatccccaagccacagccagtcaacccactgttccaggacagtcctgacctcggcctggactactatagcggggacagcagcatgtcaccactgccctcacagtcgagggccttcggcgtgggagagcgagacccctgtgacttcataggaccctactccatgaacccgtccacgccttccgatggcacctttggccaaggcttccactgcgactcgcccagcctgggtgctcccgagcttgatggcaagcatttcccaccgctggcccacccacccacggtgtttgacgccggcctgcagaaggcatactcgcccacctgctcgcctacactgggcttcaaggaagagctgcggccaccgcccacaaagctggctgcctgcgagcccctcaagcatggactccagggggccagcctgggccacgcagctgcagcccaggcccacctgagctgccgggacctgccgctgggccagccccactacgattcccccagctgcaagggcacagcctattggtaccctccaggctcagctgcccgcagcccgccctatgaaggcaaggtgggtacagggctgctggctgacttcctgggcaggacggaggccgcgtgcctcagtgcccctcacctggctagcccaccagccacgcccaaggccgacaaggagccactggaaatggcccggccccctggcccaccccgtggccctgctgcagccgctgctggctatggctgcccactccttagtgacttgaccctgtcccccgtgccgagggactcgctgctgcccctgcaggacaccgcctacaggtacccaggctttatgccccaggcgcatcctggcctgggtgggggccccaagagcggcttcctggggcccatggcggaacctcaccccgaggacacattcaccgtcacatccctgtagtgccaactgaagtgccgactggaccgcgaggttttgttcctggctttcagaaaaccaacgccaagatccctcccagcgtccacatcgtcctctggcaggagctcctgcccctctgcctcccaccctgccccctacaccccctgcagacccatctccctccaccccctcccacccatctcctccacgcagaagccgaaggtgagccctttctgcacaaaaccagcaattgtaaatactttttaaaaatgtacaaaacttaaaaacaaaacacagttttagaaaaagacaaaaaaaaaaaagagagagagagagcgagagagcgagcgtgtgcaagaggttgcgagcggggccccgaggtgtccagagcccctgcaagtatgcactgagaaatttatctacaggtcgtttgacaaaaatgaacaatatcctatttattgtatatactgttttattataaatcgtggattgtatattgcattctgtaaacctgctgtggtcccgtggtgtgcaaattcgcatggtgggggggagggagaagaacctcttgcgggagctttttttttctttcttatttttcactcttttgggttttctcttctgttgttgttgttgttgttttctgttggcaggacacacccaaagatccaagtttgtatt

SEQ ID NO: 109252 - DNA, 8577 bp, Homo sapiens
  Payload ID: 1461
  Gene Symbol: ARID1A
  Gene Name: AT rich interactive domain 1A (SWI-like)
  Uniprot ID: O14497
  ENST ID: ENST00000324856
  CDS Start-End: 372-7229
gaaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgccgcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgccgccgccgccgccctcggagctgaagaaagccgagcagcagcagcgggaggaggcggggggcgaggcggcggcggcggcagcggccgagcgcggggaaatgaaggcagccgccgggcaggaaagcgagggccccgccgtggggccgccgcagccgctgggaaaggagctgcaggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtcccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcagaattacaagcggccaatggatggcacatatggccctcctgccaagcggcacgaaggggagatgtacagcgtgccatacagcactgggcaggggcagcctcagcagcagcagttgcccccagcccagccccagcctgccagccagcaacaagctgcccagccttcccctcagcaagatgtatacaaccagtatggcaatgcctatcctgccactgccacagctgctactgagcgccgaccagcaggcggcccccagaaccaatttccattccagtttggccgagaccgtgtctctgcaccccctggcaccaatgcccagcaaaacatgccaccacaaatgatgggcggccccatacaggcatcagctgaggttgctcagcaaggcaccatgtggcaggggcgtaatgacatgacctataattatgccaacaggcagagcacgggctctgccccccagggccccgcctatcatggcgtgaaccgaacagatgaaatgctgcacacagatcagagggccaaccacgaaggctcgtggccttcccatggcacacgccagcccccatatggtccctctgcccctgtgccccccatgacaaggccccctccatctaactaccagcccccaccaagcatgcagaatcacattcctcaggtatccagccctgctcccctgccccggccaatggagaaccgcacctctcctagcaagtctccattcctgcactctgggatgaaaatgcagaaggcaggtcccccagtacctgcctcgcacatagcacctgcccctgtgcagccccccatgattcggcgggatatcaccttcccacctggctctgttgaagccacacagcctgtgttgaagcagaggaggcggctcacaatgaaagacattggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaa

SEQ ID NO: 109253 - DNA, 5992 bp, Homo sapiens
  Payload ID: 1461
  Gene Symbol: ARID1A
  Gene Name: AT rich interactive domain 1A (SWI-like)
  Uniprot ID: O14497
  ENST ID: ENST00000374152
  CDS Start-End: 284-5992
tggatctcaagcagtaccacagttacaaagtagtttttagcttacaaggtgttttcacaaataggtggtattttcatttttcaaatgacaaaattagggttctgaggcgggtcagttgacttaaaggttactaggttggtctcattgctctttcaaagtaactgtatttctttatagcatacagactaaaaaaacctgtgtacttgggttatatattcagtggccagaggccatcaaagctcaggttaatgaaatgctctttattttgtagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtcccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcagaattacaagcggccaatggatggcacatatggccctcctgccaagcggcacgaaggggagatgtacagcgtgccatacagcactgggcaggggcagcctcagcagcagcagttgcccccagcccagccccagcctgccagccagcaacaagctgcccagccttcccctcagcaagatgtatacaaccagtatggcaatgcctatcctgccactgccacagctgctactgagcgccgaccagcaggcggcccccagaaccaatttccattccagtttggccgagaccgtgtctctgcaccccctggcaccaatgcccagcaaaacatgccaccacaaatgatgggcggccccatacaggcatcagctgaggttgctcagcaaggcaccatgtggcaggggcgtaatgacatgacctataattatgccaacaggcagagcacgggctctgccccccagggccccgcctatcatggcgtgaaccgaacagatgaaatgctgcacacagatcagagggccaaccacgaaggctcgtggccttcccatggcacacgccagcccccatatggtccctctgcccctgtgccccccatgacaaggccccctccatctaactaccagcccccaccaagcatgcagaatcacattcctcaggtatccagccctgctcccctgccccggccaatggagaaccgcacctctcctagcaagtctccattcctgcactctgggatgaaaatgcagaaggcaggtcccccagtacctgcctcgcacatagcacctgcccctgtgcagccccccatgattcggcgggatatcaccttcccacctggctctgttgaagccacacagcctgtgttgaagcagaggaggcggctcacaatgaaagacattggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatga

SEQ ID NO: 109254 - DNA, 6268 bp, Homo sapiens
  Payload ID: 1461
  Gene Symbol: ARID1A
  Gene Name: AT rich interactive domain 1A (SWI-like)
  Uniprot ID: O14497
  ENST ID: ENST00000457599
  CDS Start-End: 1-6207
atggccgcgcaggtcgcccccgccgccgccagcagcctgggcaacccgccgccgccgccgccctcggagctgaagaaagccgagcagcagcagcgggaggaggcggggggcgaggcggcggcggcggcagcggccgagcgcggggaaatgaaggcagccgccgggcaggaaagcgagggccccgccgtggggccgccgcagccgctgggaaaggagctgcaggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtcccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcaggtatccagccctgctcccctgccccggccaatggagaaccgcacctctcctagcaagtctccattcctgcactctgggatgaaaatgcagaaggcaggtcccccagtacctgcctcgcacatagcacctgcccctgtgcagccccccatgattcggcgggatatcaccttcccacctggctctgttgaagccacacagcctgtgttgaagcagaggaggcggctcacaatgaaagacattggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactga

SEQ ID NO: 109255 - DNA, 3978 bp, Homo sapiens
  Payload ID: 1461
  Gene Symbol: ARID1A
  Gene Name: AT rich interactive domain 1A (SWI-like)
  ENST ID: ENST00000430799
  CDS Start-End: 1-3547
tgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcagaattacaagcggccaatggatggcacatatggccctcctgccaagcggcacgaaggggagatgtacagcgtgccatacagcactgggcaggggcagcctcagcagcagcagttgcccccagcccagccccagcctgccagccagcaacaagctgcccagccttcccctcagcaagatgtatacaaccagtatggcaatgcctatcctgccactgccacagctgctactgagcgccgaccagcaggcggcccccagaaccaatttccattccagtttggccgagaccgtgtctctgcaccccctggcaccaatgcccagcaaaacatgccaccacaaatgatgggcggccccatacaggcatcagctgaggttgctcagcaaggcaccatgtggcaggggcgtaatgacatgacctataattatgccaacaggcagagcacgggctctgccccccagggccccgcctatcatggcgtgaaccgaacagatgaaatgctgcacacagatcagagggccaaccacgaaggctcgtggccttcccatggcacacgccagcccccatatggtccctctgcccctgtgccccccatgacaaggccccctccatctaactaccagcccccaccaagcatgcagaatcacattcctcaggtatccagccctgctcccctgccccggccaatggagaaccgcacctctcctagcaagtctccattcctgcactctgggatgaaaatgcagaaggcaggtcccccagtacctgcctcgcacatagcacctgcccctgtgcagccccccatgattcggcgggatatcaccttcccacctggctctgttgaagccacacagcctgtgttgaagcagaggaggcggctcacaatgaaagacattggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaa

SEQ ID NO: 109256 - DNA, 2696 bp, Homo sapiens
  Payload ID: 1461
  Gene Symbol: ARID1A
  Gene Name: AT rich interactive domain 1A (SWI-like)
  ENST ID: ENST00000466382
  CDS Start-End: 1-434
atccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcaggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaa

SEQ ID NO: 109257 - DNA, 546 bp, Homo sapiens
  Payload ID: 1461
  Gene Symbol: ARID1A
  Gene Name: AT rich interactive domain 1A (SWI-like)
  ENST ID: ENST00000524572
  CDS Start-End: 179-546
gactgcccctcatgttgtggggagacctagactgacagagatacccagagcaggctgatctctttgttcaacaaaatagtctctccagttggaggccacatggacagcagctgcagtctgtgatgagatgaggacctcagtgtgatatgtggcatgatatggccatccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtc

SEQ ID NO: 109258 - DNA, 2583 bp, Homo sapiens
  Payload ID: 1461
  Gene Symbol: ARID1A
  Gene Name: AT rich interactive domain 1A (SWI-like)
  ENST ID: ENST00000532781
  CDS Start-End: 1-566
atggcacacgccagcccccatatggtccctctgcccctgtgccccccatgacaaggccccctccatctaactaccagcccccaccaagcatgcagaatcacattcctcaggtatccagccctgctcccctgccccggccaatggagaaccgcacctctcctagcaagtctccattcctgcactctgggatgaaaatgcagaaggcaggtcccccagtacctgcctcgcacatagcacctgcccctgtgcagccccccatgattcggcgggatatcaccttcccacctggctctgttgaagccacacagcctgtgttgaagcagaggaggcggctcacaatgaaagacattggaaccccggaggcatggcgggtaatgatgtccctcaagtctggtctcctggcagagagcacatgggcattagataccatcaacatcctgctgtatgatgacaacagcatcatgaccttcaacctcagtcagatatcttccatgccagtactttgcttcctttgcctctgggcacgggcccaggattttgacagcaataataatttgtttacatgataaccttaacacaggattgacttcaaaaggaatttgggagacactttgtggtattactcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctca

SEQ ID NO: 109259 - DNA, 3804 bp, Homo sapiens
  Payload ID: 1461
  Gene Symbol: ARID1A
  Gene Name: AT rich interactive domain 1A (SWI-like)
  ENST ID: ENST00000615191
  CDS Start-End: 284-3709
tggatctcaagcagtaccacagttacaaagtagtttttagcttacaaggtgttttcacaaataggtggtattttcatttttcaaatgacaaaattagggttctgaggcgggtcagttgacttaaaggttactaggttggtctcattgctctttcaaagtaactgtatttctttatagcatacagactaaaaaaacctgtgtacttgggttatatattcagtggccagaggccatcaaagctcaggttaatgaaatgctctttattttgtagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatgccacctcaggttgggtcagggatgtgtccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcagaattacaagcggccaatggatggcacatatggccctcctgccaagcggcacgaaggggagatgtacagcgtgccatacagcactgggcaggggcagcctcagcagcagcagttgcccccagcccagccccagcctgccagccagcaacaagctgcccagccttcccctcagcaagatgtatacaaccagtatggcaatgcctatcctgccactgccacagctgctactgagcgccgaccagcaggcggcccccagaaccaatttccattccagtttggccgagaccgtgtctctgcaccccctggcaccaatgcccagcaaaacatgccaccacaaatgatgggcggccccatacaggcatcagctgaggttgctcagcaaggcaccatgtggcaggggcgtaatgacatgacctataattatgccaacaggcagagcacggctctgccccccagggccccgcctatcatggcgtgaaccgaacagatgaaatgctgcacacagatcagagggccaaccacgaaggctcgtggccttcccatggcacacgccagcccccatatggtccctct

SEQ ID NO: 109260 - DNA, 7971 bp, Homo sapiens
  Payload ID: 1462
  Gene Symbol: ARID1B
  Gene Name: AT rich interactive domain 1B (SWI1-like)
  Uniprot ID: Q8NFD5
  ENST ID: ENST00000350026
  CDS Start-End: 2-6712
catggcccataacgcgggcgccgcggccgccgccggcacccacagcgccaagagcggcggctccgaggcggctctcaaggagggtggaagcgccgccgcgctgtcctcctcctcctcctcctccgcggcggcagcggcggcatcctcttcctcctcgtcgggcccgggctcggccatggagacggggctgctccccaaccacaaactgaaaaccgttggcgaagcccccgccgcgccgccccaccagcagcaccaccaccaccaccatgcccaccaccaccaccaccatgcccaccacctccaccaccaccacgcactacagcagcagctaaaccagttccagcagcagcagcagcagcagcaacagcagcagcagcagcagcagcaacagcaacatcccatttccaacaacaacagcttgggcggcgcgggcggcggcgcgcctcagcccggccccgacatggagcagccgcaacatggaggcgccaaggacagtgctgcgggcggccaggccgaccccccgggcccgccgctgctgagcaagccgggcgacgaggacgacgcgccgcccaagatgggggagccggcgggcggccgctacgagcacccgggcttgggcgccctgggcacgcagcagccgccggtcgccgtgcccgggggcggcggcggcccggcggccgtcccggagtttaataattactatggcagcgctgcccctgcgagcggcggccccggcggccgcgctgggccttgctttgatcaacatggcggacaacaaagccccgggatggggatgatgcactccgcctccgccgccgccgccggggcccccggcagcatggaccccctgcagaactcccacgaagggtaccccaacagccagtgcaaccattatccgggctacagccggcccggcgcgggcggcggcggcggcggcggcggcggaggaggaggaggcagcggaggaggaggaggaggaggaggagcaggagcaggaggagcaggagcgggagctgtggcggcggcggccgcggcggcggcggcagcagcaggaggcggcggcggcggcggctatgggggctcgtccgcggggtacggggtgctgagctccccccggcagcagggcggcggcatgatgatgggccccgggggcggcggggccgcgagcctcagcaaggcggccgccggctcggcggcggggggcttccagcgcttcgccggccagaaccagcacccgtcgggggccaccccgaccctcaatcagctgctcacctcgcccagccccatgatgcggagctacggcggcagctaccccgagtacagcagccccagcgcgccgccgccgccgccgtcgcagccccagtcccaggcggcggcggcgggggcggcggcgggcggccagcaggcggccgcgggcatgggcttgggcaaggacatgggcgcccagtacgccgctgccagcccggcctgggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcagatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaagaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctgctaactcgggatccttgcaaggcccacagaccccccagtcaactggcagcaattccatggcagaggttccaggtgacctgaagccacctaccccagcctccacccctcacggccagatgactccaatgcaaggtggaagaagcagtacaatcagtgtgcacgacccattctcagatgtgagtgattcatccttcccgaaacggaactccatgactccaaacgccccctaccagcagggcatgagcatgcccgatgtgatgggcaggatgccctatgagcccaacaaggacccctttgggggaatgagaaaagtgcctggaagcagcgagccctttatgacgcaaggacagatgcccaacagcagcatgcaggacatgtacaaccaaagtccctccggagcaatgtctaacctgggcatggggcagcgccagcagtttccctatggagccagttacgaccgaaggcatgaaccttatgggcagcagtatccaggccaaggccctccctcgggacagccgccgtatggagggcaccagcccggcctgtacccacagcagccgaattacaaacgccatatggacggcatgtacgggcccccagccaagcgccacgagggcgacatgtacaacatgcagtacagcagccagcagcaggagatgtacaaccagtatggaggctcctactcgggcccggaccgcaggcccatccagggccagtacccgtatccctacagcagggagaggatgcagggcccggggcagatccagacacacggaatcccgcctcagatgatgggcggcccgctgcagtcgtcctccagtgaggggcctcagcagaatatgtgggcagcacgcaatgatatgccttatccctaccagaacaggcagggccctggcggccctacacaggcgcccccttacccaggcatgaaccgcacagacgatatgatggtacccgatcagaggataaatcatgagagccagtggccttctcacgtcagccagcgtcagccttatatgtcgtcctcagcctccatgcagcccatcacacgcccaccacagccgtcctaccagacgccaccgtcactgccaaatcacatctccagggcgcccagcccagcgtccttccagcgctccctggagaaccgcatgtctccaagcaagtctccttttctgccgtctatgaagatgcagaaggtcatgcccacggtccccacatcccaggtcaccgggccaccaccccaaccacccccaatcagaagggagatcacctttcctcctggctcagtagaagcatcacaaccagtcttgaaacaaaggcgaaagattacctccaaagatatcgttactcctgaggcgtggcgtgtgatgatgtcccttaaatcaggtcttttggctgagagtacgtgggctttggacactattaatattcttctgtatgatgacagcactgttgctactttcaatctctcccagttgtctggatttctcgaacttttagtcgagtactttagaaaatgcctgattgacatttttggaattcttatggaatatgaagtgggagaccccagccaaaaagcacttgatcacaacgcagcaaggaaggatgacagccagtccttggcagacgattctgggaaagaggaggaagatgctgaatgtattgatgacgacgaggaagacgaggaggatgaggaggaagacagcgagaagacagaaagcgatgaaaagagcagcatcgctctgactgccccggacgccgctgcagacccaaaggagaagcccaagcaagccagtaagttcgacaagctgccaataaagatagtcaaaaagaacaacctgtttgttgttgaccgatctgacaagttggggcgtgtgcaggagttcaatagtggccttctgcactggcagctcggcgggggtgacaccaccgagcacattcagactcactttgagagcaagatggaaattcctcctcgcaggcgcccacctccccccttaagctccgcaggtagaaagaaagagcaagaaggcaaaggcgactctgaagagcagcaagagaaaagcatcatagcaaccatcgatgacgtcctctctgctcggccaggggcattgcctgaagacgcaaaccctgggccccagaccgaaagcagtaagtttccctttggtatccagcaagccaaaagtcaccggaacatcaagctgctggaggacgagcccaggagccgagacgagactcctctgtgtaccatcgcgcactggcaggactcgctggctaagcgatgcatctgtgtgtccaatattgtccgtagcttgtcattcgtgcctggcaatgatgccgaaatgtccaaacatccaggcctggtgctgatcctggggaagctgattcttcttcaccacgagcatccagagagaaagcgagcaccgcagacctatgagaaagaggaggatgaggacaagggggtggcctgcagcaaagatgagtggtggtgggactgcctcgaggtcttgagggataacacgttggtcacgttggccaacatttccgggcagctagacttgtctgcttacacggaaagcatctgcttgccaattttggatggcttgctgcactggatggtgtgcccgtctgcagaggcacaagatccctttccaactgtgggacccaactcggtcctgtcgcctcagagacttgtgctggagaccctctgtaaactcagtatccaggacaataatgtggacctgatcttggccactcctccatttagtcgtcaggagaaattctatgctacattagttaggtacgttggggatcgcaaaaacccagtctgtcgagaaatgtccatggcgcttttatcgaaccttgcccaaggggacgcactagcagcaagggccatagctgtgcagaaaggaagcattggaaacttgataagcttcctagaggatggggtcacgatggcccagtaccagcagagccagcacaacctcatgcacatgcagcccccgcccctggaaccacctagcgtagacatgatgtgcagggcggccaaggctttgctagccatggccagagtggacgaaaaccgctcggaattccttttgcacgagggccggttgctggatatctcgatatcagctgtcctgaactctctggttgcatctgtcatctgtgatgtactgtttcagattgggcagttatgacataagtgagaaggcaagcatgtgtgagtgaagattagagggtcacatataactggctgttttctgttcttgtttatccagcgtaggaagaaggaaaagaaaatctttgctcctctgccccattcactatttaccaattgggaattaaagaaataattaatttgaacagttatgaaattaatatttgctgtctgtgtgtataagtacatcctttggggttttttttttctcttttttttaaccaaagttgctgtctagtgcattcaaaggtcactttttgttcttcacagatctttttaatgttctttcccatgttgtattgcatttttgggggaagcaaattgactttaaagaaaaaagttgtggcaaaagatgctaagatgcgaaaatttcaccacactgagtcaaaaaggtgaaaaattatccatttcctatgcgttttactcctcagagaatgaaaaaaactgcatcccatcacccaaagttctgtgcaatagaaatttctacagatacaggtataggggctcaaggaggtatgtcggtcagtagtcaaaactatgaaatgatactggtttctccacaggaatatggttccattaggctgggagcaaaaacaatgttttttaagattgagaatacatacctgacaacgatccggaaactgctcctcaccactcccgtcatgcctgctgtcggcgtttgaccttccacgtgacagttcttcacaattcctttcatcattttttaaatattttttttactgcctatgggctgtgatgtatatagaagttgtacattaaacataccctcatttttttcttttcttttttttttttttttttagtacaaagttttagtttctttttcatgatgtggtaactacgaagtgatggtagatttaaataattttttatttttattttatatattttttcattagggccatatctccaaaaaaagaaagaaaaaatacaaaaaacaaaaacaaaaaaaaaagagggtaatgtacaagtttctgtatgtataaagtcatgctcgatttcaggagagcagctgatcacaatttgcttcatgaatcaaggtgtggaaatggttatatatggattgatttagaaaatggttaccagtacagtcaaaaaagagaaaatgaaaaaaatacaactaaaaggaagaaacacaacttcaaagatttttcagtgatgagaatccacatttgtatttcaagataatgtagtttaaaaaaaaaaaaaagaaaaaaa

SEQ ID NO: 109261 - DNA, 2202 bp, Homo sapiens
  Payload ID: 1462
  Gene Symbol: ARID1B
  Gene Name: AT rich interactive domain 1B (SWI1-like)
  ENST ID: ENST00000319584
  CDS Start-End: 1-2187
cagatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaaggatagctacagctctcagggtatttctcagcccccaaccccaggcaacctgccagtcccttccccaatgtcccccagctctgctagcatctcctcatttcatggagatgaaagtgatagcattagcagcccaggctggccaaagactccatcaagccctaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctgtagtccagatggagccgagggcctgtgacacaggaggcagtggaaggaaagcctcctggtctcgtccagccccgagagcgcgtgcagggggctccaggcacacacaggcgtctgggggtcgcaggcagaggcaccctggtcttcagaagcctctcgattcactgccacccacacagcaggtggcctctccgattccagtcccatcattagggaaagtgtctggaaacatttttgttgttaaaggaaaataaaattattcccaacta

SEQ ID NO: 109262 - DNA, 10194 bp, Homo sapiens
  Payload ID: 1462
  Gene Symbol: ARID1B
  Gene Name: AT rich interactive domain 1B (SWI1-like)
  Uniprot ID: Q8NFD5
  ENST ID: ENST00000346085
  CDS Start-End: 557-7306
tctcaagccatgctgggcccgataggctcagctagtcgtgtatttacccatatccgggctagagaggaaaagagaaaagtttcatttaaacctgaactaaaaactttcaccatgaaagcacacagcaggagcaggcccagagcgtaaggcgtgcccggcccggcgctccggcggggcctgcggagggggagggggtcgcggcttcccggcgggccgcgtggatgcgcacaggaggggccgcggcctgaaaagtgggggttattgtctccccccgccccccgcccggcctcgccacgccgcggcgatcatggccgcgcgggcagcagcggcggcggcggcggcggcggcgcgggcgcgggcgcgggcaggcagcggcgaacggcgggcgccccccgggccgcggccggcgcccggagcccgggacctggaggcgggggcgcgcggcgcggcggcggcggcggcggcaccgggacccatgctggggggcggcggcgacggcggcggcggcctgaacagtgtgcaccaccaccccctgctcccccgtcacgaactcaacatggcccataacgcgggcgccgcggccgccgccggcacccacagcgccaagagcggcggctccgaggcggctctcaaggagggtggaagcgccgccgcgctgtcctcctcctcctcctcctccgcggcggcagcggcggcatcctcttcctcctcgtcgggcccgggctcggccatggagacggggctgctccccaaccacaaactgaaaaccgttggcgaagcccccgccgcgccgccccaccagcagcaccaccaccaccaccatgcccaccaccaccaccaccatgcccaccacctccaccaccaccacgcactacagcagcagctaaaccagttccagcagcagcagcagcagcagcaacagcagcagcagcagcagcagcaacagcaacatcccatttccaacaacaacagcttgggcggcgcgggcggcggcgcgcctcagcccggccccgacatggagcagccgcaacatggaggcgccaaggacagtgctgcgggcggccaggccgaccccccgggcccgccgctgctgagcaagccgggcgacgaggacgacgcgccgcccaagatgggggagccggcgggcggccgctacgagcacccgggcttgggcgccctgggcacgcagcagccgccggtcgccgtgcccgggggcggcggcggcccggcggccgtcccggagtttaataattactatggcagcgctgcccctgcgagcggcggccccggcggccgcgctgggccttgctttgatcaacatggcggacaacaaagccccgggatggggatgatgcactccgcctccgccgccgccgccggggcccccggcagcatggaccccctgcagaactcccacgaagggtaccccaacagccagtgcaaccattatccgggctacagccggcccggcgcgggcggcggcggcggcggcggcggcggaggaggaggaggcagcggaggaggaggaggaggaggaggagcaggagcaggaggagcaggagcgggagctgtggcggcggcggccgcggcggcggcggcagcagcaggaggcggcggcggcggcggctatgggggctcgtccgcggggtacggggtgctgagctccccccggcagcagggcggcggcatgatgatgggccccgggggcggcggggccgcgagcctcagcaaggcggccgccggctcggcggcggggggcttccagcgcttcgccggccagaaccagcacccgtcgggggccaccccgaccctcaatcagctgctcacctcgcccagccccatgatgcggagctacggcggcagctaccccgagtacagcagccccagcgcgccgccgccgccgccgtcgcagccccagtcccaggcggcggcggcgggggcggcggcgggcggccagcaggcggccgcgggcatgggcttgggcaaggacatgggcgcccagtacgccgctgccagcccggcctgggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcaggactctggagatgccacatggaaagaaacattctggttgatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaagaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctgctaactcgggatccttgcaaggcccacagaccccccagtcaactggcagcaattccatggcagaggttccaggtgacctgaagccacctaccccagcctccacccctcacggccagatgactccaatgcaaggtggaagaagcagtacaatcagtgtgcacgacccattctcagatgtgagtgattcatccttcccgaaacggaactccatgactccaaacgccccctaccagcagggcatgagcatgcccgatgtgatgggcaggatgccctatgagcccaacaaggacccctttgggggaatgagaaaagtgcctggaagcagcgagccctttatgacgcaaggacagatgcccaacagcagcatgcaggacatgtacaaccaaagtccctccggagcaatgtctaacctgggcatggggcagcgccagcagtttccctatggagccagttacgaccgaaggcatgaaccttatgggcagcagtatccaggccaaggccctccctcgggacagccgccgtatggagggcaccagcccggcctgtacccacagcagccgaattacaaacgccatatggacggcatgtacgggcccccagccaagcgccacgagggcgacatgtacaacatgcagtacagcagccagcagcaggagatgtacaaccagtatggaggctcctactcgggcccggaccgcaggcccatccagggccagtacccgtatccctacagcagggagaggatgcagggcccggggcagatccagacacacggaatcccgcctcagatgatgggcggcccgctgcagtcgtcctccagtgaggggcctcagcagaatatgtgggcagcacgcaatgatatgccttatccctaccagaacaggcagggccctggcggccctacacaggcgcccccttacccaggcatgaaccgcacagacgatatgatggtacccgatcagaggataaatcatgagagccagtggccttctcacgtcagccagcgtcagccttatatgtcgtcctcagcctccatgcagcccatcacacgcccaccacagccgtcctaccagacgccaccgtcactgccaaatcacatctccagggcgcccagcccagcgtccttccagcgctccctggagaaccgcatgtctccaagcaagtctccttttctgccgtctatgaagatgcagaaggtcatgcccacggtccccacatcccaggtcaccgggccaccaccccaaccacccccaatcagaagggagatcacctttcctcctggctcagtagaagcatcacaaccagtcttgaaacaaaggcgaaagattacctccaaagatatcgttactcctgaggcgtggcgtgtgatgatgtcccttaaatcaggtcttttggctgagagtacgtgggctttggacactattaatattcttctgtatgatgacagcactgttgctactttcaatctctcccagttgtctggatttctcgaacttttagtcgagtactttagaaaatgcctgattgacatttttggaattcttatggaatatgaagtgggagaccccagccaaaaagcacttgatcacaacgcagcaaggaaggatgacagccagtccttggcagacgattctgggaaagaggaggaagatgctgaatgtattgatgacgacgaggaagacgaggaggatgaggaggaagacagcgagaagacagaaagcgatgaaaagagcagcatcgctctgactgccccggacgccgctgcagacccaaaggagaagcccaagcaagccagtaagttcgacaagctgccaataaagatagtcaaaaagaacaacctgtttgttgttgaccgatctgacaagttggggcgtgtgcaggagttcaatagtggccttctgcactggcagctcggcgggggtgacaccaccgagcacattcagactcactttgagagcaagatggaaattcctcctcgcaggcgcccacctccccccttaagctccgcaggtagaaagaaagagcaagaaggcaaaggcgactctgaagagcagcaagagaaaagcatcatagcaaccatcgatgacgtcctctctgctcggccaggggcattgcctgaagacgcaaaccctgggccccagaccgaaagcagtaagtttccctttggtatccagcaagccaaaagtcaccggaacatcaagctgctggaggacgagcccaggagccgagacgagactcctctgtgtaccatcgcgcactggcaggactcgctggctaagcgatgcatctgtgtgtccaatattgtccgtagcttgtcattcgtgcctggcaatgatgccgaaatgtccaaacatccaggcctggtgctgatcctggggaagctgattcttcttcaccacgagcatccagagagaaagcgagcaccgcagacctatgagaaagaggaggatgaggacaagggggtggcctgcagcaaagatgagtggtggtgggactgcctcgaggtcttgagggataacacgttggtcacgttggccaacatttccgggcagctagacttgtctgcttacacggaaagcatctgcttgccaattttggatggcttgctgcactggatggtgtgcccgtctgcagaggcacaagatccctttccaactgtgggacccaactcggtcctgtcgcctcagagacttgtgctggagaccctctgtaaactcagtatccaggacaataatgtggacctgatcttggccactcctccatttagtcgtcaggagaaattctatgctacattagttaggtacgttggggatcgcaaaaacccagtctgtcgagaaatgtccatggcgcttttatcgaaccttgcccaaggggacgcactagcagcaagggccatagctgtgcagaaaggaagcattggaaacttgataagcttcctagaggatggggtcacgatggcccagtaccagcagagccagcacaacctcatgcacatgcagcccccgcccctggaaccacctagcgtagacatgatgtgcagggcggccaaggctttgctagccatggccagagtggacgaaaaccgctcggaattccttttgcacgagggccggttgctggatatctcgatatcagctgtcctgaactctctggttgcatctgtcatctgtgatgtactgtttcagattgggcagttatgacataagtgagaaggcaagcatgtgtgagtgaagattagagggtcacatataactggctgttttctgttcttgtttatccagcgtaggaagaaggaaaagaaaatctttgctcctctgccccattcactatttaccaattgggaattaaagaaataattaatttgaacagttatgaaattaatatttgctgtctgtgtgtataagtacatcctttggggttttttttttctcttttttttaaccaaagttgctgtctagtgcattcaaaggtcactttttgttcttcacagatctttttaatgttctttcccatgttgtattgcatttttgggggaagcaaattgactttaaagaaaaaagttgtggcaaaagatgctaagatgcgaaaatttcaccacactgagtcaaaaaggtgaaaaattatccatttcctatgcgttttactcctcagagaatgaaaaaaactgcatcccatcacccaaagttctgtgcaatagaaatttctacagatacaggtataggggctcaaggaggtatgtcggtcagtagtcaaaactatgaaatgatactggtttctccacaggaatatggttccattaggctgggagcaaaaacaatgttttttaagattgagaatacatacctgacaacgatccggaaactgctcctcaccactcccgtcatgcctgctgtcggcgtttgaccttccacgtgacagttcttcacaattcctttcatcattttttaaatattttttttactgcctatgggctgtgatgtatatagaagttgtacattaaacataccctcatttttttcttttcttttttttttttttttttagtacaaagttttagtttctttttcatgatgtggtaactacgaagtgatggtagatttaaataattttttatttttattttatatattttttcattagggccatatctccaaaaaaagaaagaaaaaatacaaaaaacaaaaacaaaaaaaaaagagggtaatgtacaagtttctgtatgtataaagtcatgctcgatttcaggagagcagctgatcacaatttgcttcatgaatcaaggtgtggaaatggttatatatggattgatttagaaaatggttaccagtacagtcaaaaaagagaaaatgaaaaaaatacaactaaaaggaagaaacacaacttcaaagatttttcagtgatgagaatccacatttgtatttcaagataatgtagtttaaaaaaaaaaaaaagaaaaaaacttgatgtaaattcctccttttcctctggcttaatgaatatcatttattcagtataaaatctttatatgttccacatgttaagaataaatgtacattaaatcttgttaagcactgtgatgggtgttcttgaatactgttctagtttccttaaagtggtttcctagtaatcaagttatttacaagaaataggggaatgcagcagtgtattcacattataaaaccctacatttggaagagacctttaggggttacctactttagagtggggagcaacagtttgattttctcaaattacttagctaattagtctttctttgaagcaattaactctaacgacattgaggtatgatcattttcagtatttatgggaggtggctgctgacccacttgaggtgagatctcagaagcttaactggcctgaaaatgtaacattctgccttttactaactccatcttagtttaatcaaagttcaatctattccttgtttcttctgtgtgcctcagagttattttgcatttagtttactccaccgtgtataatatttatactgtgcaatgttaaaaaagaatctgttatattgtatgtggtgtacatagtgcaaagtgatgatttctatttcagggcatattatggttctcatattccttcctacctggtgcacagtagctttttaatactagtcacttctaatttaaactttctcttcctgggtcattgactgttactgtgtaataatcgatttctttgaaactgctgcataattatgctgttagtggacctctacctcttctcttccctctcccaatcacagtatactcagaatccccagcccctcgcatacattgtgtcggttcacattactcacagtaatatatggaagagttagacaagaacatgcagttacagtcattgtgagacgtgactctccagtgtcacgaggaaaaaaatcatcttttctgcaaacagtctctcatctgtcaactcccacattactgagtcaaacagtcttcttacataacaatgcaaccaaatatatgttgaattaaagacccatttataattctgctttaaatacatctgcttgctaagaacagatttcagtgctccaagcttcaaatatggagatttgtaagagggaattcaatattattctaatttctctcttacagagtacaaataaaaggtgtatacaaactccgaacatatccagtattccaattcctttgtcaatcagaagagtaaaataattaacaaaagactgttgttatggtttgcattgtaaccgatacgcagagtctgaccgttgggcaacaagtttttctatcctgatgcgcaacacagtctctagagactaatccaggaagactttagcctcctttccatattctcacccccgaatcaagatttacagaagcccacgaagaatttacagcctgcttgagatcatcttgcctataaactgagttattgctttgtcctaaaaattagtcggtttttttttttctatgaggcttttcagaaatttacaggatgcccagactttacatgtgtaccaaaaaaaaaaaaaagataaaaaataaaggtgcaaagaaagtttagtattttggaatggtgctataaagttgaa

SEQ ID NO: 109263 - DNA, 2887 bp, Homo sapiens
  Payload ID: 1462
  Gene Symbol: ARID1B
  Gene Name: AT rich interactive domain 1B (SWI1-like)
  ENST ID: ENST00000400790
  CDS Start-End: 1-822
gcagcagtgatgcaggctgctgcgaactcagcacaaagcaggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaagaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctggtaagtggcggcgctgcagtcactggcccaggaaagcccaggcgcctggcctgggaggttccgggaaggtggtttcacagtcaggccaacagggaacttgggacttttgagaggtggggggttcctgtgtcgttttgtttatttaattggacgcccactggcagtgttaagggatgagagaattaaatctgggatatggccatttctggttgacacttggaaggcaccccttcttttgctttaccttaatcaaaacaggctttcgaattctaagccatatacgtttattgcttatacaagtattcaaaaagattccatctacctctacacaaaataaagatcccccagtggccagtttgaatacatgtgcacttctaggaaatgccaccctacaggttcgacagctcgagctcccccgccctctttcggaaatcctcagatttgaactttagtaaaatgaagcctgggcttcgtttctaatgtcccctacccagcaagttctcacttctagggaatttaacaagctgtcgtggtaaggatccacacggccttgttttggaaacaggtggtcttttgcagccttgttctggaagtcaggggtcttaggaatgggtgcagcgctggccaccaacacgctcgcaggccgagccacatcagtgacgcctgctggctcccttccctctcctccccactgacagagaccctcccattcctttcagctcccctgccagccttcgttctaccgtttggctttcagatttgaaatgacaaaatcatatattctgataaatgcaatagtagagaggggaagaaattggcaccttagtgctgggtggtgaccttactccagtagatccgaccattctcttatctgtgtctgcctcgcagtcagcgaccttcagcacattagcctcactgttcctggtccctgtctatgagatgtggctgcacccaccgctcctgtacacagcttgttctgagcgtggctggcagcccatgtttcctgagcacttccagtgtgctgggcccttttctaagtgctatcatttcattttcacatcagccctgtgacattgatactattttaaaatccatgagaaaatgaaggtctcgtggaatctaagtacttgcccaaagccaactagctggggagtagaaggtcttatctggggcatctggtgctacagtatacacgatacccaccagacacctctggctgtattgaaaatacctttgtaatatgtgaaatgtttacacatagaagccagagaaagaggtcatttcatttttaatgatttcctctagctgctgtctggatggcaaagctgatatccaaggttgctaatcaagggatctcacataaatacgttttaggcccaaagtgcacttgtagtgaatatacctagaattacatctgtaggctctaaaaacaagtagaaatcctcgctaacctcatccttaaagattcaaaggctttaccaactcaggtgtcccttaaaaactgggaaatctaattttaaaaatctcacaacattacatccagttcacagagtaaaacaagctgcctgtgaacagctctgaaactatttttccaaaataaaaacccagtggggcgtagggaccaaagtggtgatgtctgtaaagatctaagggtacattttatttgccaggaaagaactcgtgtcactgaatgggctgcacttgtgtatggagaatagctctcccagtgtgcatcagcttcaggacgggggccctgctgaggcgtatagatccttcagaaagtggagggcctgttctcttaacagccagccgttcccttttccccttttttaaactgtcatttttatggcaacattatcattttaactacacaaaagagcttggattgcaaatggactcctggtatacattcttctcagtagtccagatggagccgagggcctgtgacacaggaggcagtggaaggaaagcctcctggtctcgtccagccccgagagcgcgtgcagggggctccaggcacacacaggcgtctgggggtcgcaggcagaggcaccctggtcttcagaagcctctcgattcactgccacccacacagcaggtggcctctccgattccagtcccatcattagggaaagtgtctggaaacatttttgttgttaaaggaaaataaaatta

SEQ ID NO: 109264 - DNA, 6653 bp, Homo sapiens
  Payload ID: 1462
  Gene Symbol: ARID1B
  Gene Name: AT rich interactive domain 1B (SWI1-like)
  ENST ID: ENST00000414678
  CDS Start-End: 1-5277
agccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcagatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaaggatagctacagctctcagggtatttctcagcccccaaccccaggcaacctgccagtcccttccccaatgtcccccagctctgctagcatctcctcatttcatggagatgaaagtgatagcattagcagcccaggctggccaaagactccatcaagccctaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctgctaactcgggatccttgcaaggcccacagaccccccagtcaactggcagcaattccatggcagaggttccaggtgacctgaagccacctaccccagcctccacccctcacggccagatgactccaatgcaaggtggaagaagcagtacaatcagtgtgcacgacccattctcagatgtgagtgattcatccttcccgaaacggaactccatgactccaaacgccccctaccagcagggcatgagcatgcccgatgtgatgggcaggatgccctatgagcccaacaaggacccctttgggggaatgagaaaagtgcctggaagcagcgagccctttatgacgcaaggacagatgcccaacagcagcatgcaggacatgtacaaccaaagtccctccggagcaatgtctaacctgggcatggggcagcgccagcagtttccctatggagccagttacgaccgaaggcatgaaccttatgggcagcagtatccaggccaaggccctccctcgggacagccgccgtatggagggcaccagcccggcctgtacccacagcagccgaattacaaacgccatatggacggcatgtacgggcccccagccaagcgccacgagggcgacatgtacaacatgcagtacagcagccagcagcaggagatgtacaaccagtatggaggctcctactcgggcccggaccgcaggcccatccagggccagtacccgtatccctacagcagggagaggatgcagggcccggggcagatccagacacacggaatcccgcctcagatgatgggcggcccgctgcagtcgtcctccagtgaggggcctcagcagaatatgtgggcagcacgcaatgatatgccttatccctaccagaacaggcagggccctggcggccctacacaggcgcccccttacccaggcatgaaccgcacagacgatatgatggtacccgatcagaggataaatcatgagagccagtggccttctcacgtcagccagcgtcagccttatatgtcgtcctcagcctccatgcagcccatcacacgcccaccacagccgtcctaccagacgccaccgtcactgccaaatcacatctccagggcgcccagcccagcgtccttccagcgctccctggagaaccgcatgtctccaagcaagtctccttttctgccgtctatgaagatgcagaaggtcatgcccacggtccccacatcccaggtcaccgggccaccaccccaaccacccccaatcagaagggagatcacctttcctcctggctcagtagaagcatcacaaccagtcttgaaacaaaggcgaaagattacctccaaagatatcgttactcctgaggcgtggcgtgtgatgatgtcccttaaatcaggtcttttggctgagagtacgtgggctttggacactattaatattcttctgtatgatgacagcactgttgctactttcaatctctcccagttgtctggatttctcgaacttttagtcgagtactttagaaaatgcctgattgacatttttggaattcttatggaatatgaagtgggagaccccagccaaaaagcacttgatcacaacgcagcaaggaaggatgacagccagtccttggcagacgattctgggaaagaggaggaagatgctgaatgtattgatgacgacgaggaagacgaggaggatgaggaggaagacagcgagaagacagaaagcgatgaaaagagcagcatcgctctgactgccccggacgccgctgcagacccaaaggagaagcccaagcaagccagtaagttcgacaagctgccaataaagatagtcaaaaagaacaacctgtttgttgttgaccgatctgacaagttggggcgtgtgcaggagttcaatagtggccttctgcactggcagctcggcgggggtgacaccaccgagcacattcagactcactttgagagcaagatggaaattcctcctcgcaggcgcccacctccccccttaagctccgcaggtagaaagaaagagcaagaaggcaaaggcgactctgaagagcagcaagagaaaagcatcatagcaaccatcgatgacgtcctctctgctcggccaggggcattgcctgaagacgcaaaccctgggccccagaccgaaagcagtaagtttccctttggtatccagcaagccaaaagtcaccggaacatcaagctgctggaggacgagcccaggagccgagacgagactcctctgtgtaccatcgcgcactggcaggactcgctggctaagcgatgcatctgtgtgtccaatattgtccgtagcttgtcattcgtgcctggcaatgatgccgaaatgtccaaacatccaggcctggtgctgatcctggggaagctgattcttcttcaccacgagcatccagagagaaagcgagcaccgcagacctatgagaaagaggaggatgaggacaagggggtggcctgcagcaaagatgagtggtggtgggactgcctcgaggtcttgagggataacacgttggtcacgttggccaacatttccgggcagctagacttgtctgcttacacggaaagcatctgcttgccaattttggatggcttgctgcactggatggtgtgcccgtctgcagaggcacaagatccctttccaactgtgggacccaactcggtcctgtcgcctcagagacttgtgctggagaccctctgtaaactcagtatccaggacaataatgtggacctgatcttggccactcctccatttagtcgtcaggagaaattctatgctacattagttaggtacgttggggatcgcaaaaacccagtctgtcgagaaatgtccatggcgcttttatcgaaccttgcccaaggggacgcactagcagcaagggccatagctgtgcagaaaggaagcattggaaacttgataagcttcctagaggatggggtcacgatggcccagtaccagcagagccagcacaacctcatgcacatgcagcccccgcccctggaaccacctagcgtagacatgatgtgcagggcggccaaggctttgctagccatggccagagtggacgaaaaccgctcggaattccttttgcacgagggccggttgctggatatctcgatatcagctgtcctgaactctctggttgcatctgtcatctgtgatgtactgtttcagattgggcagttatgacataagtgagaaggcaagcatgtgtgagtgaagattagagggtcacatataactggctgttttctgttcttgtttatccagcgtaggaagaaggaaaagaaaatctttgctcctctgccccattcactatttaccaattgggaattaaagaaataattaatttgaacagttatgaaattaatatttgctgtctgtgtgtataagtacatcctttggggttttttttttctcttttttttaaccaaagttgctgtctagtgcattcaaaggtcactttttgttcttcacagatctttttaatgttctttcccatgttgtattgcatttttgggggaagcaaattgactttaaagaaaaaagttgtggcaaaagatgctaagatgcgaaaatttcaccacactgagtcaaaaaggtgaaaaattatccatttcctatgcgttttactcctcagagaatgaaaaaaactgcatcccatcacccaaagttctgtgcaatagaaatttctacagatacaggtataggggctcaaggaggtatgtcggtcagtagtcaaaactatgaaatgatactggtttctccacaggaatatggttccattaggctgggagcaaaaacaatgttttttaagattgagaatacatacctgacaacgatccggaaactgctcctcaccactcccgtcatgcctgctgtcggcgtttgaccttccacgtgacagttcttcacaattcctttcatcattttttaaatattttttttactgcctatgggctgtgatgtatatagaagttgtacattaaacataccctcatttttttcttttcttttttttttttttttttagtacaaagttttagtttctttttcatgatgtggtaactacgaagtgatggtagatttaaataattttttatttttattttatatattttttcattagggccatatctccaaaaaaagaaagaaaaaatacaaaaaacaaaaacaaaaaaaaaagagggtaatgtacaagtttctgtatgtataaagtcatgctcgatttcaggagagcagctgatcacaatttgcttcatgaatcaaggtgtggaaatggttatatatggattgatttagaaaatggttaccagtacagtcaaaaaagagaaaatgaaaaaaatacaactaaaaggaagaaacacaacttcaaagatttttcagtgatgagaatccacatttgtatttcaagataatgtagtttaaaaaaaaaaaaaagaaaaaaacttgatgtaaattcctccttttcctctggcttaatgaatatcatttattcagtataaaatctttatatgttccacatgttaagaataaatgtacattaaatcttgttaagcactgtg

SEQ ID NO: 109265 - DNA, 916 bp, Homo sapiens
  Payload ID: 1462
  Gene Symbol: ARID1B
  Gene Name: AT rich interactive domain 1B (SWI1-like)
  ENST ID: ENST00000478761
  CDS Start-End: 1-916
cagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggccaccatacattaggtcgcctgcttatcccagccagtctggggctggcggacgccccatgttttcttcccagcaccccaactatggcaactctcaggctcccatggtgcaccagcctgaccagtacgggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaaggatagctacagctctcagggtatttctcagcccccaaccccaggcaacctgccagtcccttccccaatgtcccccagctctgctagcatctcctcatttcatggagatgaaagtgatagcattagcagcccaggctggccaaagactccatcaagccctaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccag

SEQ ID NO: 109266 - DNA, 8642 bp, Homo sapiens
  Payload ID: 1463
  Gene Symbol: ARID2
  Gene Name: AT rich interactive domain 2 (ARID, RFX-like)
  Uniprot ID: Q68CP9
  ENST ID: ENST00000334344
  CDS Start-End: 173-5680
gcgccgccgccgccgccgccgccgccgccgccgccgccaccgccggcccatgactgagccccgccgccgccggccgaggaatgggctccgggctctggtaggaagcgctgggagcggggggcgcttttaaaacaccgatctgggttttttaaaaacctcctttgaaaaaataatggcaaactcgacggggaaggcgcctccggacgagcggagaaagggactcgctttcctggacgagctgcggcagttccaccacagcagagggtcgccttttaaaaaaatccctgcggtgggtgggaaggagctggatcttcacggtctctacaccagagtcactactttaggcggattcgcgaaggtttctgagaagaatcagtggggagaaattgttgaagagttcaactttcccagaagttgttctaacgctgcctttgctttaaaacagtattacttgcgttacctagaaaagtacgagaaagttcatcattttggggaggatgatgatgaggtaccaccaggcaatccaaagccacagcttcctattggtgcaattccatcttcctacaattaccagcaacacagtgtgtcggattatctgcgtcaaagttatgggctgtccatggactttaattcgccaaatgattataataaattggtgctttcactgttatctggactcccaaatgaagtggactttgctattaacgtatgcactctcctatcaaatgaaagcaagcacgtcatgcaacttgaaaaagatcctaaaatcatcactttactacttgctaatgccggggtgtttgacgacactttaggatccttttccactgtatttggagaagaatggaaagagaagactgatagagacttcgttaagttttggaaagacatcgttgatgataatgaagttcgtgacctcatttctgacagaaacaagtctcatgaaggtacatcaggagaatggatttgggagtctttatttcatccacctcgaaagctgggcattaacgatattgaaggacagcgggtacttcagattgcagtgattttgagaaatctttcctttgaggagggcaatgttaagctcttggcagctaatcgtacctgtcttcgtttcctattactttctgcacatagtcattttatttctttaaggcaattaggccttgacacattaggaaatattgcagctgagcttttactggaccctgttgatttcaaaactactcatctgatgtttcatactgttacaaaatgtctaatgtcaagggatagatttttaaagatgagaggcatggaaattttgggaaatctttgcaaagcagaagataatggtgttttaatttgtgaatatgtggatcaggattcctacagagagatcatttgtcatctcactttacctgatgtgctgcttgtaatctcaacactcgaggtgctatacatgctcacggaaatgggagatgttgcttgcacaaaaattgcaaaagtagaaaagagcatagacatgttagtgtgtctggtttctatggatattcagatgtttggccctgatgcactagctgcggtaaaactcattgaacacccaagttccagtcatcaaatgttatctgaaattaggccacaagctatagagcaagtccaaacccagactcatgtagcatctgccccagcttccagagcagttgtagcgcagcatgttgctccacctccaggaatagtggaaatagatagtgagaagtttgcttgtcagtggctaaatgctcattttgaagtaaatccagattgttctgtttctcgagcagaaatgtattctgaatacctctcgacttgcagtaaattagctcgtggtggaatcctaacatcaactggattttataaatgtcttagaacggtctttccaaatcatacagtgaagagagtggaggattccagtagcaatgggcaggcacatattcatgtggtaggagtaaaacggagggctataccacttcccattcagatgtactatcagcagcaaccagtttctacttctgttgttcgtgttgattctgttcctgatgtatctcctgctccttcacctgcaggaatccctcatggatcacaaaccataggaaaccattttcagaggactcctgttgccaaccaatcttcaaatctgactgcaacacaaatgtcttttcctgtacaaggtgttcatactgtggcacaaactgtttcaagaattccacaaaatccttcacctcatacccaccagcaacaaaatgctccagtgactgtcattcaaagtaaagctccaattccttgtgaagttgttaaggctacagttatccagaattccataccccagacaggagttcctgttagtattgctgttggaggaggacctccacagagttctgttgttcagaatcatagtacagggccacaacctgttacagttgtgaattctcagacattgcttcaccatccatctgtaattccacagcagtctccattacacacagtggtaccaggacagatcccttcaggcactcctgttacagtaattcaacaagctgtcccacagagtcatatgtttggcagagtacagaacataccagcatgtacttctacagtttcacagggtcaacagttaatcaccacatcaccccaacctgtgcaaacttcatctcaacagacatcagctggtagccagtcacaagatactgttatcatagcacccccacagtatgtaacaacttctgcatccaatattgtctcagcaacttcagtacagaattttcaggtagctacaggacaaatggttactattgctggtgtcccaagtccacaagcctcaagggtagggtttcagaacattgcaccaaaacctctcccttctcagcaagtttcatctacagtggtacagcagcctattcaacaaccacagcagccaacccaacaaagcgtagtgattgtaagccagccagctcaacaaggtcaaacttatgcaccagccattcaccaaattgttcttgctaatccagcagctcttccagctggtcagacagttcagctaactggacaacctaacataactccatcttcttcaccatcacctgtcccagctactaataaccaagtccctactgccatgtcgtcgtcctctacccctcaatcacagggaccacctcctactgtcagtcaaatgttatctgtgaaaaggcagcaacagcagcaacattcaccagcacccccaccacagcaggtacaagtacaagttcagcagccccaacaagtacagatgcaagttcaacctcaacagtcgaatgcaggagttggtcagcctgcctctggtgagtcgagtctgattaaacagcttctgcttccgaaacgtggtccttcaacaccaggtggtaagcttattctcccagctccacagattcctccccctaataatgcaagagctcctagccctcaggtggtctatcaggtggccagtaaccaagccgcaggttttggagtgcaggggcaaactccagctcagcagctattggttgggcagcaaaatgttcagttggtcccaagtgcaatgccaccctcagggggagtacaaactgtgcccatttcgaacttacaaatattgccaggtccactgatctcaaatagcccagcaaccattttccaagggacttctggcaaccaggtaaccataacagttgtgccaaatacgagttttgcacctgcaactgtgagtcagggaaatgcaactcagctcattgctccagcaggaattaccatgagcggaacgcagacaggagttggacttccagtacaaacgcttccagccactcaagcatctcctgctggacaatcatcatgtactactgctactcccccattcaaaggtgataaaataatttgccaaaaggaggaggaagcaaaggaagcaacaggtttacatgttcatgaacgtaaaattgaagtcatggagaacccgtcctgccgacgaggagccacaaacaccagcaatggggatacaaaggaaaatgaaatgcatgtgggaagtcttttaaatgggagaaagtacagtgactcaagtctacctccttcaaactcagggaaaattcaaagtgagactaatcagtgctcactaatcagtaatgggccatcattggaattaggtgagaatggagcatctgggaaacagaactcagaacaaatagacatgcaagatatcaaaagtgatttgagaaaaccgctagttaatggaatctgtgattttgataaaggagatggttctcatttaagcaaaaacattccaaatcataaaacttccaatcatgtaggaaatggtgagatatctccaatggaaccacaagggactttagatatcactcagcaagatactgccaaaggtgatcaactagaaagaatttctaatggacctgtattaactttgggtggttcatctgtgagcagtatacaggaggcttcaaatgcggcaacacagcaatttagtggtactgatttgcttaatggacctctagcttcaagtttgaattcagatgtgcctcagcaacgcccaagtgtagttgtctcaccacattctacaacctctgttatacagggacatcaaatcatagcagttcccgactcaggatcaaaagtatcccattctcctgccctatcatctgacgttcggtctacaaatggcacagcagaatgcaaaactgtaaagaggccagcagaggatactgatagggaaacagtcgcaggaattccaaataaagtaggagttagaattgttacaatcagtgaccccaacaatgctggctgcagcgcaacaatggttgctgtgccagcaggagcagatccaagcactgtagctaaagtagcaatagaaagtgctgttcagcaaaagcaacagcatccaccaacatatgtacagaatgtggtcccgcagaacactcctatgccaccttcaccagctgtacaagtgcagggccagcctaacagttctcagccttctccattcagtggatccagtcagcctggagatccaatgagaaaacctggacagaacttcatgtgtctgtggcagtcttgtaaaaagtggtttcagacaccctcacaggttttctaccatgcagcaactgaacatggaggaaaagatgtatatccagggcagtgtctttgggaaggttgtgagccttttcagcgacagcggttttcttttattacccacttgcaggataagcactgttcaaaggatgccctacttgcaggattaaaacaagatgaaccaggacaagcaggaagtcagaagtcttctaccaagcagccaactgtagggggcacaagctcaactcctagagcacaaaaggccattgtgaatcatcccagtgctgcacttatggctctgaggagaggatcaagaaaccttgtctttcgagattttacagatgaaaaagagggaccaataactaaacacatccgactaacagctgccttaatattaaaaaatattggtaaatattcagaatgtggtcgcagattgttaaagagacatgaaaataacttatcagtgctagccattagtaacatggaagcttcctccacccttgccaaatgcctttatgaacttaattttacagttcagagtaaggaacaagaaaaagactcagaaatgctgcagtgaaaaataattccacttacacagtgggggactcaaagtcagccacatttcacatactgttactgaagaaagcaccaagtcttaatggaacaaagaccatagaatgaattattttatctcctcccatgatgctgagaggaagcttcgtattctgatctctgagtgaatccctttgttctctgtttaaaaaaatctaaaaagaaaaaggaaaaaaaaaaaagaactgctgtgggattgtcaaccagcttatctgcaggatgtttcagatctgataaatcctgatggaaactggtatgatcagaattcagtaccatccacattggaatatacatggaatattgtaaaacctacatgagcagatgaaatagaagcattaaatatttttatctatatccaaaaaggagcacatttttatatttacaaaaccgtttaagctggtttgaataatttaaaaaagtttcagcacacctatacccccgatctcagagggggccaccaatatctagctatggatcgtgtgttttgtttagaaatcagtagcttggttttcttacttgagccaatatattttcacttatttattatcataaaaatttaccagtctgaatagatcttgtaaatatttgtgaatagaatgaatacctttcatgccactgcagccactggaaatacattctgtggtgtcctagaagcattattggtaggttctaaagttttctagactttcctgtcaattgtaagtaattgtgatatattctatgcagtggatgaatgttctttaaatttgtgtaaatacttctgcaaaggtactgatgctgtaaagtcaaaacagttttgtggaactgtgatttttttttcttttttctttttttttttctttttttttttgtattatacaccttgtagaactcattttgctggctgaaagagtatggaataatatatctcatgtcattttttagaagaaaaactatttgaaggtattttttggttttccttaacatgtatccactgtaaacgtttgtcgtgtacaagctcagagcttggacagaattttttgtatttgtaaattggtttaaatacatggaattttatacaggttttctcctgtgttatatatgcattatgtgcaggtatgatattttcttcactactttttctatcttaatatagtgtggaattttattgtattattcttccattcttaatactgtaccacattcctgctcagaaactgctcacttccttaaattgtcttttttcccccagcgtgaaatgtatccatttataactgcctattgcctgttctattagcatccaaaaatgtggaaggcctcccaaccaccatttctgctgtgtccttaggatgtgcagtaaaaaatatagacctaacagtttatgttatagaatggctttatttactttggtgactgtttatagtttttaaataaaagactgaacattttcttgagtccttcatttctgagtatgcttaagacatcttaaaaatatagagagaattctaaattcagctgaaggcaaggtataacggtcacctacctatttgattatatgttgattgataacatattaaatagagaacaaataagagaggtcctttacatgacaaatttgcatgaaataagcagattaaccaagtatttatttttcatcttgttataatgcagagcaaatgtagagaacagcaaatgattgatgcagttaaagctcaatatgcctttttttactggatactgtacatttggctaaaagcttttattgtttgatgttgtgtttcttgactgtttattcagaatcacagtgtatccaaatcttcagcttgaatttggaggcagattcttagagtgaaaaagcctcagtttccatattaaaaatgttttaaatattttgattgaattagtaccaatgtaaaatctagtttcttcctgaaggaggatccctggcgctgtcctgccatgtctcaaaggaatgtttgagaaacttcatctaatattagttataaggttgtggaatttatgcttggcccaccttccaagactggcactgcccaacagacaccgctgaaatcatgtgggtatccctaggatggccttcagagccctcaaacttacaagcacctggtagttgacatcatatggggaattttctattcaccgtacttatccaaaaatctcttttaaaaagtaaatttgtgcaacaacgtttatttgaaagataatgtcttctcaaaatcagaaactgcagtggtaattaaattaatagaaaagagaacaaactgcaggtttagaaaaatggttttcatattcaccattcttccacctcattgaattgcatgctgtagttctagcttttctgctataatatgtaaatatgactgtagccttttaagcttcagtctcagcagagaatttcctaaatgcgtttgacctaatgaaactgatcatggcttcccacttaggtttttcttcttatagctttatagaactatataataatatggacttgctgtgtaatggaattaaagtgcttttgcacaataagttctgcaaaaccctctcattcatgaaaaggtgctccttgctagacagaaacttgctgatttacagtattgttatttttgtctaaagttctgtaaatacatgctttaatgttatctttgagaaatctatgtaaataatatagtctacaacatagagactgtataattctgtgttatatatgtgcctagtgctctgttggcactcaataaattttaagtaacaaaattgataatcatatagcgaaggcatatttttcttccaagctcaagtcaggattgtgactatatattaatgagactcagtaatccaacccacacctgagaactcgtctcattactttatagtcatgtcatgtatgtttttttaaccatgaaatgacaataaaatgatttttaaaatgagaa

SEQ ID NO: 109267 - DNA, 4356 bp, Homo sapiens
  Payload ID: 1463
  Gene Symbol: ARID2
  Gene Name: AT rich interactive domain 2 (ARID, RFX-like)
  ENST ID: ENST00000457135
  CDS Start-End: 6-1211
ctccaatggaaccacaagggactttagatatcactcagcaagatactgccaaaggtgatcaactagaaagaatttctaatggacctgtattaactttgggtggttcatctgtgagcagtatacaggaggcttcaaatgcggcaacacagcaatttagtggtactgatttgcttaatggacctctagcttcaagtttgaattcagatgtgcctcagcaacgcccaagtgtagttgtctcaccacattctacaacctctgttatacagggacatcaaatcatagcagttcccgactcaggatcaaaagtatcccattctcctgccctatcatctgacgttcggtctacaaatggcacagcagaatgcaaaactgtaaagaggccagcagaggatactgatagggaaacagtcgcaggaattccaaataaagtaggagttagaattgttacaatcagtgaccccaacaatgctggctgcagcgcaacaatggttgctgtgccagcaggagcagatccaagcactgtagctaaagtagcaatagaaagtgctgttcagcaaaagcaacagcatccaccaacatatgtacagaatgtggtcccgcagaacactcctatgccaccttcaccagctgtacaagtgcagggccagcctaacagttctcagccttctccattcagtggatccagtcagcctggagatccaatgagaaaacctggacagaacttcatgtgtctgtggcagtcttgtaaaaagtggtttcagacaccctcacaggttttctaccatgcagcaactgaacatggaggaaaagatgtatatccagggcagtgtctttgggaaggttgtgagccttttcagcgacagcggttttcttttattacccacttgcaggataagcactgttcaaaggatgccctacttgcaggattaaaacaagatgaaccaggacaagcaggaagtcagaagtcttctaccaagcagccaactgtagggggcacaagctcaactcctagagcacaaaaggccattgtgaatcatcccagtgctgcacttatggctctgaggagaggatcaagaaaccttgtctttcgagattttacagatgaaaaagagggaccaataactaaacacatccgactaacagctgccttaatattaaaaaatattggtaaatattcagaatgtggtcgcagaaacatgaatgaagattgaaaaagaattttgctgtgcagccttccatatttagaaagattgttaaagagacatgaaaataacttatcagtgctagccattagtaacatggaagcttcctccacccttgccaaatgcctttatgaacttaattttacagttcagagtaaggaacaagaaaaagactcagaaatgctgcagtgaaaaataattccacttacacagtgggggactcaaagtcagccacatttcacatactgttactgaagaaagcaccaagtcttaatggaacaaagaccatagaatgaattattttatctcctcccatgatgctgagaggaagcttcgtattctgatctctgagtgaatccctttgttctctgtttaaaaaaatctaaaaagaaaaaggaaaaaaaaaaaagaactgctgtgggattgtcaaccagcttatctgcaggatgtttcagatctgataaatcctgatggaaactggtatgatcagaattcagtaccatccacattggaatatacatggaatattgtaaaacctacatgagcagatgaaatagaagcattaaatatttttatctatatccaaaaaggagcacatttttatatttacaaaaccgtttaagctggtttgaataatttaaaaaagtttcagcacacctatacccccgatctcagagggggccaccaatatctagctatggatcgtgtgttttgtttagaaatcagtagcttggttttcttacttgagccaatatattttcacttatttattatcataaaaatttaccagtctgaatagatcttgtaaatatttgtgaatagaatgaatacctttcatgccactgcagccactggaaatacattctgtggtgtcctagaagcattattggtaggttctaaagttttctagactttcctgtcaattgtaagtaattgtgatatattctatgcagtggatgaatgttctttaaatttgtgtaaatacttctgcaaaggtactgatgctgtaaagtcaaaacagttttgtggaactgtgatttttttttcttttttctttttttttttctttttttttttgtattatacaccttgtagaactcattttgctggctgaaagagtatggaataatatatctcatgtcattttttagaagaaaaactatttgaaggtattttttggttttccttaacatgtatccactgtaaacgtttgtcgtgtacaagctcagagcttggacagaattttttgtatttgtaaattggtttaaatacatggaattttatacaggttttctcctgtgttatatatgcattatgtgcaggtatgatattttcttcactactttttctatcttaatatagtgtggaattttattgtattattcttccattcttaatactgtaccacattcctgctcagaaactgctcacttccttaaattgtcttttttcccccagcgtgaaatgtatccatttataactgcctattgcctgttctattagcatccaaaaatgtggaaggcctcccaaccaccatttctgctgtgtccttaggatgtgcagtaaaaaatatagacctaacagtttatgttatagaatggctttatttactttggtgactgtttatagtttttaaataaaagactgaacattttcttgagtccttcatttctgagtatgcttaagacatcttaaaaatatagagagaattctaaattcagctgaaggcaaggtataacggtcacctacctatttgattatatgttgattgataacatattaaatagagaacaaataagagaggtcctttacatgacaaatttgcatgaaataagcagattaaccaagtatttatttttcatcttgttataatgcagagcaaatgtagagaacagcaaatgattgatgcagttaaagctcaatatgcctttttttactggatactgtacatttggctaaaagcttttattgtttgatgttgtgtttcttgactgtttattcagaatcacagtgtatccaaatcttcagcttgaatttggaggcagattcttagagtgaaaaagcctcagtttccatattaaaaatgttttaaatattttgattgaattagtaccaatgtaaaatctagtttcttcctgaaggaggatccctggcgctgtcctgccatgtctcaaaggaatgtttgagaaacttcatctaatattagttataaggttgtggaatttatgcttggcccaccttccaagactggcactgcccaacagacaccgctgaaatcatgtgggtatccctaggatggccttcagagccctcaaacttacaagcacctggtagttgacatcatatggggaattttctattcaccgtacttatccaaaaatctcttttaaaaagtaaatttgtgcaacaacgtttatttgaaagataatgtcttctcaaaatcagaaactgcagtggtaattaaattaatagaaaagagaacaaactgcaggtttagaaaaatggttttcatattcaccattcttccacctcattgaattgcatgctgtagttctagcttttctgctataatatgtaaatatgactgtagccttttaagcttcagtctcagcagagaatttcctaaatgcgtttgacctaatgaaactgatcatggcttcccacttaggtttttcttcttatagctttatagaactatataataatatggacttgctgtgtaatggaattaaagtgcttttgcacaataagttctgcaaaaccctctcattcatgaaaaggtgctccttgctagacagaaacttgctgatttacagtattgttatttttgtctaaagttctgtaaatacatgctttaatgttatctttgagaaatctatgtaaataatatagtctacaacatagagactgtataattctgtgttatatatgtgcctagtgctctgttggcactcaataaattttaagtaacaaaattgataatcatatagcgaaggcatatttttcttccaagctcaagtcaggattgtgactatatattaatgagactcagtaatccaacccacacctgagaactcgtctcattactttatagtcatgtcatgtatgtttttttaaccatgaaatgacaataaaatgatttttaaaatgagaa

SEQ ID NO: 109268 - DNA, 7316 bp, Homo sapiens
  Payload ID: 1463
  Gene Symbol: ARID2
  Gene Name: AT rich interactive domain 2 (ARID, RFX-like)
  ENST ID: ENST00000444670
  CDS Start-End: 17-4354
ggatagatttttaaagatgagaggcatggaaattttgggaaatctttgcaaagcagaagataatggtgttttaatttgtgaatatgtggatcaggattcctacagagagatcatttgtcatctcactttacctgatgtgctgcttgtaatctcaacactcgaggtgctatacatgctcacggaaatgggagatgttgcttgcacaaaaattgcaaaagtagaaaagagcatagctgcggtaaaactcattgaacacccaagttccagtcatcaaatgttatctgaaattaggccacaagctatagagcaagtccaaacccagactcatgtagcatctgccccagcttccagagcagttgtagcgcagcatgttgctccacctccaggaatagtggaaatagatagtgagaagtttgcttgtcagtggctaaatgctcattttgaagtaaatccagattgttctgtttctcgagcagaaatgtattctgaatacctctcgacttgcagtaaattagctcgtggtggaatcctaacatcaactggattttataaatgtcttagaacggtctttccaaatcatacagtgaagagagtggaggattccagtagcaatgggcaggcacatattcatgtggtaggagtaaaacggagggctataccacttcccattcagatgtactatcagcagcaaccagtttctacttctgttgttcgtgttgattctgttcctgatgtatctcctgctccttcacctgcaggaatccctcatggatcacaaaccataggaaaccattttcagaggactcctgttgccaaccaatcttcaaatctgactgcaacacaaatgtcttttcctgtacaaggtgttcatactgtggcacaaactgtttcaagaattccacaaaatccttcacctcatacccaccagcaacaaaatgctccagtgactgtcattcaaagtaaagctccaattccttgtgaagttgttaaggctacagttatccagaattccataccccagacaggagttcctgttagtattgctgttggaggaggacctccacagagttctgttgttcagaatcatagtacagggccacaacctgttacagttgtgaattctcagacattgcttcaccatccatctgtaattccacagcagtctccattacacacagtggtaccaggacagatcccttcaggcactcctgttacagtaattcaacaagctgtcccacagagtcatatgtttggcagagtacagaacataccagcatgtacttctacagtttcacagggtcaacagttaatcaccacatcaccccaacctgtgcaaacttcatctcaacagacatcagctggtagccagtcacaagatactgttatcatagcacccccacagtatgtaacaacttctgcatccaatattgtctcagcaacttcagtacagaattttcaggtagctacaggacaaatggttactattgctggtgtcccaagtccacaagcctcaagggtagggtttcagaacattgcaccaaaacctctcccttctcagcaagtttcatctacagtggtacagcagcctattcaacaaccacagcagccaacccaacaaagcgtagtgattgtaagccagccagctcaacaaggtcaaacttatgcaccagccattcaccaaattgttcttgctaatccagcagctcttccagctggtcagacagttcagctaactggacaacctaacataactccatcttcttcaccatcacctgtcccagctactaataaccaagtccctactgccatgtcgtcgtcctctacccctcaatcacagggaccacctcctactgtcagtcaaatgttatctgtgaaaaggcagcaacagcagcaacattcaccagcacccccaccacagcaggtacaagtacaagttcagcagccccaacaagtacagatgcaagttcaacctcaacagtcgaatgcaggagttggtcagcctgcctctggtgagtcgagtctgattaaacagcttctgcttccgaaacgtggtccttcaacaccaggtggtaagcttattctcccagctccacagattcctccccctaataatgcaagagctcctagccctcaggtggtctatcaggtggccagtaaccaagccgcaggttttggagtgcaggggcaaactccagctcagcagctattggttgggcagcaaaatgttcagttggtcccaagtgcaatgccaccctcagggggagtacaaactgtgcccatttcgaacttacaaatattgccaggtccactgatctcaaatagcccagcaaccattttccaagggacttctggcaaccaggtaaccataacagttgtgccaaatacgagttttgcacctgcaactgtgagtcagggaaatgcaactcagctcattgctccagcaggaattaccatgagcggaacgcagacaggagttggacttccagtacaaacgcttccagccactcaagcatctcctgctggacaatcatcatgtactactgctactcccccattcaaaggtgataaaataatttgccaaaaggaggaggaagcaaaggaagcaacaggtttacatgttcatgaacgtaaaattgaagtcatggagaacccgtcctgccgacgaggagccacaaacaccagcaatggggatacaaaggaaaatgaaatgcatgtgggaagtcttttaaatgggagaaagtacagtgactcaagtctacctccttcaaactcagggaaaattcaaagtgagactaatcagtgctcactaatcagtaatgggccatcattggaattaggtgagaatggagcatctgggaaacagaactcagaacaaatagacatgcaagatatcaaaagtgatttgagaaaaccgctagttaatggaatctgtgattttgataaaggagatggttctcatttaagcaaaaacattccaaatcataaaacttccaatcatgtaggaaatggtgagatatctccaatggaaccacaagggactttagatatcactcagcaagatactgccaaaggtgatcaactagaaagaatttctaatggacctgtattaactttgggtggttcatctgtgagcagtatacaggaggcttcaaatgcggcaacacagcaatttagtggtactgatttgcttaatggacctctagcttcaagtttgaattcagatgtgcctcagcaacgcccaagtgtagttgtctcaccacattctacaacctctgttatacagggacatcaaatcatagcagttcccgactcaggatcaaaagtatcccattctcctgccctatcatctgacgttcggtctacaaatggcacagcagaatgcaaaactgtaaagaggccagcagaggatactgatagggaaacagtcgcaggaattccaaataaagtaggagttagaattgttacaatcagtgaccccaacaatgctggctgcagcgcaacaatggttgctgtgccagcaggagcagatccaagcactgtagctaaagtagcaatagaaagtgctgttcagcaaaagcaacagcatccaccaacatatgtacagaatgtggtcccgcagaacactcctatgccaccttcaccagctgtacaagtgcagggccagcctaacagttctcagccttctccattcagtggatccagtcagcctggagatccaatgagaaaacctggacagaacttcatgtgtctgtggcagtcttgtaaaaagtggtttcagacaccctcacaggttttctaccatgcagcaactgaacatggaggaaaagatgtatatccagggcagtgtctttgggaaggttgtgagccttttcagcgacagcggttttcttttattacccacttgcaggataagcactgttcaaaggatgccctacttgcaggattaaaacaagatgaaccaggacaagcaggaagtcagaagtcttctaccaagcagccaactgtagggggcacaagctcaactcctagagcacaaaaggccattgtgaatcatcccagtgctgcacttatggctctgaggagaggatcaagaaaccttgtctttcgagattttacagatgaaaaagagggaccaataactaaacacatccgactaacagctgccttaatattaaaaaatattggtaaatattcagaatgtggtcgcagattgttaaagagacatgaaaataacttatcagtgctagccattagtaacatggaagcttcctccacccttgccaaatgcctttatgaacttaattttacagttcagagtaaggaacaagaaaaagactcagaaatgctgcagtgaaaaataattccacttacacagtgggggactcaaagtcagccacatttcacatactgttactgaagaaagcaccaagtcttaatggaacaaagaccatagaatgaattattttatctcctcccatgatgctgagaggaagcttcgtattctgatctctgagtgaatccctttgttctctgtttaaaaaaatctaaaaagaaaaaggaaaaaaaaaaaagaactgctgtgggattgtcaaccagcttatctgcaggatgtttcagatctgataaatcctgatggaaactggtatgatcagaattcagtaccatccacattggaatatacatggaatattgtaaaacctacatgagcagatgaaatagaagcattaaatatttttatctatatccaaaaaggagcacatttttatatttacaaaaccgtttaagctggtttgaataatttaaaaaagtttcagcacacctatacccccgatctcagagggggccaccaatatctagctatggatcgtgtgttttgtttagaaatcagtagcttggttttcttacttgagccaatatattttcacttatttattatcataaaaatttaccagtctgaatagatcttgtaaatatttgtgaatagaatgaatacctttcatgccactgcagccactggaaatacattctgtggtgtcctagaagcattattggtaggttctaaagttttctagactttcctgtcaattgtaagtaattgtgatatattctatgcagtggatgaatgttctttaaatttgtgtaaatacttctgcaaaggtactgatgctgtaaagtcaaaacagttttgtggaactgtgatttttttttcttttttctttttttttttctttttttttttgtattatacaccttgtagaactcattttgctggctgaaagagtatggaataatatatctcatgtcattttttagaagaaaaactatttgaaggtattttttggttttccttaacatgtatccactgtaaacgtttgtcgtgtacaagctcagagcttggacagaattttttgtatttgtaaattggtttaaatacatggaattttatacaggttttctcctgtgttatatatgcattatgtgcaggtatgatattttcttcactactttttctatcttaatatagtgtggaattttattgtattattcttccattcttaatactgtaccacattcctgctcagaaactgctcacttccttaaattgtcttttttcccccagcgtgaaatgtatccatttataactgcctattgcctgttctattagcatccaaaaatgtggaaggcctcccaaccaccatttctgctgtgtccttaggatgtgcagtaaaaaatatagacctaacagtttatgttatagaatggctttatttactttggtgactgtttatagtttttaaataaaagactgaacattttcttgagtccttcatttctgagtatgcttaagacatcttaaaaatatagagagaattctaaattcagctgaaggcaaggtataacggtcacctacctatttgattatatgttgattgataacatattaaatagagaacaaataagagaggtcctttacatgacaaatttgcatgaaataagcagattaaccaagtatttatttttcatcttgttataatgcagagcaaatgtagagaacagcaaatgattgatgcagttaaagctcaatatgcctttttttactggatactgtacatttggctaaaagcttttattgtttgatgttgtgtttcttgactgtttattcagaatcacagtgtatccaaatcttcagcttgaatttggaggcagattcttagagtgaaaaagcctcagtttccatattaaaaatgttttaaatattttgattgaattagtaccaatgtaaaatctagtttcttcctgaaggaggatccctggcgctgtcctgccatgtctcaaaggaatgtttgagaaacttcatctaatattagttataaggttgtggaatttatgcttggcccaccttccaagactggcactgcccaacagacaccgctgaaatcatgtgggtatccctaggatggccttcagagccctcaaacttacaagcacctggtagttgacatcatatggggaattttctattcaccgtacttatccaaaaatctcttttaaaaagtaaatttgtgcaacaacgtttatttgaaagataatgtcttctcaaaatcagaaactgcagtggtaattaaattaatagaaaagagaacaaactgcaggtttagaaaaatggttttcatattcaccattcttccacctcattgaattgcatgctgtagttctagcttttctgctataatatgtaaatatgactgtagccttttaagcttcagtctcagcagagaatttcctaaatgcgtttgacctaatgaaactgatcatggcttcccacttaggtttttcttcttatagctttatagaactatataataatatggacttgctgtgtaatggaattaaagtgcttttgcacaataagttctgcaaaaccctctcattcatgaaaaggtgctccttgctagacagaaacttgctgatttacagtattgttatttttgtctaaagttctgtaaatacatgctttaatgttatctttgagaaatctatgtaaataatatagtctacaacatagagactgtataattctgtgttatatatgtgcctagtgctctgttggcactcaataaattttaagtaacaaaattgataatcatatagcgaaggcatatttttcttccaagctcaagtcaggattgtgactatatattaatgagactcagtaatccaacccacacctgagaactcgtctcattactttatagtcatgtcatgtatgtttttttaaccatgaaatgacaataaaatgatttttaaaatgagaa

SEQ ID NO: 109269 - DNA, 5481 bp, Homo sapiens
  Payload ID: 1463
  Gene Symbol: ARID2
  Gene Name: AT rich interactive domain 2 (ARID, RFX-like)
  ENST ID: ENST00000422737
  CDS Start-End: 369-5288
accacagcagagggtcgccttttaaaaaaatccctgcggtgggtgggaaggagctggatcttcacggtctctacaccagagtcactactttaggcggattcgcgaaggtttctgagaagaatcagtggggagaaattgttgaagagttcaactttcccagaagttgttctaacgctgcctttgctttaaaacagtattacttgcgttacctagaaaagtacgagaaagttcatcattttggggaggatgatgatgaggtaccaccaggcaatccaaagccacagcttcctattggtgcaattccatcttcctacaattaccagcaacacagtgtgtcggattatctgcgtcaaagttatgggctgtccatggactttaattcgccaaatgattataataaattggtgctttcactgttatctggactcccaaatgaagtggactttgctattaacgtatgcactctcctatcaaatgaaagcaagcacgtcatgcaacttgaaaaagatcctaaaatcatcactttactacttgctaatgccggggtgtttgacgacactttaggatccttttccactgtatttggagaagaatggaaagagaagactgatagagacttcgttaagttttggaaagacatcgttgatgataatgaagttcgtgacctcatttctgacagaaacaagtctcatgaaggtacatcaggagaatggatttgggagtctttatttcatccacctcgaaagctgggcattaacgatattgaaggacagcgggtacttcagattgcagtgattttgagaaatctttcctttgaggagggcaatgttaagctcttggcagctaatcgtacctgtcttcgtttcctattactttctgcacatagtcattttatttctttaaggcaattaggccttgacacattaggaaatattgcagctgagcttttactggaccctgttgatttcaaaactactcatctgatgtttcatactgttacaaaatgtctaatgtcaagggatagatttttaaagatgagaggcatggaaattttgggaaatctttgcaaagcagaagataatggtgttttaatttgtgaatatgtggatcaggattcctacagagagatcatttgtcatctcactttacctgatgtgctgcttgtaatctcaacactcgaggtgctatacatgctcacggaaatgggagatgttgcttgcacaaaaattgcaaaagtagaaaagagcatagacatgttagtgtgtctggtttctatggatattcagatgtttggccctgatgcactagctgcggtaaaactcattgaacacccaagttccagtcatcaaatgttatctgaaattaggccacaagctatagagcaagtccaaacccagactcatgtagcatctgccccagcttccagagcagttgtagcgcagcatgttgctccacctccaggaatagtggaaatagatagtgagaagtttgcttgtcagtggctaaatgctcattttgaagtaaatccagattgttctgtttctcgagcagaaatgtattctgaatacctctcgacttgcagtaaattagctcgtggtggaatcctaacatcaactggattttataaatgtcttagaacggtctttccaaatcatacagtgaagagagtggaggattccagtagcaatgggcaggcacatattcatgtggtaggagtaaaacggagggctataccacttcccattcagatgtactatcagcagcaaccagtttctacttctgttgttcgtgttgattctgttcctgatgtatctcctgctccttcacctgcaggaatccctcatggatcacaaaccataggaaaccattttcagaggactcctgttgccaaccaatcttcaaatctgactgcaacacaaatgtcttttcctgtacaaggtgttcatactgtggcacaaactgtttcaagaattccacaaaatccttcacctcatacccaccagcaacaaaatgctccagtgactgtcattcaaagtaaagctccaattccttgtgaagttgttaaggctacagttatccagaattccataccccagacaggagttcctgttagtattgctgttggaggaggacctccacagagttctgttgttcagaatcatagtacagggccacaacctgttacagttgtgaattctcagacattgcttcaccatccatctgtaattccacagcagtctccattacacacagtggtaccaggacagatcccttcaggcactcctgttacagtaattcaacaagctgtcccacagagtcatatgtttggcagagtacagaacataccagcatgtacttctacagtttcacagggtcaacagttaatcaccacatcaccccaacctgtgcaaacttcatctcaacagacatcagctggtagccagtcacaagatactgttatcatagcacccccacagtatgtaacaacttctgcatccaatattgtctcagcaacttcagtacagaattttcaggtagctacaggacaaatggttactattgctggtgtcccaagtccacaagcctcaagggtagggtttcagaacattgcaccaaaacctctcccttctcagcaagtttcatctacagtggtacagcagcctattcaacaaccacagcagccaacccaacaaagcgtagtgattgtaagccagccagctcaacaaggtcaaacttatgcaccagccattcaccaaattgttcttgctaatccagcagctcttccagctggtcagacagttcagctaactggacaacctaacataactccatcttcttcaccatcacctgtcccagctactaataaccaagtccctactgccatgtcgtcgtcctctacccctcaatcacagggaccacctcctactgtcagtcaaatgttatctgtgaaaaggcagcaacagcagcaacattcaccagcacccccaccacagcaggtacaagtacaagttcagcagccccaacaagtacagatgcaagttcaacctcaacagtcgaatgcaggagttggtcagcctgcctctggtgagtcgagtctgattaaacagcttctgcttccgaaacgtggtccttcaacaccaggtggtaagcttattctcccagctccacagattcctccccctaataatgcaagagctcctagccctcaggtggtctatcaggtggccagtaaccaagccgcaggttttggagtgcaggggcaaactccagctcagcagctattggttgggcagcaaaatgttcagttggtcccaagtgcaatgccaccctcagggggagtacaaactgtgcccatttcgaacttacaaatattgccaggtccactgatctcaaatagcccagcaaccattttccaagggacttctggcaaccaggtaaccataacagttgtgccaaatacgagttttgcacctgcaactgtgagtcagggaaatgcaactcagctcattgctccagcaggaattaccatgagcggaacgcagacaggagttggacttccagtacaaacgcttccagccactcaagcatctcctgctggacaatcatcatgtactactgctactcccccattcaaaggtgataaaataatttgccaaaaggaggaggaagcaaaggaagcaacaggtttacatgttcatgaacgtaaaattgaagtcatggagaacccgtcctgccgacgaggagccacaaacaccagcaatggggatacaaaggaaaatgaaatgcatgtgggaagtcttttaaatgggagaaagtacagtgactcaagtctacctccttcaaactcagggaaaattcaaagtgagactaatcagtgctcactaatcagtaatgggccatcattggaattaggtgagaatggagcatctgggaaacagaactcagaacaaatagacatgcaagatatcaaaagtgatttgagaaaaccgctagttaatggaatctgtgattttgataaaggagatggttctcatttaagcaaaaacattccaaatcataaaacttccaatcatgtaggaaatggtgagatatctccaatggaaccacaagggactttagatatcactcagcaagatactgccaaaggtgatcaactagaaagaatttctaatggacctgtattaactttgggtggttcatctgtgagcagtatacaggaggcttcaaatgcggcaacacagcaatttagtggtactgatttgcttaatggacctctagcttcaagtttgaattcagatgtgcctcagcaacgcccaagtgtagttgtctcaccacattctacaacctctgttatacagggacatcaaatcatagcagttcccgactcaggatcaaaagtatcccattctcctgccctatcatctgacgttcggtctacaaatggcacagcagaatgcaaaactgtaaagaggccagcagaggatactgatagggaaacagtcgcaggaattccaaataaagtaggagttagaattgttacaatcagtgaccccaacaatgctggctgcagcgcaacaatggttgctgtgccagcaggagcagatccaagcactgtagctaaagtagcaatagaaagtgctgttcagcaaaagcaacagcatccaccaacatatgtacagaatgtggtcccgcagaacactcctatgccaccttcaccagctgtacaagtgcagggccagcctaacagttctcagccttctccattcagtggatccagtcagcctggagatccaatgagaaaacctggacagaacttcatgtgtctgtggcagtcttgtaaaaagtggtttcagacaccctcacaggttttctaccatgcagcaactgaacatggaggaaaagatgtatatccagggcagtgtctttgggaaggttgtgagccttttcagcgacagcggttttcttttattacccacttgcaggataagcactgttcaaaggatgccctacttgcaggattaaaacaagatgaaccaggacaagcaggaagtcagaagtcttctaccaagcagccaactgtagggggcacaagctcaactcctagagcacaaaaggccattgtgaatcatcccagtgctgcacttatggctctgaggagaggatcaagaaaccttgtctttcgagattttacagatgaaaaagagggaccaataactaaacacatccgactaacagctgccttaatattaaaaaatattggtaaatattcagaatgtggtcgcaggtgagtaatatgttttctgtagccaaagtgaatttagtttattttatttttacatataagttaataaaattagataactgtattttcttcattgtttttctcatcaattttgcaaatacatccaaaagtttatgcctaggtcaggccatgatgagctcttaaaagtcaaaaataaatagaagttaaaacaaccaaaa

SEQ ID NO: 109270 - DNA, 523 bp, Homo sapiens
  Payload ID: 1463
  Gene Symbol: ARID2
  Gene Name: AT rich interactive domain 2 (ARID, RFX-like)
  ENST ID: ENST00000477947
  CDS Start-End: 1-193
aggattaaaacaagatgaaccaggacaagcaggaagtcagaagtcttctaccaagcagccaactgtagggggcacaagctcaactcctagagcacaaaaggccattgtgaatcatcccagtgctgcacttatggctctgaggagaggatcaagaaaccttgtctttcgagattttacagtaagcatgccttgaaacccttatctgtaaaagtctgagtcctgtatgatttagatctttattcttttttttcctttctttttaaggatgaaaaagagggaccaataactaaacacatccgactaacagctgccttaatattaaaaaatattggtaaatattcagaatgtggtcgcaggtgagtaatatgttttctgtagccaaagtgaatttagtttattttatttttacatataagttaataaaattagataactgtattttcttcattgtttttctcatcaattttgcaaatacatccaaaagtttatgcctaggtcaggccatgatgagctcttaaaagtc

SEQ ID NO: 109271 - DNA, 5941 bp, Homo sapiens
  Payload ID: 1464
  Gene Symbol: ARID3A
  Gene Name: AT rich interactive domain 3A (BRIGHT-like)
  Uniprot ID: Q99856
  ENST ID: ENST00000263620
  CDS Start-End: 291-2072
acgcggacgcggctggcggctcggtttctgcaaatgcgtgaatgagccggatgccagcctctgtcccctggagcccagcgtgaggaagaggcatgccccatcagccttcagcttgagcccggcggcccccgcccccgccccctgccaccctgcactgccccggctcccccgcggcccccacgctgcagtgcggccgggccccctccccgcaggggccgcccccgccgcccacccctagcgcccgtggtggtggtggtggtggtggtggtggtggcccgggccgcagggccatgaaactacaggccgtgatggagacgctgttgcagcggcagcagcgggcgcgccaggagctggaggcccggcagcagctgccccccgatccccctgctgcaccccccggccgggcccgggctgcccccgacgaggacagagagcccgagagtgcccggatgcagcgggctcagatggccgcactggcagccatgcgggctgcagctgcgggcctgggacacccagccagccccggcggctctgaggatgggcccccaggctcggaggaggaggacgcggcccgggaggggacaccgggctcacccgggcgaggcagagaagggccaggagaggagcactttgaggacatggcctccgacgaggacatgaagcccaaatgggaggaggaggagatggaggaagacctcggggaggatgaggaggaggaggaggaggattacgaggatgaggaggaggaggaggacgaggaggggctgggccccccaggccctgccagcttgggcaccacggcactgttcccccgaaaggcccagccaccccaggccttccgcggcgatggcgttcccagggtgctggggggccaggagcggccggggcctggccctgcccaccccggaggggccgcccacgtagccccgcagctgcagccgcctgaccacggcgactggacttacgaggagcagtttaagcagctctacgaactcgacggggaccccaagaggaaggaattcctggatgacttgttcagcttcatgcagaagcgagggacacctgtgaaccgcatccccatcatggccaaacaggtccttgacctgttcatgctgtacgtgctggtgacggagaagggcggcctcgtggaggtcatcaacaagaagctgtggcgtgagatcaccaagggcctcaacctgcccacgtccatcaccagtgcagccttcaccctgcggacccaatacatgaagtacctgtacccctacgagtgtgagaagcggggcctcagtaaccccaatgagctccaggcagccatagacagcaaccgacgggagggccggcgccagagctttggtggctccctctttgcctactcgccaggcggggcacacggcatgctctcctcacccaagctacccgtgtcctccctgggcctggccgcaagcaccaatggcagctccatcacccccgcccctaagatcaagaaagaggaggactcagccatccccatcacagtccctggccgcctgcctgtgtccctggcgggccaccctgtggtggcagcccaggcagcagctgtgcaagcagcagccgcccaagcagctgtggccgcacaggcagctgccctggaacagctgcgggagaagctggagtctgcagagcctccggagaagaagatggccctggtggccgatgagcagcaacggctgatgcaacgtgcactccagcagaacttcctggccatggcggcccagctgcccatgagcattcggatcaacagccaagcctccgaaagccgccaggactctgctgtgaacctgacgggcaccaacggcagcaacagcatcagcatgtcggtggagatcaacggcatcatgtacacaggagttctgtttgctcagccgccggcccccacgccaacctctgctcccaacaaaggaggcggcggcggcggcggcagcagcagcaacgcaggcggccggggaggaaacaccggaaccagcggcggccaggctgggccagcggggctgtccacaccctccacatctacctcaaataactcgttgccttaaccgcatcactccccacccgccacccaccctggagcccgccggcctgggcagggggtccaggtgggccacacaggggccaggatggcggaagatacgggtggggagggaagatatccagaaaggagccacagctgacgccaaaaagaaaagaaaaaagatatatatatatatatatatatatacacgtatatatataaagagaatttaataaaacaggggaaaaccaaggaacacttgaatttctcaggttttggacattcagagagatgaattgtgagaacagcaaagaaatccatcagaaaaacagaaagaggcagacgtttcccagggcgttcaggcagccctgatggaccgaaggctctggtgtctggtttggccccacagcagtgtgggccgatcctgtttacctcatacatccctgcactgtgtgttttcatttttgtctgctttagttctcttttattttctattcaccacacactcaccactcccagcttctcgtgtccagtgaaacccctgaaccaagatcactgaatttttgtttttttcttgttgctttgggaaatttttttttctctgtagggtttttaagaggtttcgggggttttgttgtgtaaatattctattttattcttggggggatcaaaccttaggaaaaggatatctatatatctatatagctatatatttgtgttccttcagggaaactggtcttgaaaaagcaagaaaaaaaagcaaaaaaaaaaaaaaaaaaaaaaaaaaaaaactcacctttttatttttcccatgaccaatttgggtccctttgtccatttctgggggtgcgttgggcagctgtgagcccagcacatcggatccctggggctagagccgcggagccaatgaactcaggtgctatgggccgggctggggcagagggtgcatgctggggtcccaccggccaggggcccctgacagtgaattgctgactgtgatattccacgatgcttttgcttgtgccgtgcttgtctgctgggctctcgagtcaggggcctggaaatttttttttttttttttttttgagacggagttttgctcttgtcgcccaggctggagtgagtgcaatggtgcgatcttggctcactgcaacctgcacctcccaggtgcaagcgattctcctgcctcagcctccggagtagctgggattacaggcgcccgccaccacgcccagttaatttttgtatttttagtagagatgggggttttgccatgttggtcaggctgatctcgaactcctgacctcaggtgatctgcccgccttggcctcccaaagtgctgggattacaggcatgagccgccacgctggcccggtctggaaatcttatctaaaaagtagcaagtgctggaaaaagggcctggggggcgggggtggttcttgtcgaagcccccaggctcctgtctcagggatgaatgtggcgtctcattgggattcttctcttgcccgaaagggctgcttttgaggactatcaatactggggagtgggggtgaagccggacctcactcagggtgaggatttcagggccccggcatcctgaacaccccccacaccccaacattctcctcgctctgtcccttcctcttctcccaaccccttttgtgctggggctgcgagctccccgagttctgcggtgactaaatcgaggccgagaagggaggctgccccccaccaccctgtgggtcagtacccctccccctggcttggagaaagtggggtcaccgcagctgagctggggggttattttggctggagctgctggagcagaaaggctgggtctgaaatgcccagcagggtctggggacttcgttggacccgcgtggtgttgggcggggctgtcgtgtcctacacgggagctctgggctttcatttctcttggggtgcagtggggattaactcagctattcccagggtaagcctgggtctctaattgggccctgggagccctgttaggccaccggcatgggggcttggtgaggaaggggactccccagctccccccactcccaaccacctccccattgccttggagacccctggggagggggctggggggcttctgagcccctgagtctaggttcactttcccgtcgggctgtgggaggggactgtcactttcctgtgtctttggggaggggacccccacttccttctcggatctcagggccgtggacacacaccccctttccaggagggggtggtgggcgtctaggttttccttgtcccttcctggggccagcaccgtagcagcacaatcaccccgggaagggggtgtctgtttgcctccagacacaatcgggccccactcgcagaaccacctggactctgtccgtgtctgtcccccggcctccagggctcctctcccgggacccccgtcccacgcctgggccccgcgccgggggaagcgcctgctgcctatctctgtctacctcaggtctgacttttgatgccaaaatctgagcccctggggtgcctctcccccgcctcccgtgcaccagggtctgcagcagccactggggcctggctgcctgctgcatctggcggccctggacccctggggcccccgtgcacctgcccacctcggagcctggggaggggccgtgcagggtcgagggctgggtcgtctccctcgggctgcgtgtgtgtgtcgggaatcctgcgtgtcgtgtctgtgggcgatccggcctcccggcggtgggtggacctggattctaactcagaggacttgagcctgctgttaactccgatgattgtagggacaggcggggtgggtggggggtgggcgcgaggctgggtcccggcccaggagaaggaagtcgctgaaggcagtggccatgctggccgtggaaatgggaggcggttgcagagggtctatggggcccggtcctggatactcggcaggaagccgtgtctgcagaggctcctccctgcctcaggtggccccgttcaaccccagccgtgcccatctcctgccaccgcctgtcggtgggggtttaaattcggtgtggctttctggggtgcagctcagcacccccccttatgcagactgggagggggtcgggcagtcccctcagccacgaggaccctggatgggttctagttcacttgggaccgtggggcctggctgcgtactgagtgggtgccccacagtcaaggccaacgggggctccccctgctctgagatgttgggagaaaggcggcttctggaaccttccgtgggacccgtaagtggctgtccagaaaggcgggagggtgggcacggggcacggggggcagctggggtcgttgttaagggtcacgcatctgtacagttgaatttcctttctcttatcatgttttacccaccttgtcccttttttccccaattgtgcttttgcatttttttccttggcaaatgtaaactcagcctttcattcatgacgtgtgaaatttcagtttctctggagtttgtcagacggcgtgggaaccacgcctgaaactcaggtaataggaggaaaaaaaaaaaaacttaaaaaaatttttaaaaaacataaaactactctctacctctggctgggcccagcctgtctcgccctggccgcggcagggtggcctgtaacaatttcagttttcgcagaacattcaggtattaaaaggaaaaaaaaaaaaaaagacaaaaagaccaaaaaaaaaaaaaagtgtgattttgaaatttaaaagaacactgaaagtttacattttatagtaacattattatgcagattgtatttaaacttcagaaatatttaagacgattgtaaccctgtaaagctgatgagatattaaaacgagacaaaacacttctgacttttaaca

SEQ ID NO: 109272 - DNA, 549 bp, Homo sapiens
  Payload ID: 1464
  Gene Symbol: ARID3A
  Gene Name: AT rich interactive domain 3A (BRIGHT-like)
  ENST ID: ENST00000457152
  CDS Start-End: 1-289
gttcccccgaaaggcccagccaccccaggccttccgcggcgatggcgttcccagggtgctggggggccaggagcggccggggcctggccctgcccaccccggaggggccgcccacgtagccccgcagctgcagccgcctgaccacggcgactggacttacgaggagcagtttaagcagctctacgaactcgacggggaccccaagaggaaggaattcctggatgacttgttcagcttcatgcagaagcgagtacaaaaattgaccaggcgtggtggcaggcgcctgtaatcccagctacttgggaggctgaggcaggagaattgcttgaatccaggaggcagaggttgcagtgagccgagattgcagcactgcactctagcctgggtgacagagggagcccccgtctcaaacaaacaaaaagcaggcatgggacacctgtgaaccgcatccccatcatggccaaacaggtccttgacctgttcatgctgtacgtgctggtgacggagaagggcggcctcgtggaggtcatcaacaagaagctgtggcgt

SEQ ID NO: 109273 - DNA, 1016 bp, Homo sapiens
  Payload ID: 1464
  Gene Symbol: ARID3A
  Gene Name: AT rich interactive domain 3A (BRIGHT-like)
  ENST ID: ENST00000587532
  CDS Start-End: 1-1016
gaggacgaggaggggctgggccccccaggccctgccagcttgggcaccacggcactgttcccccgaaaggcccagccaccccaggccttccgcggcgatggcgttcccagggtgctggggggccaggagcggccggggcctggccctgcccaccccggaggggccgcccacgtagccccgcagctgcagccgcctgaccacggcgactggacttacgaggagcagtttaagcagctctacgaactcgacggggaccccaagaggaaggaattcctggatgacttgttcagcttcatgcagaagcgagggacacctgtgaaccgcatccccatcatggccaaacaggtccttgacctgttcatgctgtacgtgctggtgacggagaagggcggcctcgtggaggtcatcaacaagaagctgtggcgtgagatcaccaagggcctcaacctgcccacgtccatcaccagtgcagccttcaccctgcggacccaatacatgaagtacctgtacccctacgagtgtgagaagcggggcctcagtaaccccaatgagctccaggcagccatagacagcaaccgacgggagggccggcgccagagctttggtggctccctctttgcctactcgccaggcggggcacacggcatgctctcctcacccaagctacccgtgtcctccctgggcctggccgcaagcaccaatggcagctccatcacccccgcccctaagatcaagaaagcctccgaaagccgccaggactctgctgtgaacctgacgggcaccaacggcagcaacagcatcagcatgtcggtggagatcaacggcatcatgtacacaggagttctgtttgctcagccgccggcccccacgccaacctctgctcccaacaaaggaggcggcggcggcggcggcagcagcagcaacgcaggcggccggggaggaaacaccggaaccagcggcggccaggctgggccagcggggctgtccacaccctccacatctacctcaaataactc

SEQ ID NO: 109274 - DNA, 4271 bp, Homo sapiens
  Payload ID: 1465
  Gene Symbol: ARID3B
  Gene Name: AT rich interactive domain 3B (BRIGHT-like)
  Uniprot ID: Q8IVW6
  ENST ID: ENST00000346246
  CDS Start-End: 232-1914
ctggctggcggtccagccccgcggcgccgcttccggtgcgggccccgccccggctgtggcccccggctgcggaggagtccgagacgcagctgccgcgccggggcctgagctgccgcctcctccgccgcccgaaaacccggagtgccccgcacaggtttagacccagtgtgcctggtgggctgtgcccaggttcagagtcatgccactctgtgggtgaagcttgaggcaaaaatggagccacttcagcagcagcagcagcagcagcagcaacaacagaagcagccacacctggctcctctgcagatggatgccagagagaagcagggccagcagatgagagaagcccagttcttgtatgcccaaaagctggtcacacagccgactctcctttccgccacagctgggagaccttctggcagcactcccttaggtcccttagccagagttccacccaccgcagcagtggcccaagtgtttgaacggggcaacatgaactcagagcctgaggaagaggacggaggtttggaagatgaggatggggatgatgaagttgcagaggtggctgagaaagaaacccaggctgcttcaaaatattttcatgtgcagaaagtagctcgccaagatcccagagtggcacccatgtccaatctacttccagcaccagggctcccaccacatggacaacaagctaaagaagaccataccaaagatgcttccaaggcctcaccttctgtctccacagcaggacagccgaactggaatctggatgagcagctcaagcagaatggtggtttggcctggagtgatgatgcagatggaggccggggaagagagatctctcgagattttgccaagctgtatgaactggacggtgatcctgaaaggaaagagttcctggatgacctcttcgtctttatgcagaagagggggacccccatcaaccgaatccccatcatggccaaacagatcctggacctgtacatgctgtataagctggtgaccgagaagggaggcctggtggagatcatcaacaagaagatctggagggagatcaccaaaggcctaaacctgcccacatccatcaccagcgccgccttcaccctcaggacgcagtacatgaagtatctgtatgcctatgagtgtgagaagaaagccttgagttccccagccgagctccaggcagcaattgatggcaaccgcagggagggccggcggcccagctacagctcctccctctttggctactcacctgctgcggctactgctgctgccgctgccggggcccctgcccttctctccccacccaagatccgctttcccatccttgggcttggctccagcagtggtaccaataccagtagccctcggatatccccagcaaccactctcaggaaaggtgatggagccccagtgacaacagtgcctgtgccaaatcgtctggctgtgcccgtgaccttggcaagccagcaggctggtactcggaccgccgcactggagcagctgcgggagcggctggagtcaggggagcctgctgagaagaaggcatcgaggctgtctgaggaggagcagcgcctggtgcagcaggccttccagcgcaactttttcagcatggcacggcagctccccatgaagatcaggatcaacggcagggaagacagagcagaggcctcggctgcagcactgaacctgaccacgagtagcattgggagcattaacatgtctgtggacatcgatggcaccacctatgcaggtgtgctgtttgcccagaagcctgtggtccacctcatcacggggtctgctccccagagcctcggcagcagcgccagcagcagcagcagctctcactgttcaccaagtcctacctcatcccggggcacccccagcgcagagccctccaccagctggtccctctgatgggcaggacccagcttcccacttgccactctcctgtcgagagtgaaggaagttgatgcacagaatttacctcatctcacagagcccacgtcgacgagcaccatttggccagacattgagagtttggacgtgtccgtctgtccaggctccattcaggtcctgctgtactctgggggcagggagaggctagaggggcaggacagacagcgttgtccaatcagggattgtcctggagaactgggtgggggtctgtgggtgtccagcttcctccagggttccccagccacctcccagctcagggcacagtgtatcgacaatctgtcagccgacgcagggctggaggccctccatttccctccccttttaatttatttccctgaccctgccttctgccatgaccccagggccactagtctcttcccctgtttttaagtcccatgtggggctgccaggagccaagagcatgccttcatgcccttctctgcagagcatgggatggggcccttccagcccactttgcctactgttaggttcctggggtacgggtccctcaaacacaagtcttgaatcagtcctcagggccccagatcccccttctaatagtctgaaggaagaggctgtgagggcagttcagggccagggcccacagggcatctgctgatgggaaggcagagcctcggggctgcccagccctggcacctgcttcacacggaccattctctgaccgcccccgccaaacctcatgctccccacttgcccttattggcctgctttcccaaaaacagcccactcatcctttccccagccctcttcagccctccccagtcctccccagccttcttcagccttcttcagctcagccctcttctatttcttatggggccatcttggcctcaccatccccacacgtgccgatgtcaggttcattgaaatacctcagatttgtaattgttgatgtttgagtcttcaggaagtatttgcatctctgaaatcttttttatatgtgttttgctgacttttgttttttttttattttaaaatttttatcgtagcaccaaagaaatgaaaacagatcacccccaaagccaagcaagtgattgggtaacccggcccctctggcccttccctcaagcccagtgaggaggtgggtggaggcatgcaggggagacgactcagggatcgcgggggcggggaggtggagtggagaggcccgctctcacaccgggtcgggccctgaaactgtaccagttctgaagaccgttttctgccacacccccacccccagctgaccagggaggcagaggacacctccccatcactcagcattcccagctcagggcacaggcaggctggggtcctcgctggccttgccagaggttgagccgccccagggtatgaggagatgaataactccacagctcctcctggaccctgcgcgggagcaggcagctcctgtgctgtaaagaaaattgattcgcttgcggctcacctcagtcgaggaagccctggaatgttcagcagaacaccaccactgtgacatggggctgtggcagtgggagacaccgcgcgtggcgtgggtgtgtgtggcagcgtggctcgcattcagtcctgtgtaggagaggaaagggaatcaaaagcttgagcacaaacagatacctcagcccggtaagctgcagctctgctcaactgcgtcttctctcagccctccacacacactcacccccactcccacacacatacacacacacacacacataccccatctcccgagggctgacctcctctggcctcagcctgcagggtgtgggcagagaagggcatctgggacgtggtgccagtgaggagcccagttggctggcactgggcccatttgaaggtgtctcagacatttggccagtatgtctttctcaggggtttggtcacaaaggatggactcttcccacccagaggatgcagggaaagcacactgtgtctttccggtcattggatcctctccctttccccaggcagctcgcctggccacaccgttggagtgaaccctcactgccctcaaggacaacagcagggtgtcacccagagcccgatgaggggtgccagcaggtgcccccacgagtggggccttggcccaagcagagcttcccctgaaggtgccatcagccagggcagctctgtcccctcctgctctccatcttatatgtattctaaccaggaaaaatgtgatagcacatgggtagcctaggcagtgagtaaatacctcagatgtcctcctgcagcaagtgtctatatgttgtggttattttctatcttacatgttctcgaatgtttatatttcaataaacctctacctcttcacacaa

SEQ ID NO: 109275 - DNA, 581 bp, Homo sapiens
  Payload ID: 1465
  Gene Symbol: ARID3B
  Gene Name: AT rich interactive domain 3B (BRIGHT-like)
  ENST ID: ENST00000566147
  CDS Start-End: 166-581
caatctacttccagcaccagggctcccaccacatggacaacaagctaaagaagaccataccaaagatgcttccaaggcctcaccttctgtctccacagcaggacagccgaactggaatctggatgagcagctcaagcagggacccccatcaaccgaatccccatcatggccaaacagatcctggacctgtacatgctgtataagctggtgaccgagaagggaggcctggtggagatcatcaacaagaagatctggagggagatcaccaaaggcctaaacctgcccacatccatcaccagcgccgccttcaccctcaggacgcagtacatgaagtatctgtatgcctatgagtgtgagaagaaagccttgagttccccagccgagctccaggcagcaattgatggcaaccgcagggagggccggcggcccagctacagctcctccctctttggctactcacctgctgcggctactgctgctgccgctgccggggcccctgcccttctctccccacccaagatccgctttcccatccttgggcttggctccagcagtggtaccaataccagtagccctcggat

SEQ ID NO: 109276 - DNA, 4243 bp, Homo sapiens
  Payload ID: 1465
  Gene Symbol: ARID3B
  Gene Name: AT rich interactive domain 3B (BRIGHT-like)
  Uniprot ID: Q8IVW6
  ENST ID: ENST00000622429
  CDS Start-End: 203-1888
cttccggtgcgggccccgccccggctgtggcccccggctgcggaggagtccgagacgcagctgccgcgccggggcctgagctgccgcctcctccgccgcccgaaaacccggagtgccccgcacaggtttagacccagtgtgcctggtgggctgtgcccaggttcagagtcatgccactctgtgggtgaagcttgaggcaaaaatggagccacttcagcagcagcagcagcagcagcagcaacaacagaagcagccacacctggctcctctgcagatggatgccagagagaagcagggccagcagatgagagaagcccagttcttgtatgcccaaaagctggtcacacagccgactctcctttccgccacagctgggagaccttctggcagcactcccttaggtcccttagccagagttccacccaccgcagcagtggcccaagtgtttgaacggggcaacatgaactcagagcctgaggaagaggacggaggtttggaagatgaggatggggatgatgaagttgcagaggtggctgagaaagaaacccaggctgcttcaaaatattttcatgtgcagaaagtagctcgccaagatcccagagtggcacccatgtccaatctacttccagcaccagggctcccaccacatggacaacaagctaaagaagaccataccaaagatgcttccaaggcctcaccttctgtctccacagcaggacagccgaactggaatctggatgagcagctcaagcagaatggtggtttggcctggagtgatgatgcagatggaggccggggaagagagatctctcgagattttgccaagctgtatgaactggacggtgatcctgaaaggaaagagttcctggatgacctcttcgtctttatgcagaagagggggacccccatcaaccgaatccccatcatggccaaacagatcctggacctgtacatgctgtataagctggtgaccgagaagggaggcctggtggagatcatcaacaagaagatctggagggagatcaccaaaggcctaaacctgcccacatccatcaccagcgccgccttcaccctcaggacgcagtacatgaagtatctgtatgcctatgagtgtgagaagaaagccttgagttccccagccgagctccaggcagcaattgatggcaaccgcagggagggccggcggcccagctacagctcctccctctttggctactcacctgctgcggctactgctgctgccgctgccggggcccctgcccttctctccccacccaagatccgctttcccatccttgggcttggctccagcagtggtaccaataccagtagccctcggatatccccagcaaccactctcaggaaaggtgatggagccccagtgacaacagtgcctgtgccaaatcgtctggctgtgcccgtgaccttggcaagccagcaggctggtactcggaccgccgcactggagcagctgcgggagcggctggagtcaggggagcctgctgagaagaaggcatcgaggctgtctgaggaggagcagcgcctggtgcagcaggccttccagcgcaactttttcagcatggcacggcagctccccatgaagatcaggatcaacggcagggcagaagacagagcagaggcctcggctgcagcactgaacctgaccacgagtagcattgggagcattaacatgtctgtggacatcgatggcaccacctatgcaggtgtgctgtttgcccagaagcctgtggtccacctcatcacggggtctgctccccagagcctcggcagcagcgccagcagcagcagcagctctcactgttcaccaagtcctacctcatcccggggcacccccagcgcagagccctccaccagctggtccctctgatgggcaggacccagcttcccacttgccactctcctgtcgagagtgaaggaagttgatgcacagaatttacctcatctcacagagcccacgtcgacgagcaccatttggccagacattgagagtttggacgtgtccgtctgtccaggctccattcaggtcctgctgtactctgggggcagggagaggctagaggggcaggacagacagcgttgtccaatcagggattgtcctggagaactgggtgggggtctgtgggtgtccagcttcctccagggttccccagccacctcccagctcagggcacagtgtatcgacaatctgtcagccgacgcagggctggaggccctccatttccctccccttttaatttatttccctgaccctgccttctgccatgaccccagggccactagtctcttcccctgtttttaagtcccatgtggggctgccaggagccaagagcatgccttcatgcccttctctgcagagcatgggatggggcccttccagcccactttgcctactgttaggttcctggggtacgggtccctcaaacacaagtcttgaatcagtcctcagggccccagatcccccttctaatagtctgaaggaagaggctgtgagggcagttcagggccagggcccacagggcatctgctgatgggaaggcagagcctcggggctgcccagccctggcacctgcttcacacggaccattctctgaccgcccccgccaaacctcatgctccccacttgcccttattggcctgctttcccaaaaacagcccactcatcctttccccagccctcttcagccctccccagtcctccccagccttcttcagccttcttcagctcagccctcttctatttcttatggggccatcttggcctcaccatccccacacgtgccgatgtcaggttcattgaaatacctcagatttgtaattgttgatgtttgagtcttcaggaagtatttgcatctctgaaatcttttttatatgtgttttgctgacttttgttttttttttattttaaaatttttatcgtagcaccaaagaaatgaaaacagatcacccccaaagccaagcaagtgattgggtaacccggcccctctggcccttccctcaagcccagtgaggaggtgggtggaggcatgcaggggagacgactcagggatcgcgggggcggggaggtggagtggagaggcccgctctcacaccgggtcgggccctgaaactgtaccagttctgaagaccgttttctgccacacccccacccccagctgaccagggaggcagaggacacctccccatcactcagcattcccagctcagggcacaggcaggctggggtcctcgctggccttgccagaggttgagccgccccagggtatgaggagatgaataactccacagctcctcctggaccctgcgcgggagcaggcagctcctgtgctgtaaagaaaattgattcgcttgcggctcacctcagtcgaggaagccctggaatgttcagcagaacaccaccactgtgacatggggctgtggcagtgggagacaccgcgcgtggcgtgggtgtgtgtggcagcgtggctcgcattcagtcctgtgtaggagaggaaagggaatcaaaagcttgagcacaaacagatacctcagcccggtaagctgcagctctgctcaactgcgtcttctctcagccctccacacacactcacccccactcccacacacatacacacacacacacacataccccatctcccgagggctgacctcctctggcctcagcctgcagggtgtgggcagagaagggcatctgggacgtggtgccagtgaggagcccagttggctggcactgggcccatttgaaggtgtctcagacatttggccagtatgtctttctcaggggtttggtcacaaaggatggactcttcccacccagaggatgcagggaaagcacactgtgtctttccggtcattggatcctctccctttccccaggcagctcgcctggccacaccgttggagtgaaccctcactgccctcaaggacaacagcagggtgtcacccagagcccgatgaggggtgccagcaggtgcccccacgagtggggccttggcccaagcagagcttcccctgaaggtgccatcagccagggcagctctgtcccctcctgctctccatcttatatgtattctaaccaggaaaaatgtgatagcacatgggtagcctaggcagtgagtaaatacctcagatgtcctcctgcagcaagtgtctatatgttgtggttattttctatcttacatgttctcgaatgtttatatttcaataaacctctacctcttcacac

SEQ ID NO: 109277 - DNA, 1411 bp, Homo sapiens
  Payload ID: 1466
  Gene Symbol: ARID3C
  Gene Name: AT rich interactive domain 3C (BRIGHT-like)
  Uniprot ID: A6NKF2
  ENST ID: ENST00000378909
  CDS Start-End: 94-1332
ccataattccctcccccacaggcggccctttcctcggggtcccgcctggtaccagggaccccctcagctgggggactgcgcctggaagctgtcatggaggccctgcagaagcagcaggcagctcggctggcccagggggtggggccattggcccctgcatgcccgctgctgccaccgcagcctcccctgcctgaccaccggaccctacaggcccctgagggggccttggggaatgttggggctgaggaagaggaagatgctgaagaagatgaggagaagcgggaggaagccggggcagaggaggaggcagctgaggagagccgtccaggggcccagggccccagctcgccttctagccagccccctggactccatccccacgagtggacctacgaggaacaattcaagcagctgtatgagctcgatgcagaccccaagaggaaggaatttctggatgacctgtttagcttcatgcaaaagagggggacgccagtgaaccgcgtgcccatcatggcgaagcaggtgctcgacctgtacgctctgtttcgcctggtgaccgccaagggcggcctggtggaagtcatcaaccgcaaagtgtggcgggaagtcacgcgcggcctcagcctacccaccaccatcacctcggccgccttcactctacgcacccagtacatgaagtacctgtacccgtacgagtgcgagactcgagcgctcagctccccaggggagctccaggccgccatagacagcaatcggcgcgagggccgtcgccaggcttacaccgctactccgctcttcggcttggcagggccgccccctcggggcgctcaggacccagccttgggtcccggccccgcccctccggcgacccagtccagccctggcccagcccagggttccacctccggcctgccagcgcatgcatgcgctcagctgagtccaagccctattaagaaagaggagagtggaattccaaacccttgtctggcactgcctgtgggcctggcactgggacctacacgggagaaattggcaccagaggagcccccagagaagagagctgtgctgatggggcctatggacccacctcgaccttgcatgccccccagtttcctgccccgtggcaaggttcccctgagggaagagcggctggatgggcctcttaatctggcaggcagtggcatcagcagtatcaacatggccctagagatcaacggggtggtctacactggtgtcctctttgcccgccgccagcctgtgccagcttcccagggtccaaccaaccctgcacccccaccctccacagggcccccttccagcatcttgccctgagaggtcctacttgaaactaagagtcccagccccattgctgaggggggaggagaccccctgctttgattctttctggctg

SEQ ID NO: 109278 - DNA, 5562 bp, Homo sapiens
  Payload ID: 1467
  Gene Symbol: ARID4A
  Gene Name: AT rich interactive domain 4A (RBP1-like)
  Uniprot ID: P29374
  ENST ID: ENST00000348476
  CDS Start-End: 255-3821
caataggagttcgtgtagaagcgagtctgctcaacagcttgttatttggtggattgtggcagtaaatcggggcgagtggggaacccggcgcaggaactgcagccgcggctgggagtggtgctgcccggacgggggcccacggaggtcagaggggaggaggactctggagctgacagcgcgcacttcacccgcagttgttctagcgactgcgaagatagctcgctgagctggaaccccacagatcaccaacaaaaatgaaggcggcagatgagcctgcctacctgacagtgggaaccgatgtcagtgccaagtaccgaggtgccttctgtgaggcaaagattaagactgtgaaaaggctggtgaaagttaaggtactcctgaaacaggataataccacacaattggtacaagatgaccaagtaaagggtcctttaagagttggagctattgttgaaacaaggacatctgatggatcttttcaggaagctattatcagcaagttgacagatgctagttggtataccgtggtgtttgatgatggtgatgagcgaacattgagacgtacctcactttgtctgaaaggagagagacattttgcagagagtgagacacttgaccagcttccattaacaaatccagagcattttggaactccagtaattgcaaagaagacgaacagaggaaggagatcttctcttcctgttactgaagatgaaaaggaagaagaaagcagtgaagaggaagatgaagacaagcgccgtctcaatgatgaattactaggaaaagttgtaagtgtggtgtctgcaacggagaggactgaatggtatcctgctttggtaatatctcccagctgtaatgatgacatcacagtgaaaaaggatcagtgtttagttcgatcatttattgattctaaattttactctatagcaagaaaggacattaaggaagtagacattctcaatctaccggaatctgagctctccactaaaccagggcttcagaaagcaagcatcttcttaaaaactagagttgttcctgataattggaaaatggatataagtgaaatccttgagtcatccagtagtgatgatgaagatggcccagctgaagaaaatgatgaagagaaggaaaaggaggccaaaaagacagaagaagaggtgcctgaggaagaacttgatcctgaagagagggacaacttcctccagcagctttataagtttatggaagacagaggtactccaatcaacaaaccacctgttttgggctataaagatctcaatctcttcaaactcttcagactggtttatcatcagggtggatgtgacaatattgatagtggtgctgtatggaagcaaatttatatggaccttggcattcctattttgaattcagctgcttcctacaatgtaaaaactgcttatagaaagtatctctatggttttgaggagtactgccgttcggcaaatattcagttcagaactgttcatcaccatgaaccaaaagtaaaagaggaaaaaaaagacttagaagaatcaatggaagaggctctcaaattagatcaagaaatgcctttaacagaagtgaagagtgaacctgaggaaaatatcgattcaaacagtgaaagtgaaagagaagagatagaattaaaatctccgaggggacgaaggagaattgctcgagatgtaaattctattaaaaaggaaattgaagaagagaaaacagaagacaaattaaaagataatgatacagaaaataaggatgtagatgatgactatgaaactgcagagaaaaaagaaaatgagctactactggggagaaaaaatacaccaaagcaaaaagagaagaaaattaaaaaacaggaggattctgacaaagactcagatgaagaggaagagaaaagccaagagagggaagaaactgaaagcaaatgtgactctgaaggagaggaagatgaggaagacatggaaccctgcctaacaggaaccaaagtgaaagtaaaatatggacgagggaagactcagaaaatttatgaagccagtattaaaagcactgaaattgatgacggagaagttttatatttggtacattactatggatggaatgtcaggtatgatgagtgggtgaaggctgacaggataatctggcctttggacaaaggtggaccaaagaaaaaacagaagaaaaaagctaaaaataaagaagatagtgaaaaggacgaaaagagagatgaggagaggcagaagtcaaaacggggacgacctcctttaaaatcaaccctctcatcaaacatgccgtatggcttatctaagacagcaaacagtgaaggaaaatcagactcttgttcatctgatagtgaaacagaagatgctttagaaaagaatttaataaatgaagaactttctcttaaagatgaactagaaaaaaatgaaaatttgaatgatgataagctagatgaagaaaatccaaagatttctgcacatatattaaaagaaaatgataggactcaaatgcagcctttagaaaccctgaagttagaagttggagagaatgaacaaatagtacagatttttgggaacaaaatggaaaaaacagaagaagttaagaaagaagccgaaaaatctccaaaaggaaagggaagacgaagcaagacaaaagatctttctttagaaattataaagatttcatcatttggccagaatgaagcaggaagtgaacctcatatagaagctcatagtcttgaattgtcttcattagacaataaaaacttttcttctgctacagaagatgaaattgaccaatgtgtgaaagaaaagaagttgaaacggaaaatactaggacaatcatcgccagagaaaaaaataagaattgagaatggaatggaaatgacaaatactgtatctcaagaaaggaccagtgattgtattggatctgagggaatgaaaaacttaaattttgaacagcactttgaaagagaaaatgaaggaatgccatcattgatagcagagtcaaaccaatgcatccaacaactgactagtgaaagatttgatagtccagctgaagaaactgtaaatattccactaaaagaagatgaggatgcaatgcctctgatcgggcctgaaaccttggtttgccatgaagtagatttggatgatttggatgaaaaggataagaccagcattgaggatgtagcagttgaaagctctgagtctaactctcttgtttctattccacctgccctacctcctgtagtccaacataacttttcagtagcttcaccacttactcttagtcaagatgagtctcgaagcgtaaaaagtgagagtgatataacgattgaagttgatagtattgctgaagaatctcaagaaggtctctgtgagagggaatcggcaaatggatttgaaactaatgttgcctctggtacctgtagtataattgtacaagagagagagagcagagagaagggtcagaagaggccaagtgatggaaatagtggattaatggcaaaaaagcaaaagcgtaccccaaagcgaacaagtgctgcagccaaaaatgaaaagaatggaacagatgaattagataatatgaacagtacagagagaatctcatttctccaagaaaaactacaggaaatcagaaaatattatatgtctttgaagtctgaagttgcaaccatagacaggaggagaaaaagattaaaaaagaaagacagggaagtgtctcatgcgggagcctccatgtcatctgcttcatcagacactggaatgagtccctcatcatcatctcccccacaaaatgtacttgctgtagaatgcaggtgataaacattttctctaccttcccagcagtttgctgccatggacataaatccccaaaccctgaattacaaccacagaaagcactcaactggtttgacattgctaagtatatcctgtatacttttccaggctggattgtatctattcccctctctcttcttttttcttgttgcaaaaaataagctgattaataagtgaaggttaagcagcctgccatatttgtcataatttttcctctttacttttgtttttcgtttgttgtgatatagaacaaagggcacttagcaaatttgaatttgtataataaagctttcaggtgttacagaaatcgtagacaagcaagtgcacatgataaacatcaaaatattacccagctgaatagttactgctgcactttcactaagatgtatttgaacacttggtgagtagggggtttatgttgtgttttttttcattatcgttttttttatttttgtggaagcacttgctatttagaactgccaaagtatatgttcagcagtgtgcccaggattgaaggtgtaaatgggacaaaataaattgtgaaaggaagtgtagttgactgaaaactacagttgtaataagtcttccactttttataggatttttgagcacaaaattatgcaaatattttaatgtttattaatgtttacagtggaattgtgaataagttttcagtggactatcttatcccttgacaaaaatattttgtcttttttctatgtaatttcagagtttttattttgttacaaaaagacaaaaatgaaatatataacaacaatgaagttatttaacaagatttctaaagctgaaatttttgtgtaaaataaggtattatcttgcaacttgttaaatatatttattcagacattggatgttgtatttttatgtattttttaaaatattaataaaatttaaaaaaagaaaattctaggttaattcactctttggatgacaatagctctcagctgtcctttttacaggaggttgcatcctgcagccttgcctgtgttaaagggagtctgtctcagtccatcaaacagtatagaactataaatgggcatctggatcattaaagtatgtccttgtttagaaactttggcagtcctagtatttaaactgttttgaggatcaaatttttggttgcccttaagatactttgtcacagtttttatgtttgctatactgccgaatgaatttatatctcccaaagttgagatgcaacaactaagtaaagcaactatgtatgctttgtctgtgaattgttccacagactgatagattttgtaaataattcttccaaaatcatgtatttaaagcagttttgcatatacattatgtaaaaaggtgattttataaaagcagtttttaaattcatgtttgtacattgaaaggggttttttttttaaacctccttttctgtgtttaatatgctgtagaataataacctagatgctctagactgtatatcaggatctgatttacaagaaaaagtcagagctaaacactagtgatggcatagcattactgaaatcattgtttcttaatttcattttactacattgtgaacttgtgattcagattccattttctcagagaattaaaaacaaaaaaagtactcttgtaaaatgcacttttctgtcttttctttgcaaagcagaagtatctcaatgtaaaataaaaatggagctcagtgggcagtattaataaaggccatgttttaaac

SEQ ID NO: 109279 - DNA, 5891 bp, Homo sapiens
  Payload ID: 1467
  Gene Symbol: ARID4A
  Gene Name: AT rich interactive domain 4A (RBP1-like)
  Uniprot ID: P29374
  ENST ID: ENST00000355431
  CDS Start-End: 374-4147
taagtggaagatgtcctacctgctgtttttctcaccaatccatgaagtttcacagctacatccaatgaggacggcaggtagcgaggtcctatccgaagctcttcggcgtcatgagcagccaataggagttcgtgtagaagcgagtctgctcaacagcttgttatttggtggattgtggcagtaaatcggggcgagtggggaacccggcgcaggaactgcagccgcggctgggagtggtgctgcccggacgggggcccacggaggtcagaggggaggaggactctggagctgacagcgcgcacttcacccgcagttgttctagcgactgcgaagatagctcgctgagctggaaccccacagatcaccaacaaaaatgaaggcggcagatgagcctgcctacctgacagtgggaaccgatgtcagtgccaagtaccgaggtgccttctgtgaggcaaagattaagactgtgaaaaggctggtgaaagttaaggtactcctgaaacaggataataccacacaattggtacaagatgaccaagtaaagggtcctttaagagttggagctattgttgaaacaaggacatctgatggatcttttcaggaagctattatcagcaagttgacagatgctagttggtataccgtggtgtttgatgatggtgatgagcgaacattgagacgtacctcactttgtctgaaaggagagagacattttgcagagagtgagacacttgaccagcttccattaacaaatccagagcattttggaactccagtaattgcaaagaagacgaacagaggaaggagatcttctcttcctgttactgaagatgaaaaggaagaagaaagcagtgaagaggaagatgaagacaagcgccgtctcaatgatgaattactaggaaaagttgtaagtgtggtgtctgcaacggagaggactgaatggtatcctgctttggtaatatctcccagctgtaatgatgacatcacagtgaaaaaggatcagtgtttagttcgatcatttattgattctaaattttactctatagcaagaaaggacattaaggaagtagacattctcaatctaccggaatctgagctctccactaaaccagggcttcagaaagcaagcatcttcttaaaaactagagttgttcctgataattggaaaatggatataagtgaaatccttgagtcatccagtagtgatgatgaagatggcccagctgaagaaaatgatgaagagaaggaaaaggaggccaaaaagacagaagaagaggtgcctgaggaagaacttgatcctgaagagagggacaacttcctccagcagctttataagtttatggaagacagaggtactccaatcaacaaaccacctgttttgggctataaagatctcaatctcttcaaactcttcagactggtttatcatcagggtggatgtgacaatattgatagtggtgctgtatggaagcaaatttatatggaccttggcattcctattttgaattcagctgcttcctacaatgtaaaaactgcttatagaaagtatctctatggttttgaggagtactgccgttcggcaaatattcagttcagaactgttcatcaccatgaaccaaaagtaaaagaggaaaaaaaagacttagaagaatcaatggaagaggctctcaaattagatcaagaaatgcctttaacagaagtgaagagtgaacctgaggaaaatatcgattcaaacagtgaaagtgaaagagaagagatagaattaaaatctccgaggggacgaaggagaattgctcgagatgtaaattctattaaaaaggaaattgaagaagagaaaacagaagacaaattaaaagataatgatacagaaaataaggatgtagatgatgactatgaaactgcagagaaaaaagaaaatgagctactactggggagaaaaaatacaccaaagcaaaaagagaagaaaattaaaaaacaggaggattctgacaaagactcagatgaagaggaagagaaaagccaagagagggaagaaactgaaagcaaatgtgactctgaaggagaggaagatgaggaagacatggaaccctgcctaacaggaaccaaagtgaaagtaaaatatggacgagggaagactcagaaaatttatgaagccagtattaaaagcactgaaattgatgacggagaagttttatatttggtacattactatggatggaatgtcaggtatgatgagtgggtgaaggctgacaggataatctggcctttggacaaaggtggaccaaagaaaaaacagaagaaaaaagctaaaaataaagaagatagtgaaaaggacgaaaagagagatgaggagaggcagaagtcaaaacggggacgacctcctttaaaatcaaccctctcatcaaacatgccgtatggcttatctaagacagcaaacagtgaaggaaaatcagactcttgttcatctgatagtgaaacagaagatgctttagaaaagaatttaataaatgaagaactttctcttaaagatgaactagaaaaaaatgaaaatttgaatgatgataagctagatgaagaaaatccaaagatttctgcacatatattaaaagaaaatgataggactcaaatgcagcctttagaaaccctgaagttagaagttggagagaatgaacaaatagtacagatttttgggaacaaaatggaaaaaacagaagaagttaagaaagaagccgaaaaatctccaaaaggaaagggaagacgaagcaagacaaaagatctttctttagaaattataaagatttcatcatttggccagaatgaagcaggaagtgaacctcatatagaagctcatagtcttgaattgtcttcattagacaataaaaacttttcttctgctacagaagatgaaattgaccaatgtgtgaaagaaaagaagttgaaacggaaaatactaggacaatcatcgccagagaaaaaaataagaattgagaatggaatggaaatgacaaatactgtatctcaagaaaggaccagtgattgtattggatctgagggaatgaaaaacttaaattttgaacagcactttgaaagagaaaatgaaggaatgccatcattgatagcagagtcaaaccaatgcatccaacaactgactagtgaaagatttgatagtccagctgaagaaactgtaaatattccactaaaagaagatgaggatgcaatgcctctgatcgggcctgaaaccttggtttgccatgaagtagatttggatgatttggatgaaaaggataagaccagcattgaggatgtagcagttgaaagctctgagtctaactctcttgtttctattccacctgccctacctcctgtagtccaacataacttttcagtagcttcaccacttactcttagtcaagatgagtctcgaagcgtaaaaagtgagagtgatataacgattgaagttgatagtattgctgaagaatctcaagaaggtctctgtgagagggaatcggcaaatggatttgaaactaatgttgcctctggtacctgtagtataattgtacaagagagagagagcagagagaagggtcagaagaggccaagtgatggaaatagtggattaatggcaaaaaagcaaaagcgtaccccaaagcgaacaagtgctgcagccaaaaatgaaaagaatggaacaggacaaagcagtgatagtgaagatcttcctgtcctagacaattcaagtaaatgtaccccagtaaagcatcttaatgtatctaagccacagaaacttgcacgatctcctgcaagaatatccccgcacatcaaagatggagagaaagataaacacagagaaaaacatccgaattcatcccctaggacatataaatggagctttcagctcaatgaattagataatatgaacagtacagagagaatctcatttctccaagaaaaactacaggaaatcagaaaatattatatgtctttgaagtctgaagttgcaaccatagacaggaggagaaaaagattaaaaaagaaagacagggaagtgtctcatgcgggagcctccatgtcatctgcttcatcagacactggaatgagtccctcatcatcatctcccccacaaaatgtacttgctgtagaatgcaggtgataaacattttctctaccttcccagcagtttgctgccatggacataaatccccaaaccctgaattacaaccacagaaagcactcaactggtttgacattgctaagtatatcctgtatacttttccaggctggattgtatctattcccctctctcttcttttttcttgttgcaaaaaataagctgattaataagtgaaggttaagcagcctgccatatttgtcataatttttcctctttacttttgtttttcgtttgttgtgatatagaacaaagggcacttagcaaatttgaatttgtataataaagctttcaggtgttacagaaatcgtagacaagcaagtgcacatgataaacatcaaaatattacccagctgaatagttactgctgcactttcactaagatgtatttgaacacttggtgagtagggggtttatgttgtgttttttttcattatcgttttttttatttttgtggaagcacttgctatttagaactgccaaagtatatgttcagcagtgtgcccaggattgaaggtgtaaatgggacaaaataaattgtgaaaggaagtgtagttgactgaaaactacagttgtaataagtcttccactttttataggatttttgagcacaaaattatgcaaatattttaatgtttattaatgtttacagtggaattgtgaataagttttcagtggactatcttatcccttgacaaaaatattttgtcttttttctatgtaatttcagagtttttattttgttacaaaaagacaaaaatgaaatatataacaacaatgaagttatttaacaagatttctaaagctgaaatttttgtgtaaaataaggtattatcttgcaacttgttaaatatatttattcagacattggatgttgtatttttatgtattttttaaaatattaataaaatttaaaaaaagaaaattctaggttaattcactctttggatgacaatagctctcagctgtcctttttacaggaggttgcatcctgcagccttgcctgtgttaaagggagtctgtctcagtccatcaaacagtatagaactataaatgggcatctggatcattaaagtatgtccttgtttagaaactttggcagtcctagtatttaaactgttttgaggatcaaatttttggttgcccttaagatactttgtcacagtttttatgtttgctatactgccgaatgaatttatatctcccaaagttgagatgcaacaactaagtaaagcaactatgtatgctttgtctgtgaattgttccacagactgatagattttgtaaataattcttccaaaatcatgtatttaaagcagttttgcatatacattatgtaaaaaggtgattttataaaagcagtttttaaattcatgtttgtacattgaaaggggttttttttttaaacctccttttctgtgtttaatatgctgtagaataataacctagatgctctagactgtatatcaggatctgatttacaagaaaaagtcagagctaaacactagtgatggcatagcattactgaaatcattgtttcttaatttcattttactacattgtgaacttgtgattcagattccattttctcagagaattaaaaacaaaaaaagtactcttgtaaaatgcacttttctgtcttttctttgcaaagcagaagtatctcaatgtaaaataaaaatggagctcagtgggcagtattaataaaggccatgttttaaacata

SEQ ID NO: 109280 - DNA, 4051 bp, Homo sapiens
  Payload ID: 1467
  Gene Symbol: ARID4A
  Gene Name: AT rich interactive domain 4A (RBP1-like)
  Uniprot ID: P29374
  ENST ID: ENST00000395168
  CDS Start-End: 203-3814
attgtggcagtaaatcggggcgagtggggaacccggcgcaggaactgcagccgcggctgggagtggtgctgcccggacgggggcccacggaggtcagaggggaggaggactctggagctgacagcgcgcacttcacccgcagttgttctagcgactgcgaagatagctcgctgagctggaaccccacagatcaccaacaaaaatgaaggcggcagatgagcctgcctacctgacagtgggaaccgatgtcagtgccaagtaccgaggtgccttctgtgaggcaaagattaagactgtgaaaaggctggtgaaagttaaggtactcctgaaacaggataataccacacaattggtacaagatgaccaagtaaagggtcctttaagagttggagctattgttgaaacaaggacatctgatggatcttttcaggaagctattatcagcaagttgacagatgctagttggtataccgtggtgtttgatgatggtgatgagcgaacattgagacgtacctcactttgtctgaaaggagagagacattttgcagagagtgagacacttgaccagcttccattaacaaatccagagcattttggaactccagtaattgcaaagaagacgaacagaggaaggagatcttctcttcctgttactgaagatgaaaaggaagaagaaagcagtgaagaggaagatgaagacaagcgccgtctcaatgatgaattactaggaaaagttgtaagtgtggtgtctgcaacggagaggactgaatggtatcctgctttggtaatatctcccagctgtaatgatgacatcacagtgaaaaaggatcagtgtttagttcgatcatttattgattctaaattttactctatagcaagaaaggacattaaggaagtagacattctcaatctaccggaatctgagctctccactaaaccagggcttcagaaagcaagcatcttcttaaaaactagagttgttcctgataattggaaaatggatataagtgaaatccttgagtcatccagtagtgatgatgaagatggcccagctgaagaaaatgatgaagagaaggaaaaggaggccaaaaagacagaagaagaggtgcctgaggaagaacttgatcctgaagagagggacaacttcctccagcagctttataagtttatggaagacagaggtactccaatcaacaaaccacctgttttgggctataaagatctcaatctcttcaaactcttcagactggtttatcatcagggtggatgtgacaatattgatagtggtgctgtatggaagcaaatttatatggaccttggcattcctattttgaattcagctgcttcctacaatgtaaaaactgcttatagaaagtatctctatggttttgaggagtactgccgttcggcaaatattcagttcagaactgttcatcaccatgaaccaaaagtaaaagaggaaaaaaaagacttagaagaatcaatggaagaggctctcaaattagatcaagaaatgcctttaacagaagtgaagagtgaacctgaggaaaatatcgattcaaacagtgaaagtgaaagagaagagatagaattaaaatctccgaggggacgaaggagaattgctcgagatgtaaattctattaaaaaggaaattgaagaagagaaaacagaagacaaattaaaagataatgatacagaaaataaggatgtagatgatgactatgaaactgcagagaaaaaagaaaatgagctactactggggagaaaaaatacaccaaagcaaaaagagaagaaaattaaaaaacaggaggattctgacaaagactcagatgaagaggaagagaaaagccaagagagggaagaaactgaaagcaaatgtgactctgaaggagaggaagatgaggaagacatggaaccctgcctaacaggaaccaaagtgaaagtaaaatatggacgagggaagactcagaaaatttatgaagccagtattaaaagcactgaaattgatgacggagaagttttatatttggtacattactatggatggaatgtcaggtatgatgagtgggtgaaggctgacaggataatctggcctttggacaaaggtggaccaaagaaaaaacagaagaaaaaagctaaaaataaagaagatagtgaaaaggacgaaaagagagatgaggagaggcagaagtcaaaacggggacgacctcctttaaaatcaaccctctcatcaaacatgccgtatggcttatctaagacagcaaacagtgaaggaaaatcagactcttgttcatctgatagtgaaacagaagatgctttagaaaagaatttaataaatgaagaactttctcttaaagatgaactagaaaaaaatgaaaatttgaatgatgataagctagatgaagaaaatccaaagatttctgcacatatattaaaagaaaatgataggactcaaatgcagcctttagaaaccctgaagttagaagttggagagaatgaacaaatagtacagatttttgggaacaaaatggaaaaaacagaagaagttaagaaagaagccgaaaaatctccaaaaggaaagggaagacgaagcaagacaaaagatctttctttagaaattataaagatttcatcatttggccagaatgaagcaggaagtgaacctcatatagaagctcatagtcttgaattgtcttcattagacaataaaaacttttcttctgctacagaagatgaaattgaccaatgtgtgaaagaaaagaagttgaaacggaaaatactaggacaatcatcgccagagaaaaaaataagaattgagaatggaatggaaatgacaaatactgtatctcaagaaaggaccagtgattgtattggatctgagggaatgaaaaacttaaattttgaacagcactttgaaagagaaaatgaaggaatgccatcattgatagcagagtcaaaccaatgcatccaacaactgactagtgaaagatttgatagtccagctgaagaaactgtaaatattccactaaaagaagatgaggatgcaatgcctctgatcgggcctgaaaccttggtttgccatgaagtagatttggatgatttggatgaaaaggataagaccagcattgaggatgtagcagttgaaagctctgagtctaactctcttgtttctattccacctgccctacctcctgtagtccaacataacttttcagtagcttcaccacttactcttagtcaagatgagtctcgaagcgtaaaaagtgagagtgatataacgattgaagttgatagtattgctgaagaatctcaagaaggtctctgtgagagggaatcggcaaatggatttgaaactaatgttgcctctggtacctgtagtataattgtacaagagagagagagcagagagaagggtcagaagaggccaagtgatggaaatagtggattaatggcaaaaaagcaaaagcgtaccccaaagcgaacaagtgctgcagccaaaaatgaaaagaatggaacaggacaaagcagtgatagtgaagatcttcctgtcctagacaattcaaatgaattagataatatgaacagtacagagagaatctcatttctccaagaaaaactacaggaaatcagaaaatattatatgtctttgaagtctgaagttgcaaccatagacaggaggagaaaaagattaaaaaagaaagacagggaagtgtctcatgcgggagcctccatgtcatctgcttcatcagacactggaatgagtccctcatcatcatctcccccacaaaatgtacttgctgtagaatgcaggtgataaacattttctctaccttcccagcagtttgctgccatggacataaatccccaaaccctgaattacaaccacagaaagcactcaactggtttgacattgctaagtatatcctgtatacttttccaggctggattgtatctattcccctctctcttcttttttcttgttgcaaaaaataagctgattaataagtgaaggttaagcagcctgccatatttgtcataatttttcctcttt

SEQ ID NO: 109281 - DNA, 965 bp, Homo sapiens
  Payload ID: 1467
  Gene Symbol: ARID4A
  Gene Name: AT rich interactive domain 4A (RBP1-like)
  ENST ID: ENST00000445108
  CDS Start-End: 171-965
ccggcgcaggaactgcagccgcggctgggagtggtgctgcccggacgggggcccacggaggtcagaggggaggaggactctggagctgacagcgcgcacttcacccgcagttgttctagcgactgcgaagatagctcgctgagctggaaccccacagatcaccaacaaaaatgaaggtactcctgaaacaggataataccacacaattggtacaagatgaccaagtaaagggtcctttaagagttggagctattgttgaaacaaggacatctgatggatcttttcaggaagctattatcagcaagttgacagatgctagttggtataccgtggtgtttgatgatggtgatgagcgaacattgagacgtacctcactttgtctgaaaggagagagacattttgcagagagtgagacacttgaccagcttccattaacaaatccagagcattttggaactccagtaattgcaaagaagacgaacagaggaaggagatcttctcttcctgttactgaagatgaaaaggaagaagaaagcagtgaagaggaagatgaagacaagcgccgtctcaatgatgaattactaggaaaagttgtaagtgtggtgtctgcaacggagaggactgaatggtatcctgctttggtaatatctcccagctgtaatgatgacatcacagtgaaaaaggatcagtgtttagttcgatcatttattgattctaaattttactctatagcaagaaaggacattaaggaagtagacattctcaatctaccggaatctgagctctccactaaaccagggcttcagaaagcaagcatcttcttaaaaactagagttgttcctgataattggaaaatggatataagtgaaatccttgagtcatccagtagtgatgatgaagatggcccagctgaagaaaatgatgaagagaaggaaaaggaggccaaaaagacagaagaagaggtg

SEQ ID NO: 109282 - DNA, 5783 bp, Homo sapiens
  Payload ID: 1467
  Gene Symbol: ARID4A
  Gene Name: AT rich interactive domain 4A (RBP1-like)
  Uniprot ID: P29374
  ENST ID: ENST00000431317
  CDS Start-End: 319-3885
attccgggtcaaagtggccagcgaggcgggggcgcggtgggccgctggcgagctccggggcggaacgggctgccctttggcgctcgtggggttctcgctgccccctcagctcctgcgtcctggctgccctcgtaaggggtcttgtcccttggctggtgaggattctgcccctccccgctggcgtttgtttactttctttcccttggtcgctccccgcagttgactgattatgtctgtgcctgtctttccccctccccatagttctagcgactgcgaagatagctcgctgagctggaaccccacagatcaccaacaaaaatgaaggcggcagatgagcctgcctacctgacagtgggaaccgatgtcagtgccaagtaccgaggtgccttctgtgaggcaaagattaagactgtgaaaaggctggtgaaagttaaggtactcctgaaacaggataataccacacaattggtacaagatgaccaagtaaagggtcctttaagagttggagctattgttgaaacaaggacatctgatggatcttttcaggaagctattatcagcaagttgacagatgctagttggtataccgtggtgtttgatgatggtgatgagcgaacattgagacgtacctcactttgtctgaaaggagagagacattttgcagagagtgagacacttgaccagcttccattaacaaatccagagcattttggaactccagtaattgcaaagaagacgaacagaggaaggagatcttctcttcctgttactgaagatgaaaaggaagaagaaagcagtgaagaggaagatgaagacaagcgccgtctcaatgatgaattactaggaaaagttgtaagtgtggtgtctgcaacggagaggactgaatggtatcctgctttggtaatatctcccagctgtaatgatgacatcacagtgaaaaaggatcagtgtttagttcgatcatttattgattctaaattttactctatagcaagaaaggacattaaggaagtagacattctcaatctaccggaatctgagctctccactaaaccagggcttcagaaagcaagcatcttcttaaaaactagagttgttcctgataattggaaaatggatataagtgaaatccttgagtcatccagtagtgatgatgaagatggcccagctgaagaaaatgatgaagagaaggaaaaggaggccaaaaagacagaagaagaggtgcctgaggaagaacttgatcctgaagagagggacaacttcctccagcagctttataagtttatggaagacagaggtactccaatcaacaaaccacctgttttgggctataaagatctcaatctcttcaaactcttcagactggtttatcatcagggtggatgtgacaatattgatagtggtgctgtatggaagcaaatttatatggaccttggcattcctattttgaattcagctgcttcctacaatgtaaaaactgcttatagaaagtatctctatggttttgaggagtactgccgttcggcaaatattcagttcagaactgttcatcaccatgaaccaaaagtaaaagaggaaaaaaaagacttagaagaatcaatggaagaggctctcaaattagatcaagaaatgcctttaacagaagtgaagagtgaacctgaggaaaatatcgattcaaacagtgaaagtgaaagagaagagatagaattaaaatctccgaggggacgaaggagaattgctcgagatgtaaattctattaaaaaggaaattgaagaagagaaaacagaagacaaattaaaagataatgatacagaaaataaggatgtagatgatgactatgaaactgcagagaaaaaagaaaatgagctactactggggagaaaaaatacaccaaagcaaaaagagaagaaaattaaaaaacaggaggattctgacaaagactcagatgaagaggaagagaaaagccaagagagggaagaaactgaaagcaaatgtgactctgaaggagaggaagatgaggaagacatggaaccctgcctaacaggaaccaaagtgaaagtaaaatatggacgagggaagactcagaaaatttatgaagccagtattaaaagcactgaaattgatgacggagaagttttatatttggtacattactatggatggaatgtcaggtatgatgagtgggtgaaggctgacaggataatctggcctttggacaaaggtggaccaaagaaaaaacagaagaaaaaagctaaaaataaagaagatagtgaaaaggacgaaaagagagatgaggagaggcagaagtcaaaacggggacgacctcctttaaaatcaaccctctcatcaaacatgccgtatggcttatctaagacagcaaacagtgaaggaaaatcagactcttgttcatctgatagtgaaacagaagatgctttagaaaagaatttaataaatgaagaactttctcttaaagatgaactagaaaaaaatgaaaatttgaatgatgataagctagatgaagaaaatccaaagatttctgcacatatattaaaagaaaatgataggactcaaatgcagcctttagaaaccctgaagttagaagttggagagaatgaacaaatagtacagatttttgggaacaaaatggaaaaaacagaagaagttaagaaagaagccgaaaaatctccaaaaggaaagggaagacgaagcaagacaaaagatctttctttagaaattataaagatttcatcatttggccagaatgaagcaggaagtgaacctcatatagaagctcatagtcttgaattgtcttcattagacaataaaaacttttcttctgctacagaagatgaaattgaccaatgtgtgaaagaaaagaagttgaaacggaaaatactaggacaatcatcgccagagaaaaaaataagaattgagaatggaatggaaatgacaaatactgtatctcaagaaaggaccagtgattgtattggatctgagggaatgaaaaacttaaattttgaacagcactttgaaagagaaaatgaaggaatgccatcattgatagcagagtcaaaccaatgcatccaacaactgactagtgaaagatttgatagtccagctgaagaaactgtaaatattccactaaaagaagatgaggatgcaatgcctctgatcgggcctgaaaccttggtttgccatgaagtagatttggatgatttggatgaaaaggataagaccagcattgaggatgtagcagttgaaagctctgagtctaactctcttgtttctattccacctgccctacctcctgtagtccaacataacttttcagtagcttcaccacttactcttagtcaagatgagtctcgaagcgtaaaaagtgagagtgatataacgattgaagttgatagtattgctgaagaatctcaagaaggtctctgtgagagggaatcggcaaatggatttgaaactaatgttgcctctggtacctgtagtataattgtacaagagagagagagcagagagaagggtcagaagaggccaagtgatggaaatagtggattaatggcaaaaaagcaaaagcgtaccccaaagcgaacaagtgctgcagccaaaaatgaaaagaatggaacagatgaattagataatatgaacagtacagagagaatctcatttctccaagaaaaactacaggaaatcagaaaatattatatgtctttgaagtctgaagttgcaaccatagacaggaggagaaaaagattaaaaaagaaagacagggaagtgtctcatgcgggagcctccatgtcatctgcttcatcagacactggaatgagtccctcatcatcatctcccccacaaaatgtacttgctgtagaatgcaggtgataaacattttctctaccttcccagcagtttgctgccatggacataaatccccaaaccctgaattacaaccacagaaagcactcaactggtttgacattgctaagtatatcctgtatacttttccaggctggattgtatctattcccctctctcttcttttttcttgttgcaaaaaataagctgattaataagtgaaggttaagcagcctgccatatttgtcataatttttcctctttacttttgtttttcgtttgttgtgatatagaacaaagggcacttagcaaatttgaatttgtataataaagctttcaggtgttacagaaatcgtagacaagcaagtgcacatgataaacatcaaaatattacccagctgaatagttactgctgcactttcactaagatgtatttgaacacttggtgagtagggggtttatgttgtgttttttttcattatcgttttttttatttttgtggaagcacttgctatttagaactgccaaagtatatgttcagcagtgtgcccaggattgaaggtgtaaatgggacaaaataaattgtgaaaggaagtgtagttgactgaaaactacagttgtaataagtcttccactttttataggatttttgagcacaaaattatgcaaatattttaatgtttattaatgtttacagtggaattgtgaataagttttcagtggactatcttatcccttgacaaaaatattttgtcttttttctatgtaatttcagagtttttattttgttacaaaaagacaaaaatgaaatatataacaacaatgaagttatttaacaagatttctaaagctgaaatttttgtgtaaaataaggtattatcttgcaacttgttaaatatatttattcagacattggatgttgtatttttatgtattttttaaaatattaataaaatttaaaaaaagaaaattctaggttaattcactctttggatgacaatagctctcagctgtcctttttacaggaggttgcatcctgcagccttgcctgtgttaaagggagtctgtctcagtccatcaaacagtatagaactataaatgggcatctggatcattaaagtatgtccttgtttagaaactttggcagtcctagtatttaaactgttttgaggatcaaatttttggttgcccttaagatactttgtcacagtttttatgtttgctatactgccgaatgaatttatatctcccaaagttgagatgcaacaactaagtaaagcaactatgtatgctttgtctgtgaattgttccacagactgatagattttgtaaataattcttccaaaatcatgtatttaaagcagttttgcatatacattatgtaaaaaggtgattttataaaagcagtttttaaattcatgtttgtacattgaaaggggttttttttttaaacctccttttctgtgtttaatatgctgtagaataataacctagatgctctagactgtatatcaggatctgatttacaagaaaaagtcagagctaaacactagtgatggcatagcattactgaaatcattgtttcttaatttcattttactacattgtgaacttgtgattcagattccattttctcagagaattaaaaacaaaaaaagtactcttgtaaaatgcacttttctgtcttttctttgcaaagcagaagtatctcaatgtaaaataaaaatggagctcagtgggcagtattaataaaggccatgttttaaacataggctttatacttttagttttcatttaagtgattgcttttttcctaagtgcttgtaacttacagttggaaaatcagatttcacaaaaccaagcattttagtatattcagcctttacaataaaatatttctactaattataaaaatgaaaaaaaaa

SEQ ID NO: 109283 - DNA, 697 bp, Homo sapiens
  Payload ID: 1467
  Gene Symbol: ARID4A
  Gene Name: AT rich interactive domain 4A (RBP1-like)
  ENST ID: ENST00000431612
  CDS Start-End: 200-322
gtggcagtaaatcggggcgagtggggaacccggcgcaggaactgcagccgcggctgggagtggtgctgcccggacgggggcccacggaggtcagaggggaggaggactctggagctgacagcgcgcacttcacccgcagttgttctagcgactgcgaagatagctcgctgagctggaaccccacagatcaccaacaaaaatgaaggcggcagatgagcctgcctacctgacagtgggaaccgatgtcagtgccaagtaccgaggtgccttctgtgaggcaaagattaagactgtgaaaaggctggtgaaagttaagaattaagcaccataaaaggaggaaacgtctgacttgttctatgcccaacacatagagtagtgcctgatacatagtggaccctcaaaatttgttgaatgaatcagtgaactagagcagtgattcctaaagggtccctccagaccagcagcatcagccttacttgggaacttgttccaaatgcaaattttccccaccccagatctacttcatcagaaactctgggggtactcctgaaacaggataataccacacaattggtacaagatgaccaagtaaagggtcctttaagagttggagctattgttgaaacaaggacatctgatggatcttttcaggaagctattatcagcaagttgacagatgctagttggtataccgtgg

SEQ ID NO: 109284 - DNA, 582 bp, Homo sapiens
  Payload ID: 1467
  Gene Symbol: ARID4A
  Gene Name: AT rich interactive domain 4A (RBP1-like)
  ENST ID: ENST00000424658
  CDS Start-End: 419-582
ggcgccgtgacactccgctgccgccaccgcgggcccggggcgggccgagggggccgagcggcggaggcggggcgcgggccgaagtcggggtatccgggggaccgcggagcggaggctcggcggtcgtctccgcgggggacctggggaagcccgaagggagctctggccttttccggagctatctgtcctggagctccgagttgagcattccgggtcaaagtggccagcgaggcgggggcgcggtgggccgctggcgagctccggggcggaacgggctgccctttggcgctcgtggggttctcgctgccccctcagctcctgcgtcctggctgccctcgtaaggggtcttgtcccttggctgttctagcgactgcgaagatagctcgctgagctggaaccccacagatcaccaacaaaaatgaaggcggcagatgagcctgcctacctgacagtgggaaccgatgtcagtgccaagtaccgaggtgccttctgtgaggcaaagattaagactgtgaaaaggctggtgaaagttaaggtactcctgaaacaggataataccacacaattggtacaagatgacca

SEQ ID NO: 109285 - DNA, 2537 bp, Homo sapiens
  Payload ID: 1467
  Gene Symbol: ARID4A
  Gene Name: AT rich interactive domain 4A (RBP1-like)
  ENST ID: ENST00000417477
  CDS Start-End: 293-2537
aatggaggtttgccagatgctttgaaatgggctgtctttcttttcctttcatgtaatgtctgatttttatgtggaagagaatgtaagtagtgctgtataaccctgcggatgctatgccctaagagggaaagcaaatatttgcaagtcagactgaaaaatgtccagaccctgtactgattaagtagaaggggaatctaaccactttgcatttgaaagaaaatgcagcatatagcctgaggaagaacttgatcctgaagagagggacaacttcctccagcagctttataagtttatggaagacagaggtactccaatcaacaaaccacctgttttgggctataaagatctcaatctcttcaaactcttcagactggtttatcatcagggtggatgtgacaatattgatagtggtgctgtatggaagcaaatttatatggaccttggcattcctattttgaattcagctgcttcctacaatgtaaaaactgcttatagaaagtatctctatggttttgaggagtactgccgttcggcaaatattcagttcagaactgttcatcaccatgaaccaaaagtaaaagaggaaaaaaaagacttagaagaatcaatggaagaggctctcaaattagatcaagaaatgcctttaacagaagtgaagagtgaacctgaggaaaatatcgattcaaacagtgaaagtgaaagagaagagatagaattaaaatctccgaggggacgaaggagaattgctcgagatgtaaattctattaaaaaggaaattgaagaagagaaaacagaagacaaattaaaagataatgatacagaaaataaggatgtagatgatgactatgaaactgcagagaaaaaagaaaatgagctactactggggagaaaaaatacaccaaagcaaaaagagaagaaaattaaaaaacaggaggattctgacaaagactcagatgaagaggaagagaaaagccaagagagggaagaaactgaaagcaaatgtgactctgaaggagaggaagatgaggaagacatggaaccctgcctaacaggaaccaaagtgaaagtaaaatatggacgagggaagactcagaaaatttatgaagccagtattaaaagcactgaaattgatgacggagaagttttatatttggtacattactatggatggaatgtcaggtatgatgagtgggtgaaggctgacaggataatctggcctttggacaaaggtggaccaaagaaaaaacagaagaaaaaagctaaaaataaagaagatagtgaaaaggacgaaaagagagatgaggagaggcagaagtcaaaacggggacgacctcctttaaaatcaaccctctcatcaaacatgccgtatggcttatctaagacagcaaacagtgaaggaaaatcagactcttgttcatctgatagtgaaacagaagatgctttagaaaagaatttaataaatgaagaactttctcttaaagatgaactagaaaaaaatgaaaatttgaatgatgataagctagatgaagaaaatccaaagatttctgcacatatattaaaagaaaatgataggactcaaatgcagcctttagaaaccctgaagttagaagttggagagaatgaacaaatagtacagatttttgggaacaaaatggaaaaaacagaagaagttaagaaagaagccgaaaaatctccaaaaggaaagggaagacgaagcaagacaaaagatctttctttagaaattataaagatttcatcatttggccagaatgaagcaggaagtgaacctcatatagaagctcatagtcttgaattgtcttcattagacaataaaaacttttcttctgctacagaagatgaaattgaccaatgtgtgaaagaaaagaagttgaaacggaaaatactaggacaatcatcgccagagaaaaaaataagaattgagaatggaatggaaatgacaaatactgtatctcaagaaaggaccagtgattgtattggatctgagggaatgaaaaacttaaattttgaacagcactttgaaagagaaaatgaaggaatgccatcattgatagcagagtcaaaccaatgcatccaacaactgactagtgaaagatttgatagtccagctgaagaaactgtaaatattccactaaaagaagatgaggatgcaatgcctctgatcgggcctgaaaccttggtttgccatgaagtagatttggatgatttggatgaaaaggataagaccagcattgaggatgtagcagttgaaagctctgagtctaactctcttgtttctattccacctgccctacctcctgtagtccaacataacttttcagtagcttcaccacttactcttagtcaagatgagtctcgaagcgtaaaaagtgagagtgatataacgattgaagttgatagtattgctgaagaatctcaagaaggtctctgtgagagggaatcggcaaatggatttgaaactaatgttgcctctggtacctgtagtataattgtacaagagagagagagcagagagaagg

SEQ ID NO: 109286 - DNA, 6067 bp, Homo sapiens
  Payload ID: 1468
  Gene Symbol: ARID4B
  Gene Name: AT rich interactive domain 4B (RBP1-like)
  Uniprot ID: Q4LE39
  ENST ID: ENST00000264183
  CDS Start-End: 499-4437
aaagggggggaacctagagtcggtgggggggaagcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgtcagttgagtgcaggtgacagcaggacttgctaaagcactttgcacttaatggctgttgagggccactttttttttatactgcacagtggcacaaaaaaatatcagacaagcactattttatatttaaaaattgtttcttgacaagctgacttggcacttaagtgcacttttttatgaagaaaaagtacaatgaactgcttttcctcaagcaataattgtttccaacttgtctgggaattgtgtgtctggtaactggaaggccttccactgtggcaaatggaggcttttcactgcctgtagagacaatacagtaagcatagttaaggggtgggtcagaacatgttaagataacttactgtatatgtattcccttgtattttgttaaagctggaacatttgatatttttccatttatttatgaaaaaatatgaacctattttcatttgtacaaggtaattgttttttaaagcaagtcaccttagggtggctttaattgtataagtcaagcacatgtaataaattcaaaacctgcagttaacaggatattagacatcaatcctggtaaccaaatattaaagattctctttaaaaaagactgaacatgtttacaggtttgaattaggctaaaaggtcttgcagtggcttttcatggcccttcaaattggaatggaactactgtactttgccatttttctataaatcagtatttttttttaattttgatatacattgtgtgaaaaaagaaaatggctaataaactgtattaaatcttaaacaatgtataaagattgtacttagccagttcaaagtgtatatttattcataatgaattataacagttatatttttgtgttttcttgtaaatgtttcttttcccttaaatacagataattcatttgtattgcttattttattatgagctacaacaaaaggacttcaggaacaagtaatgtattagtatggttcaagattgttgataggaactgtctcaaaaggatggtggttattttaaatataaatagctaatgggggtggtaggcctataaaattaaatgccttgtataaaatccaaaatgaatgcaaaattgttttcacttgtattgactttatgttgtatgattccaatctctgttctgtttggcacttgtatttaattcttcacctttgtaagacatttgtatattgtggatgtgttcattcaagctatttaatatctggcactgttaatacacagtactttattgtacagactgttttactgttttaattgtagttctgtgtactttttttggatggggctggcatgttttctttgtttcctggcaatacgacgtgggaatttcaatgcgttttgttgtagatgctaacgtgtcagaatcctttacattcaacttttctaagaaaagcattttcagtcttgtagtgtgtgcttacagtaactaattttgttgaaaatggtttcaagttattcaaatttgtacaggactgtaaagatttgttgacagcaaaatgttgaagaaaaaagcttatagaataaaagctataaagtatatattaggatctgcaaacaatgaagaattatgtaatatattgtacaaatgtaagcaaaggctctgaaataaaatgccatagtttgtgaatccttga

SEQ ID NO: 109287 - DNA, 5811 bp, Homo sapiens
  Payload ID: 1468
  Gene Symbol: ARID4B
  Gene Name: AT rich interactive domain 4B (RBP1-like)
  Uniprot ID: Q4LE39
  ENST ID: ENST00000349213
  CDS Start-End: 501-4181
agaaagggggggaacctagagtcggtgggggggaagcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgtcagttgagtgcaggtgacagcaggacttgctaaagcactttgcacttaatggctgttgagggccactttttttttatactgcacagtggcacaaaaaaatatcagacaagcactattttatatttaaaaattgtttcttgacaagctgacttggcacttaagtgcacttttttatgaagaaaaagtacaatgaactgcttttcctcaagcaataattgtttccaacttgtctgggaattgtgtgtctggtaactggaaggccttccactgtggcaaatggaggcttttcactgcctgtagagacaatacagtaagcatagttaaggggtgggtcagaacatgttaagataacttactgtatatgtattcccttgtattttgttaaagctggaacatttgatatttttccatttatttatgaaaaaatatgaacctattttcatttgtacaaggtaattgttttttaaagcaagtcaccttagggtggctttaattgtataagtcaagcacatgtaataaattcaaaacctgcagttaacaggatattagacatcaatcctggtaaccaaatattaaagattctctttaaaaaagactgaacatgtttacaggtttgaattaggctaaaaggtcttgcagtggcttttcatggcccttcaaattggaatggaactactgtactttgccatttttctataaatcagtatttttttttaattttgatatacattgtgtgaaaaaagaaaatggctaataaactgtattaaatcttaaacaatgtataaagattgtacttagccagttcaaagtgtatatttattcataatgaattataacagttatatttttgtgttttcttgtaaatgtttcttttcccttaaatacagataattcatttgtattgcttattttattatgagctacaacaaaaggacttcaggaacaagtaatgtattagtatggttcaagattgttgataggaactgtctcaaaaggatggtggttattttaaatataaatagctaatgggggtggtaggcctataaaattaaatgccttgtataaaatccaaaatgaatgcaaaattgttttcacttgtattgactttatgttgtatgattccaatctctgttctgtttggcacttgtatttaattcttcacctttgtaagacatttgtatattgtggatgtgttcattcaagctatttaatatctggcactgttaatacacagtactttattgtacagactgttttactgttttaattgtagttctgtgtactttttttggatggggctggcatgttttctttgtttcctggcaatacgacgtgggaatttcaatgcgttttgttgtagatgctaacgtgtcagaatcctttacattcaacttttctaagaaaagcattttcagtcttgtagtgtgtgcttacagtaactaattttgttgaaaatggtttcaagttattcaaatttgtacaggactgtaaagatttgttgacagcaaaatgttgaagaaaaaagcttatagaataaaagctataaagtatatattaggatctgcaaacaatgaagaattatgtaatatattgtacaaatgtaagcaaaggctctgaaataaaatgccatagtttgtgaatccttga

SEQ ID NO: 109288 - DNA, 5946 bp, Homo sapiens
  Payload ID: 1468
  Gene Symbol: ARID4B
  Gene Name: AT rich interactive domain 4B (RBP1-like)
  Uniprot ID: Q4LE39
  ENST ID: ENST00000366603
  CDS Start-End: 378-4316
ggcggggccagatgttgatctcgctcccacttgtcgggtctgagcccggaacgggacgtgggcaggggctctgtggcgggccggtcctgcccgcggcccacaggccctcctggcccctcggtggcccccggccggcctctcgctcggacgcggcgcgtgggggcgcggattcgctcggccgggcgccgaggccctaggggagagcggccggccctgcgccggacgccgggcttgttgtgagtttcttctctgacagaaatggcgtcattgtcgtagacgggaaactccgtcgggtctcgacaatggggacgggaagctgccgagctgtgtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgtcagttgagtgcaggtgacagcaggacttgctaaagcactttgcacttaatggctgttgagggccactttttttttatactgcacagtggcacaaaaaaatatcagacaagcactattttatatttaaaaattgtttcttgacaagctgacttggcacttaagtgcacttttttatgaagaaaaagtacaatgaactgcttttcctcaagcaataattgtttccaacttgtctgggaattgtgtgtctggtaactggaaggccttccactgtggcaaatggaggcttttcactgcctgtagagacaatacagtaagcatagttaaggggtgggtcagaacatgttaagataacttactgtatatgtattcccttgtattttgttaaagctggaacatttgatatttttccatttatttatgaaaaaatatgaacctattttcatttgtacaaggtaattgttttttaaagcaagtcaccttagggtggctttaattgtataagtcaagcacatgtaataaattcaaaacctgcagttaacaggatattagacatcaatcctggtaaccaaatattaaagattctctttaaaaaagactgaacatgtttacaggtttgaattaggctaaaaggtcttgcagtggcttttcatggcccttcaaattggaatggaactactgtactttgccatttttctataaatcagtatttttttttaattttgatatacattgtgtgaaaaaagaaaatggctaataaactgtattaaatcttaaacaatgtataaagattgtacttagccagttcaaagtgtatatttattcataatgaattataacagttatatttttgtgttttcttgtaaatgtttcttttcccttaaatacagataattcatttgtattgcttattttattatgagctacaacaaaaggacttcaggaacaagtaatgtattagtatggttcaagattgttgataggaactgtctcaaaaggatggtggttattttaaatataaatagctaatgggggtggtaggcctataaaattaaatgccttgtataaaatccaaaatgaatgcaaaattgttttcacttgtattgactttatgttgtatgattccaatctctgttctgtttggcacttgtatttaattcttcacctttgtaagacatttgtatattgtggatgtgttcattcaagctatttaatatctggcactgttaatacacagtactttattgtacagactgttttactgttttaattgtagttctgtgtactttttttggatggggctggcatgttttctttgtttcctggcaatacgacgtgggaatttcaatgcgttttgttgtagatgctaacgtgtcagaatcctttacattcaacttttctaagaaaagcattttcagtcttgtagtgtgtgcttacagtaactaattttgttgaaaatggtttcaagttattcaaatttgtacaggactgtaaagatttgttgacagcaaaatgttgaagaaaaaagcttatagaataaaagctataaagtatatattaggatctgcaaacaatgaagaattatgtaatatattgtacaaatgtaagcaaaggctctgaaataaaatgccatagtttgtgaatccttga

SEQ ID NO: 109289 - DNA, 1759 bp, Homo sapiens
  Payload ID: 1468
  Gene Symbol: ARID4B
  Gene Name: AT rich interactive domain 4B (RBP1-like)
  ENST ID: ENST00000418304
  CDS Start-End: 311-1759
ggtgggggggaagcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattct

SEQ ID NO: 109290 - DNA, 5151 bp, Homo sapiens
  Payload ID: 1468
  Gene Symbol: ARID4B
  Gene Name: AT rich interactive domain 4B (RBP1-like)
  Uniprot ID: Q4LE39
  ENST ID: ENST00000421364
  CDS Start-End: 416-3877
gcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcagtgccccacactgacctcctgctgctcttccaggagactcctgccacctccactgcctgacctttgctagcagccggcttggctgcacttcagtgcagaaaagggttattcggccagctccccgaggttctgctgagcccatatgacttccaggcgcaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgtcagttgagtgcaggtgacagcaggacttgctaaagcactttgcacttaatggctgttgagggccactttttttttatactgcacagtggcacaaaaaaatatcagacaagcactattttatatttaaaaattgtttcttgacaagctgacttggcacttaagtgcacttttttatgaagaaaaagtacaatgaactgcttttcctcaagcaataattgtttccaacttgtctgggaattgtgtgtctggtaactggaaggccttccactgtggcaaatggaggcttttcactgcctgtagagacaatacagtaagcatagttaaggggtgggtcagaacatgttaagataacttactgtatatgtattcccttgtattttgttaaagctggaacatttgatatttttccatttatttatgaaaaaatatgaacctattttcatttgtacaaggtaattgttttttaaagcaagtcaccttagggtggctttaattgtataagtcaagcacatgtaataaattcaaaacctgcagttaacaggatattagacatcaatcctggtaaccaaatattaaagattctctttaaaaaagactgaacatgtttacaggtttgaattaggctaaaaggtcttgcagtggcttttcatggcccttc

SEQ ID NO: 109291 - DNA, 1660 bp, Homo sapiens
  Payload ID: 1468
  Gene Symbol: ARID4B
  Gene Name: AT rich interactive domain 4B (RBP1-like)
  ENST ID: ENST00000444620
  CDS Start-End: 1-1660
agtttgagtgctatccaccaggcatgaaagtccaagtgcgatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcagtaagtgtgaaat

SEQ ID NO: 109292 - DNA, 3463 bp, Homo sapiens
  Payload ID: 1468
  Gene Symbol: ARID4B
  Gene Name: AT rich interactive domain 4B (RBP1-like)
  ENST ID: ENST00000474953
  CDS Start-End: 1-2089
caaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgcttcaaccactcccagaagacgtccttcactcccaaaatgaggcttttctgaaacggcgaggaccaccaaccgacggcgacaaacctgctccctcacccagcgcctcccttcgccgccgcccggcggccgactgccggaggggagggggcgtggccagagagcggaagtgcccggaacccggaagtgcgagctggcgcgcagctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaagaagctgaagtcgttttttaaagagtatggacaaatagaatctgtacgatttcgttctctgattccagcagagggaacgctatccaaaaagttggcagcaataaaacgtaaaattcatcctgatcagaaaaatattaatgcctatgttgtgtttaaggaggagagtgctgccacgcaagcattgaaaagaaatggggcccagattgcagatggatttcgtattagagttgatctcgcatctgagacctcatctagagacaagagatcggtttttgtggggaatctcccttataaagttgaagaatctgccattgagaagcactttctggactgtggaagtatcatggccgtgaggattgtgagagacaaaatgacaggcatcggcaaagggtttggctatgtgctctttgagaatacagattctgttcatcttgctctgaaattaaataattctgaactcatggggagaaaactcagagtcatgcgttctgttaataaagaaaaatttaaacaacaaaattcaaatccacgattgaagaatgtcagtaaacctaagcagggacttaattttacttccaaaactgcagaaggacatcctaaaagcttatttattggagaaaaagctgttctccttaaaacgaagaagaaaggacagaagaaaagtggacgccctaagaaacagagaaaacagaaataacaaccaggaactgctttttcttttcctgctgagtactgctaataaaagtgctattatctgctgatagcatcgtctgcta

SEQ ID NO: 109293 - DNA, 2188 bp, Homo sapiens
  Payload ID: 1469
  Gene Symbol: ARID5A
  Gene Name: AT rich interactive domain 5A (MRF1-like)
  Uniprot ID: Q03989
  ENST ID: ENST00000357485
  CDS Start-End: 79-1863
agtatctcagagagcgcggggtccggacagccgcgcgctgagggtctcggggcgggcgccgcgggacctctccgggccatggcagcccctgtcaaagggaacaggaagcagtccacggagggtgacgccctagacccacctgcatcccccaaacctgctggcaagcagaacggaatccagaaccccatctcgctggaggactcccccgaggcaggcggggagcgggaggaggagcaggagcgggaggaggagcaggccttcctggtcagcctctacaagttcatgaaggagcgacacacgcccatcgagagggtgccccatctcggcttcaagcagattaacctgtggaagatctacaaagcagtggagaagctgggggcctatgagctggtgaccgggcgccgcctctggaagaacgtgtacgacgagctggggggcagcccaggcagcaccagcgcggccacgtgcacgcgccgccactacgagaggctggtcctgccatacgtgcggcacctgaagggggaggatgacaagccgctgcccacctccaagcccaggaaacagtacaagatggctaaggagaacaggggggatgatggggccaccgagaggccgaagaaggccaaggaggagcggcgcatggaccagatgatgccaggaaagaccaaagcagatgctgctgacccagcaccacttcccagccaggagccccccaggaacagcacagaacagcagggcctggcctctgggtcttctgtgtcctttgtgggtgccagcggctgtcctgaggcctacaagcggctcctatccagcttctactgcaaggggacacacggcatcatgtcaccactggccaaaaagaagctcctggcccaggtgagcaaggtggaggccttgcagtgccaggaggagggctgccgccatggggcagagccccaggcgtccccagctgttcacctcccagagagtccccagagccccaaagggctgactgagaactccaggcaccggctgacccctcaggagggattgcaggccccaggtggcagcctcagagaggaggcgcaggcaggcccctgcccggcagcccccatcttcaagggctgcttctacacccaccccaccgaggtgctgaagcctgtcagccagcaccccagggacttcttctctagacttaaagatggggtgctattggggcctcctggcaaagaggggctgtcagtgaaagagccccagctggtgtggggcggagacgctaaccgcccttctgcgttccataaaggtggctccagaaagggcatcctctaccccaagcccaaagcctgctgggtgtcccccatggccaaggtcccagccgagagccccacgctcccgcccaccttccccagtagcccaggcctgggcagcaagcgcagcctggaggaagagggtgctgcccacagtgggaagagactgcgggccgtgtctccctttcttaaggaggcggatgccaagaagtgtggggccaaacctgcagggtccggcctggtctcctgccttctgggcccagccctggggcctgtgcccccagaggcctacaggggcaccatgctgcactgcccgctgaacttcactggcaccccgggccccttgaagggccaggctgcactccccttcagccccctggtcatcccggccttcccggcccacttcctggccaccgcaggcccctcgcccatggccgctggcctgatgcacttccccccaacgtccttcgacagtgccctccgccacagactttgcccggcctcatctgcctggcacgcaccaccagtcacaacctatgcagcgccccacttcttccacctcaacaccaagctgtaggccagcccatggtgttgtgtacactgtggagtcgacaggggcctacaacaggcaggtactgctgccagggggctctgaactagtgcctgctacccaggacacccgggccatgcccctggctgggcagcctggcacaagtgaagaagaaggcagtgggaaaactgggtttatctcaaggcagcagcctgagcccaggagcagaggacccagttgttataaggcgctgggagaggatgggcagctcccactgccccagagcggagctcgaagcacccaggttgcccacggaaaatccaataaaaagacaccagtgtgaatccacgta

SEQ ID NO: 109294 - DNA, 2038 bp, Homo sapiens
  Payload ID: 1469
  Gene Symbol: ARID5A
  Gene Name: AT rich interactive domain 5A (MRF1-like)
  ENST ID: ENST00000412735
  CDS Start-End: 76-252
atctcagagagcgcggggtccggacagccgcgcgctgagggtctcggggcgggcgccgcgggacctctccgggccatggcagcccctgtcaaagggaacaggaagcagtccacggagggtgacgccctagacccacctgcatcccccaaacctgctggcaagcagaacggaatccagaaccccatctcgctggagttaacctgtggaagatctacaaagcagtggagaagctgggggcctatgagctggtgaccgggcgccgcctctggaagaacgtgtacgacgagctggggggcagcccaggcagcaccagcgcggccacgtgcacgcgccgccactacgagaggctggtcctgccatacgtgcggcacctgaagggggaggatgacaagccgctgcccacctccaagcccaggaaacagtacaagatggctaaggagaacaggggggatgatggggccaccgagaggccgaagaaggccaaggaggagcggcgcatggaccagatgatgccaggaaagaccaaagcagatgctgctgacccagcaccacttcccagccaggagccccccaggaacagcacagaacagcagggcctggcctctgggtcttctgtgtcctttgtgggtgccagcggctgtcctgaggcctacaagcggctcctatccagcttctactgcaaggggacacacggcatcatgtcaccactggccaaaaagaagctcctggcccaggtgagcaaggtggaggccttgcagtgccaggaggagggctgccgccatggggcagagccccaggcgtccccagctgttcacctcccagagagtccccagagccccaaagggctgactgagaactccaggcaccggctgacccctcaggagggattgcaggccccaggtggcagcctcagagaggaggcgcaggcaggcccctgcccggcagcccccatcttcaagggctgcttctacacccaccccaccgaggtgctgaagcctgtcagccagcaccccagggacttcttctctagacttaaagatggggtgctattggggcctcctggcaaagaggggctgtcagtgaaagagccccagctggtgtggggcggagacgctaaccgcccttctgcgttccataaaggtggctccagaaagggcatcctctaccccaagcccaaagcctgctgggtgtcccccatggccaaggtcccagccgagagccccacgctcccgcccaccttccccagtagcccaggcctgggcagcaagcgcagcctggaggaagagggtgctgcccacagtgggaagagactgcgggccgtgtctccctttcttaaggaggcggatgccaagaagtgtggggccaaacctgcagggtccggcctggtctcctgccttctgggcccagccctggggcctgtgcccccagaggcctacaggggcaccatgctgcactgcccgctgaacttcactggcaccccgggccccttgaagggccaggctgcactccccttcagccccctggtcatcccggccttcccggcccacttcctggccaccgcaggcccctcgcccatggccgctggcctgatgcacttccccccaacgtccttcgacagtgccctccgccacagactttgcccggcctcatctgcctggcacgcaccaccagtcacaacctatgcagcgccccacttcttccacctcaacaccaagctgtaggccagcccatggtgttgtgtacactgtggagtcgacaggggcctacaacaggcaggtactgctgccagggggctctgaactagtgcctgctacccaggacacccgggccatgcccctggctgggcagcctggcacaagtgaagaagaaggcagtgggaaaactgggtttatctcaaggcagcagcctgagcccaggagcagaggacccagttgttataaggcgctgggagaggatgggcagctcccactgccccagagcggagctcgaagcacccaggttgcccacggaaaatccaataaaaagacaccagtgtgaa

SEQ ID NO: 109295 - DNA, 3079 bp, Homo sapiens
  Payload ID: 1469
  Gene Symbol: ARID5A
  Gene Name: AT rich interactive domain 5A (MRF1-like)
  ENST ID: ENST00000454558
  CDS Start-End: 1178-2758
gtttcctgaaaggggctgcgcgggtgtgaagaacttgctcaatgcgctttgtaggatccactgttcctctttcggccgcgggctgcgccgatggtccggggagcccggcttctcgccccctgccccttccttctcttcccttttctcttttcctctcctgtctctccgcccacccgccgcagccccacaggagaggggtcgcttccctggttgctctcctctcctgtcccttgtgtgtccccttgtcttccctcggtctgcagaagggacggggtggcggctggggagcgtcaggggaagagggcaagagcgtgggctacgagcttgcaggcgatgcccggcttcgcgctcggcgggagctgcgggccaacccgggcccgcgctccgtccctccgcggtgtctaggggtcgcccgggctggggtcgcgtcaccctccgcccagcgccggcgtggtggggcttgcgcggtgcaggacccccgagggcccagggggtcccaaggcgctgcgggtccagtgtccctttgtttgcagagtcttgggccagtaaggagtgctccgcgggccccaggggaggacaacaggtgcctcttgccccacccgggctcctctggtgggagcccacacgcacggtggcgtcactgcgcctacaggcaacgctagagcacaggaggggtgggaggtcggggctcgagggcttcaccccgcagcagagctcagagcccaatccaggccttagggacccgcctggggcctagaacttggtgtggcagaggtagaaagggcctccgataatctgcttctacagttgagagacgtcaactggcacctctgagcctctgccccgtaggtgaaatgggaacacacgaaaccatctgaggagctctcactgtccgtcaccaccaaatgtggcccagactccgtggggagggacagtcccatcctggaactggggcttttaggacatcccagagcccgcagcccctgtcaaagggaacaggaagcagtccacggagggtgacgccctagacccacctgcatcccccaaacctgctggcaagcagaacggaatccagaaccccatctcgctggaggactcccccgaggcaggcggggagcgggaggaggagcaggagcgggaggaggagcaggccttcctggtcagcctctacaagttcatgaaggagcgacacacgcccatcgagagggtgccccatctcggcttcaagcagattaacctgtggaagatctacaaagcagtggagaagctgggggcctatgagctggtgaccgggcgccgcctctggaagaacgtgtacgacgagctggggggcagcccaggcagcaccagcgcggccacgtgcacgcgccgccactacgagaggctggtcctgccatacgtgcggcacctgaagggggaggatgacaagccgctgcccacctccaagcccaggaaacagtacaagatggctaaggagaacaggggggatgatggggccaccgagaggccgaagaaggccaaggaggagcggcgcatggaccagatgatgccaggaaagaccaaagcagatgctgctgacccagcaccacttcccagccaggagccccccaggaacagcacagaacagcagggcctggcctctgggtcttctgtgtcctttgtgggtgccagcggctgtcctgaggcctacaagcggctcctatccagcttctactgcaaggggacacacggcatcatgtcaccactggccaaaaagaagctcctggcccaggtgagcaaggtggaggccttgcagtgccaggaggagggctgccgccatggggcagagccccaggcgtccccagctgttcacctcccagagagtccccagagccccaaagggctgactgagaactccaggcaccggctgacccctcaggagggattgcaggccccaggtggcagcctcagagaggaggcgcaggcaggcccctgcccggcagcccccatcttcaagggctgcttctacacccaccccaccgaggtgctgaagcctgtcagccagcaccccagggacttcttctctagacttaaagatggggtgctattggggcctcctggcaaagaggggctgtcagtgaaagagccccagctggtgtggggcggagacgctaaccgcccttctgcgttccataaaggtggctccagaaagggcatcctctaccccaagcccaaagcctgctgggtgtcccccatggccaaggtcccagccgagagccccacgctcccgcccaccttccccagtagcccaggcctgggcagcaagcgcagcctggaggaagagggtgctgcccacagtgggaagagactgcgggccgtgtctccctttcttaaggaggcggatgccaagaagtgtggggccaaacctgcagggtccggcctggtctcctgccttctgggcccagccctggggcctgtgcccccagaggcctacaggggcaccatgctgcactgcccgctgaacttcactggcaccccgggccccttgaagggccaggctgcactccccttcagccccctggtcatcccggccttcccggcccacttcctggccaccgcaggcccctcgcccatggccgctggcctgatgcacttccccccaacgtccttcgacagtgccctccgccacagactttgcccggcctcatctgcctggcacgcaccaccagtcacaacctatgcagcgccccacttcttccacctcaacaccaagctgtaggccagcccatggtgttgtgtacactgtggagtcgacaggggcctacaacaggcaggtactgctgccagggggctctgaactagtgcctgctacccaggacacccgggccatgcccctggctgggcagcctggcacaagtgaagaagaaggcagtgggaaaactgggtttatctcaaggcagcagcctgagcccaggagcagaggacccagttgttataaggcgctgggagaggatgggcagctcccactgccccagagcggagctcgaagcacccaggttgcccacggaaaatccaataaaaagacaccagtgtgaatcca

SEQ ID NO: 109296 - DNA, 7891 bp, Homo sapiens
  Payload ID: 1470
  Gene Symbol: ARID5B
  Gene Name: AT rich interactive domain 5B (MRF1-like)
  Uniprot ID: Q14865
  ENST ID: ENST00000279873
  CDS Start-End: 411-3977
atcagacgatatcccagacaggagcggttagagagagaggaatcacatctccacacagttttagggtgctttttatttttacaaatcttcttgtgtgttttttgccttgatccatcctcttcccgccgagatcgtatggcgcctttctctcgattatgaatttgatcaatccatctttggaagaaaacccacatagttttttcaggagctgaaaattgagtcgttatagaaatattaggacatattttcaatcatttcggtgcccgaagggaggcaagagctcagttttatattgagacattacgccggctgaaggcagagaatgcgtttccctgccaggacctgatgcaatccattcaagccaacaagtttggagagaatgttgagttcaatcaattcagaacgtcgagatggagcccaactcactccagtgggtcggctcaccgtgtggcttgcacggaccttacattttctacaaggcttttcaattccaccttgaaggcaaaccaagaattttgtcccttggcgactttttctttgtaagatgtacgccaaaggatccgatttgcatagcggagctccagctgttgtgggaagagaggaccagccggcaacttttatccagctctaaactttatttcctcccagaagacactccccagggcagaaatagcgaccatggcgaggatgaagtcattgctgtttccgaaaaggtgattgtgaagcttgaagacctggtcaagtgggtacattctgatttctccaagtggagatgtggcttccacgctggaccagtgaaaactgaggccttgggaaggaatggacagaaggaagctctgctgaagtacaggcagtcaaccctaaacagtggactcaacttcaaagacgttctcaaggagaaggcagacctgggggaggacgaggaagaaacgaacgtgatagttctcagctacccccagtactgccggtaccgctcgatgctgaaacgcatccaggataagccatcttccattctaacggaccagtttgcattggccctggggggcattgcagtggtcagcaggaaccctcagatcctgtactgtcgggacacctttgaccacccgactctcatagaaaacgagagtatatgcgatgagtttgcgccaaatcttaaaggcagaccacgcaaaaagaaaccatgcccacaaagaagagattcattcagtggtgttaaggattccaacaacaattccgatggcaaagccgttgccaaggtgaaatgtgaggccaggtcagccttgaccaagccgaagaataaccataactgtaaaaaagtctcaaatgaagaaaaaccaaaggttgccattggtgaagagtgcagggcagatgaacaagccttcttggtggcactttataaatacatgaaagaaaggaaaacgccgatagaacgaataccctatttaggttttaaacagattaacctttggactatgtttcaagctgctcaaaaactgggaggatatgaaacaataacagcccgccgtcagtggaaacatatttatgatgaattaggcggtaatcctgggagcaccagcgctgccacttgtacccgcagacattatgaaagattaatcctaccatatgaaagatttattaaaggagaagaagataagcccctgcctccaatcaaacctcggaaacaggagaacagttcacaggaaaatgagaacaaaacaaaagtatctggaaccaaacgcatcaaacatgaaatacctaaaagcaagaaagaaaaagaaaatgccccaaagccccaggatgcagcagaggtttcatcagagcaagaaaaagaacaagagactttaataagccagaaaagcatccctgagcctctcccagcagcagacatgaagaaaaaaatagaagggtatcaggaattttcagcgaagcccctggcatccagagtagacccagagaaggacaacgaaacagaccaaggttccaacagtgagaaggtggcagaggaggcgggagagaaggggcccacacctccactcccaagtgctcctctggccccagaaaaagattcagccttggtccctggggccagcaaacagccactcacctctcctagtgccctggtggactcaaaacaagaatccaaactgtgctgttttacagagagccctgaaagtgaaccccaagaagcatccttccccagcttccccaccacacagccaccgctggcaaaccagaatgagacggaggatgacaaactgcccgccatggcagattacattgccaactgcaccgtgaaggtggaccagctgggcagtgacgacatccacaatgcgctcaagcagaccccaaaggtccttgtggtccagtcgtttgacatgttcaaagacaaagacctgactgggcccatgaacgagaaccatggacttaattacacgcccctgctctactctaggggcaacccaggcatcatgtccccactggccaagaaaaagcttttgtcccaagtgagtggggccagcctctccagcagctacccttatggctccccaccccctttgatcagcaaaaagaaactgattgctagggatgacttgtgttccagtttgtcccagacccaccatggccaaagcactgaccatatggcggtcagccggccatcagtgattcagcacgtccagagtttcagaagcaagccctcggaagagagaaagaccatcaatgacatctttaagcatgagaaactgagtcgatcagatccccaccgctgcagcttctccaagcatcaccttaacccccttgctgactcctacgtcctgaagcaagaaattcaggagggcaaggataaactcttagagaaaagggccctcccccattcccacatgcctagcttcctggctgacttctactcgtcccctcatctccatagcctctacagacacaccgagcaccatcttcataatgaacagacatccaaatacccttccagggacatgtacagggaatcggaaaacagttcttttccttcccacagacaccaagaaaagctccatgtaaattatctcacgtccctgcacctgcaagacaaaaagtcggcggcagcagaagcccctacggatgatcagcctacagatctgagccttcccaagaacccgcacaaacctaccggcaaggtcctgggcctggctcattccaccacagggccccaggagagcaaaggcatctcccagttccaggtcttaggcagccagagtcgagactgtcaccccaaagcctgtcgggtatcacccatgaccatgtcaggccctaaaaaataccctgaatcgctttcaagatcaggaaaacctcaccatgtgagactggagaatttcaggaagatggaaggcatggtccacccaatcctgcaccggaaaatgagcccgcagaacattggggcggcgcggccgatcaagcgcagcctggaggatttggaccttgtgattgcagggaaaaaggcccgggcagtgtctcccttagacccatccaaggaggtctctgggaaggagaaggcctctgagcaggagagtgaaggcagcaaagcagcgcacggtgggcattccgggggcggatcagaaggccacaagcttcccctctcctcccctatcttcccaggtctgtattccgggagcctgtgtaactcgggcctcaactccaggctcccggctgggtattctcattctctgcagtacttgaaaaaccagactgtgctttctccactcatgcagcccctggctttccactcgcttgtgatgcaaagaggaatttttacatcaccgacaaattctcagcagctgtacagacacttggctgcggctacacctgtaggaagttcatatggggaccttttgcataacagcatttaccctttagctgctataaatcctcaagctgcctttccatcttcccagctgtcatccgtgcaccccagtacaaaactgtaggctcagctctgcccagcagtccaaagcggcatggccaacagagcttcactccttacccaggagtgctggcttatagagttagaagtcagtatttcttctaatctgaggctatgatcagtcccagctgtaggggcccagaggggaggtgaacatgcctgatttttgtgggacaactctagcccacaaactgactggctggtgagtcttgactcccttccaacacagatgcccaggcacctccagatcattcacttcgcacgtgggccttgtgaagggatttgtgaatatccaggaagaacttagaggaccccatctgagttcggatggtcaggaaacaatctgggcaaaaaagaggcaggcatttcaaaggaaggggcaaggaagactggcaaacagatggcaagggatgcccctctttttcataaaactctccaaggttcaatcaatgcaatgtatagtgaaacttcaatagatctttcattttgacactattaaacaatccagagaagtaaacactgttaaattgactgtatatatttgcttcttaaaactacctgtatcactgtttgctcacctaatttatatacaggtagttccattttctcccagttccttctcgtctttttttttttttttttttttttttttattaaatggtattgcttttgtttgcaggtctttttgtttttgttttgtttttgaggctgactgactgtcctagttgttgtgtgtttgtaatttttccacatcttattttgagcagctttgggtggtaaagttattgtttacaaattgaagcaactgattctagtggaacaaatgaaaaagaaacagtcaagcacacaatagtgcaaagaacgttcctttgtagatccgcaacttaaggattttgttcctcataaatggcatagttgaaagagcttatacactgcttacccagccaaatgctttgctttgaagtattgggttctgtgaaaatattgagcattgtacttaccttatctaggctgtgaaactgtcctacataccagagaatcataaaaacaaaaacctcactggcagcaagctgccgaataacaacagagtctagaggacatatttgtgggctgcacagatattttaggaatttcagaaattagaacaggagccaaaatgatttacattggcgttggcactgattcctttaaatggtctgggaaagggggttgggaagaggatggagctcaactggccagaagaggagcagctgcagtcctgatagcttctctagcctcggtcttttgagtgataagtagtcatgttgttttcatccagttggtttcttgtcattcccaagaagaatctcccaggccacatctttggggataactgacatactggattagccttttcaaaagaaaagtcatcctatttggttttatggggtgtgagttttgtgtgtacacacacagaaacatgtaaggtggtttgggtcatgtttttaaccacctggcaatacagtccactttctggtttcttttattgtgggaagtaaatggtcaagctgctcaggcagtgaaaagatgtggagaatgtccgttgtcattcttgccactgtattccatttgctaccgagatataacattaaggtggacacattttctaactgtattaattaaaagtcaatggatacagagagtggattttctccccaagtcccatccctgctgaagaccgcttggatgaactccccaacccactgtgcccctcccgcaacactaccagtagactttagaaccatagttaactaagtcttttacctctgagatacttaattctgggaaaattggtgacaattttcaacttctaaataggtaactcgactgcaaaataatcaaaactgataacaatgaaactgcggctcttaaacaaagccatgcatgccgtgcatttgtattgaaatgtctccatgatatgaagccaaatattcaatgtaacatacttaatatccaaaggtggaaacaaaagaatgtagagatccagtgttaagagttccatttgcttcaattaattatttaccttcctgtggaataatatatatatatatatttaatagaaccatagatagactagtagaatttagattataaatgtgtgagtgcagattatcctgctattgcacaagctagaggggggaaaaatctcaattccagctggcaagatgctagccaggacacatataagaaagttgcactagattgaatggtcacagaatcggaggacatggaagaaaaaggaaacttcggtggttctgcagcagacatgggctaggtcatatgtggtttctatgagttcgtgtctcaaaaaaaaaaggagggggggcatctgtccccggtggagctcacctatttggaatatggggcatttgttttttccactgcaatgatttcagtctggtttcatcatgttggaattcgatcacaccattttcaaacaatgttaacatagtccagcttttgtttttctcatctcttctgagaggagactcactgtttctgtctgaggaagctcataccctcggcaaaacatcaggacaaataaagagaaatgggggtacgcattcccaacagaagcagtgtgttatttgttttaaaactctgaacagagatcttggaaatctttcaaaaagaccattgaattcttcattggctgagaacgacgttttaaaatgtcttaaataaggctttgtttgcattgtttgagttcaaggggccttattattgaatggaattgcacaagcctttctttgtgcaatcaaaccattgttattggtagttctgtaaaggaaactgtggaatcgaattggcagtggagtcataaatctatttactgagtgtggcttccaagaaatgttgcaattcaaaatgcactaagtctgtgatttattggagatttggagattctaaataatatttttaaaaaacttccatgcaacttctggtttaatgtttggcaactccacatgataaaaaaataaaaacagcccaaccgagtttcggaattaagtattcttctagtaagtgattcaaacttgtaatatttgccacaggactgacttatttatttactagctagaagctcttaagttcacttgtttatcagggcatatacagaagggtttgttaaaactcgatgttaactttacaactttctgacctggtgcatgaattctcaagtactgtatttcactgtgttggtgtgtctgatggaaatttcgaggtggtcccacaaaaatattttatgtagtgtgccttcaaagagaaccatttatttctcttcacttatcgtcccacaaagtcacatttggtggtggtcagccaagtcgcatctggtctagttttactcttgtcccaattttaaagagaaatgggaatgagtttgccctggtgagacccataccattgcaatgattatcttgagcacttaaagtccagtgttggctgttagtgtatttgatattctgcctgtctcctcatggttgaaatatgtctgaagaatagcagcataatctcttggctgtttatacttttttaaactttcctgtgttgtaaatattgtatacttttggtgattccagctatgtaacctctatgctctgtaaggtgattatttgtatatagcaacatggcccagtgatattatatagtttcccaatggagaggttattgagtaacctttgcattagtttaaacactaccagaagaatgctgagccaactataaacactcaattttgtatgttttccaaattgtacttattactgcttttgatactgtattacgtgccaatagtttcccaatcacatagcaggcaagagatattttgtactttttgatccactgtaatatttaataaaaaatgttactatctgtttc

SEQ ID NO: 109297 - DNA, 3141 bp, Homo sapiens
  Payload ID: 1470
  Gene Symbol: ARID5B
  Gene Name: AT rich interactive domain 5B (MRF1-like)
  Uniprot ID: Q14865
  ENST ID: ENST00000309334
  CDS Start-End: 270-3107
agagccctccctgccagtctggcaactccagcaaagtcctcaggctcatcccacacactcggtgctagtcactgctgtgtgtttacatgagtaatggagctgccgggggaggggagttgtaagcagagcgctgagcctcgcagctcgcattcggagggaagctgacatccacaccaagtcgagacttccagggatgtggccggggagcagtcacatgctgtagctttcatgagcacaggcatcagtcaggcagatgtttgtcgactggaatggcgccaaatcttaaaggcagaccacgcaaaaagaaaccatgcccacaaagaagagattcattcagtggtgttaaggattccaacaacaattccgatggcaaagccgttgccaaggtgaaatgtgaggccaggtcagccttgaccaagccgaagaataaccataactgtaaaaaagtctcaaatgaagaaaaaccaaaggttgccattggtgaagagtgcagggcagatgaacaagccttcttggtggcactttataaatacatgaaagaaaggaaaacgccgatagaacgaataccctatttaggttttaaacagattaacctttggactatgtttcaagctgctcaaaaactgggaggatatgaaacaataacagcccgccgtcagtggaaacatatttatgatgaattaggcggtaatcctgggagcaccagcgctgccacttgtacccgcagacattatgaaagattaatcctaccatatgaaagatttattaaaggagaagaagataagcccctgcctccaatcaaacctcggaaacaggagaacagttcacaggaaaatgagaacaaaacaaaagtatctggaaccaaacgcatcaaacatgaaatacctaaaagcaagaaagaaaaagaaaatgccccaaagccccaggatgcagcagaggtttcatcagagcaagaaaaagaacaagagactttaataagccagaaaagcatccctgagcctctcccagcagcagacatgaagaaaaaaatagaagggtatcaggaattttcagcgaagcccctggcatccagagtagacccagagaaggacaacgaaacagaccaaggttccaacagtgagaaggtggcagaggaggcgggagagaaggggcccacacctccactcccaagtgctcctctggccccagaaaaagattcagccttggtccctggggccagcaaacagccactcacctctcctagtgccctggtggactcaaaacaagaatccaaactgtgctgttttacagagagccctgaaagtgaaccccaagaagcatccttccccagcttccccaccacacagccaccgctggcaaaccagaatgagacggaggatgacaaactgcccgccatggcagattacattgccaactgcaccgtgaaggtggaccagctgggcagtgacgacatccacaatgcgctcaagcagaccccaaaggtccttgtggtccagtcgtttgacatgttcaaagacaaagacctgactgggcccatgaacgagaaccatggacttaattacacgcccctgctctactctaggggcaacccaggcatcatgtccccactggccaagaaaaagcttttgtcccaagtgagtggggccagcctctccagcagctacccttatggctccccaccccctttgatcagcaaaaagaaactgattgctagggatgacttgtgttccagtttgtcccagacccaccatggccaaagcactgaccatatggcggtcagccggccatcagtgattcagcacgtccagagtttcagaagcaagccctcggaagagagaaagaccatcaatgacatctttaagcatgagaaactgagtcgatcagatccccaccgctgcagcttctccaagcatcaccttaacccccttgctgactcctacgtcctgaagcaagaaattcaggagggcaaggataaactcttagagaaaagggccctcccccattcccacatgcctagcttcctggctgacttctactcgtcccctcatctccatagcctctacagacacaccgagcaccatcttcataatgaacagacatccaaatacccttccagggacatgtacagggaatcggaaaacagttcttttccttcccacagacaccaagaaaagctccatgtaaattatctcacgtccctgcacctgcaagacaaaaagtcggcggcagcagaagcccctacggatgatcagcctacagatctgagccttcccaagaacccgcacaaacctaccggcaaggtcctgggcctggctcattccaccacagggccccaggagagcaaaggcatctcccagttccaggtcttaggcagccagagtcgagactgtcaccccaaagcctgtcgggtatcacccatgaccatgtcaggccctaaaaaataccctgaatcgctttcaagatcaggaaaacctcaccatgtgagactggagaatttcaggaagatggaaggcatggtccacccaatcctgcaccggaaaatgagcccgcagaacattggggcggcgcggccgatcaagcgcagcctggaggatttggaccttgtgattgcagggaaaaaggcccgggcagtgtctcccttagacccatccaaggaggtctctgggaaggagaaggcctctgagcaggagagtgaaggcagcaaagcagcgcacggtgggcattccgggggcggatcagaaggccacaagcttcccctctcctcccctatcttcccaggtctgtattccgggagcctgtgtaactcgggcctcaactccaggctcccggctgggtattctcattctctgcagtacttgaaaaaccagactgtgctttctccactcatgcagcccctggctttccactcgcttgtgatgcaaagaggaatttttacatcaccgacaaattctcagcagctgtacagacacttggctgcggctacacctgtaggaagttcatatggggaccttttgcataacagcatttaccctttagctgctataaatcctcaagctgcctttccatcttcccagctgtcatccgtgcaccccagtacaaaactgtaggctcagctctgcccagcagtccaaagcggcatgg

SEQ ID NO: 109298 - DNA, 5070 bp, Homo sapiens
  Payload ID: 1471
  Gene Symbol: ATCAY
  Gene Name: ataxia, cerebellar, Cayman type
  Uniprot ID: Q86WG3
  ENST ID: ENST00000450849
  CDS Start-End: 468-1583
attctggcagggggctgtgcttttccgtcaggccgccaccccccaccccctcctccctgcacacaaaagcagcataaattaaccgtcttcgggaagccgagcctctgccagccctgagctgggaagaagcagctacctcggaggcagggcgcgcaggcgggcggcgatgagagggggcgcagccgcagccccgcgctggggagcccaccgctaaccctgcaccccacccacccctgcacaaaagagctggcgggcgctggccacgtcgccctgggtgaccttcctcggatgcagaatccgcccctgcgagcatcctcttcctcctaggctctgaaggcccggggagcgtgagcgatgcccagctgcacccgggcagggctcgcctttgtttgccagtaaggaggagaggctgtctcagctgcagaggggtcatccctgcttcaagccagtgcctcttcccagctcccatggggaccaccgaagccacgctccggatggaaaacgtggacgtgaaggaggaatggcaggacgaagatcttcccaggccactcccagaagagacgggggtggaactgcttggcagcccggtggaagacacatcctctcctcccaacacgctaaatttcaacggagcgcatcgtaagaggaagacgctggtggccccagagatcaacatttctctggatcagagtgaggggtccctgctgtccgatgacttcttggatacccctgatgacctggatattaacgtggatgacatcgagacccccgatgagaccgactcgctggagttcctggggaatggcaacgaactggagtgggaagacgacacccccgtggccaccgccaagaacatgcccggggacagcgcggatctatttggggacggcacgacggaggacggcagcgccgccaacgggcgcctgtggcggacagtgatcatcggggagcaagagcaccgtatagacctgcacatgatccggccttacatgaaagtggtcacccacggagggtactacggcgaaggcctcaacgccatcatcgtcttcgcagcctgcttccttccagacagcagcctccccgactaccactacatcatggagaacctcttcctgtacgtcatcagcagcttagagctcctggtggctgaggactacatgatcgtgtacctgaacggtgccacgccccggcggaggatgcctggaatcggctggctgaagaagtgctaccagatgatcgaccggaggttgcggaaaaacctgaagtccttgatcatcgtccacccctcgtggttcattcggactgtgctggccatctctcgccctttcatcagcgtcaagttcatcaacaagatccagtacgtgcacagcttggaagacctggagcaactcatccctatggaacacgtccagatcccagactgcgtcctgcaatacgaagaggaaagactgaaggccaggagggagagcgcgaggccccagccggagtttgtgctgcccaggtctgaagagaagccagaggtggcaccagtggaaaacaggtctgctctggtctcagaagatcaggaaacaagcatgtcctgaggcgacgtgagcataacaaaggacatggaagaagattccagatgccagaaaacctctgtcagacgcccactggccccagatctcatcctgcctcatcctgagtcccaatcttccaagggtgccagcccctccgttcatctctgaaacccagcatccttttcagctgcttgaaaacattgtattttttttttttaacgatgcagtatttgtgcgttccagaaaagggcccagctctgagcccctcacccttccacactcacgaactctcagccgaggaaggcaagaagcgcagggggtggcccgcgtggcgtcggtggcctccgctcctgctcgcagcctctgtggtcagagctggatacaagattcaagacccttctcttgcttgtcacccgctccaggttggagccacagacacccaccgccaccccggctgggtctgcgtcctttcctgtgcctttccctccagaatgcggcctcagacctagaagctcaacccccctatgagggccacgtcctggggtagctcctgacctccgaccttatgtccaaatttcacacccatggtttttcatttgacccgcccccttctcgctcataatgacacccagctcctttgagaggatcagagcccattgcacaagaagagccgctgccaaccatccttgtcctccgattgcaaaatgacaccccagtaatctagaacattctcaagcccctttaactcagatgtcaagccaccgggcaaaccccgtcaatacctcccaccaaggaatgagatatgtggacctcactgctcccccaacccagcgtcaggctgggacacgccaacgctgttccgggttggaacagcagaggctcagaaactggctctgaaataggcagacctagcaagaggaagatacagggtatcgggcgtttgagtgtttcagaagtcattcgggaagataaatccagtgcgctggccgcagccacctgcattcaaagcttggaccagcgggttcttgttcgggaggcaaatttccctaggaaaaagaagacagacttttctaatgtggtccaaatgcggatcactggtcagatggactctagaagcactgagctccctgtctctggaagtatttaagaaaaggctgggccaggcacgatggctcacgcctgtaatcccagactttgggaggccgaggcaggcggatcacctgaggtgaggagtttgagaacagcctggccaacatggtgaaacctcatctctactaaaaatacaaaaattagccaggcgtggtggcaggtgcctgtaatcccagctacttgggaggctgaggcatgagaatcacttaaacctgagaggcagaggttacagtgagccaagatcgtgccactgcattccagcctgggcgacagagcaagactctgtctcaaaaaaaataaaaaataatcagggcacagtggctcatgcctgtaatcccagcactctgggaggctgaggtgggtggatcacctgaggtcaggagttcaagaccagcctggtgaacatggcgaaaccccgtctctaataaaaatacaaaaattagccgggcatggtggtgcatgcctgtaatcccagctactcgggaggctgaggcaggagaactgcttgaacccaggaggcagaggttgcagtgatccaagatcatgccactgcactccagcctgggcaacaagagcaaaactccgtctcaaaataaaaagaaaagaaaagaatggacagtgtttgcagagagttgctcacgagtttccctctaatcctaaatgtcttcatgtctatcagtctgagcagacggtgagtagggcgggcacattctccaggcccttcttcctagctctgtggttgacctctcagcaagtgctatccaggctgggccaaccagacccacaattaactgagcctcagtgaaagcgtccagtgcatcttgacctgagacagcaaggaattgcatttggggttattccaacgatgatggcagggaactggtggtatttagtgctgaggggcagtgatacagaaagatttgccctgtgggacagggtcctgcgcgagtcccatccccaaaagccagcagctcctgccatgaggaagacggggtttctgagcaggcttatgcctgcaggttcctgtggagccaccggctgtgacgggacacctctgggtctcagcattgccctggggaggctgggacatttagggacatggtagggttttaacatttgtttcccaaatgtcaaatcccgggcacaggggcaagaccctgtcccgaattcccaccccagtgaatggtgtcgctgccaaagccaacacaagatgacaaaagtggctgggtacggtggctcacgcctataatcccagcactttgggagaccgagacaggtggatcacctgaggtcaggagttcgagaccaggctggccaacatggtgaaaccccatctctactaaaaatacaaaaattagctgggtgtggtggcgcgcacctgtagtcccagctactcaggaggctgaggtagaagaatagctggaacccaggaggcagagattgcagtcagccgagattgcaccactgcactccagcctgggagacagagcaagactgactcaaaagaaaaaaaatgacagaagcctgattatcagactgcccggaggagacaggctccagcagatagatgccagccaggcccagctgccacgatttgtcccaggtgaccaaaggcacgcagctccagcatgaatcgttctaacccaacagtgacaagaactgctgggccttaaccgtcatggaagactggggccgcttccaagtcacagacaggagacggggacaggaaagaactcattccacccaatcggacacctaataattgagtgtctacagcagcaatcaagtgacaagtgaggccctacctgacccagaaggtgcctgccggctaaacattctgcccccaccagaaactccagggggtccgcccgttatgccgtggcccacccacgcccctttggatcaccagcagtcacagacaacaggcaggcgaaactgaagaccccaactcagccccagcggaccctccagagcaaaagaggcccccggcgaggccacctgtcggcaggcatgccgaggtcaaacagccggggccaccgttcccagctgggccacgacctgcaccgtccacagatgggctttgagatggatttgtatcagggtggggggtgtggtttggccaaaatgcaatggaccccgacccctcctcgtaaaaggatgttgggtttccctctggtgacacatgggatgcgtcataaaccctcccccaaagtcctggtcagcagcccatccttccaacgatgagttttgcggtttttcagaacagaaatgatcactacgattgacgacggtcgtgatgttaagacgtcgtctccatgagctttggggggacttttatgtggaataaagaaactatcactga

SEQ ID NO: 109299 - DNA, 2904 bp, Homo sapiens
  Payload ID: 1471
  Gene Symbol: ATCAY
  Gene Name: ataxia, cerebellar, Cayman type
  Uniprot ID: Q86WG3
  ENST ID: ENST00000600960
  CDS Start-End: 1-1134
atggggaccaccgaagccacgctccggatggaaaacgtggacgtgaaggaggaatggcaggacgaagatcttcccaggccactcccagaagagacgggggtggaactgcttggcagcccggtggaagacacatcctctcctcccaacacgctaaatttcaacggagcgcatcgtaagaggaagacgctggtggccccagagatcaacatttctctggatcagagtgaggggtccctgctgtccgatgacttcttggatacccctgatgacctggatattaacgtggatgacatcgagacccccgatgagaccgactcgctggagttcctggggaatggcaacgaactggagtgggaagacgacacccccgtggccaccgccaagaacatgcccggggacagcgcggatctatttggggacggcacgacggaggacggcagcgccgccaacgggcgcctgtggcggacagtgatcatcggggagcaagagcaccgtatagacctgcacatgatccggccttacatgaaagtggtcacccacggagggtactacggcgaaggcctcaacgccatcatcgtcttcgcagcctgcttccttccagacagcagcctccccgactaccactacatcatggagaacctcttcctgtacgtcatcagcagcttagagctcctggtggctgaggactacatgatcgtgtacctgaacggtgccacgccccggcggaggatgcctggaatcggctggctgaagaagtgctaccagatgatcgaccggaggttgcggaaaaacctgaagtccttgatcatcgtccacccctcgtggttcattcggactgtgctggccatctctcgccctttcatcagcgtcaagttcatcaacaagatccagtacgtgcacagcttggaagacctggagcaactcatccctatggaacacgtccagatcccagactgcgtcctgcaatacgaagaggaaagactgaaggccaggagggagagcgcgaggccccagccggagtttgtgctgcccaggtctgaagagaagccagaggtggcaccagtggaaaacaggtctgctctggtctcagaagatcaggaaacaagcctccagcccctgcacagatcaagctgatgccacgtggcccaagttccaaccctaagtcacgttcatgtcctgaggcgacgtgagcataacaaaggacatggaagaagattccagatgccagaaaacctctgtcagacgcccactggccccagatctcatcctgcctcatcctgagtcccaatcttccaagggtgccagcccctccgttcatctctgaaacccagcatccttttcagctgcttgaaaacattgtattttttttttttaacgatgcagtatttgtgcgttccagaaaagggcccagctctgagcccctcacccttccacactcacgaactctcagccgaggaaggcaagaagcgcagggggtggcccgcgtggcgtcggtggcctccgctcctgctcgcagcctctgtggtcagagctggatacaagattcaagacccttctcttgcttgtcacccgctccaggttggagccacagacacccaccgccaccccggctgggtctgcgtcctttcctgtgcctttccctccagaatgcggcctcagacctagaagctcaacccccctatgagggccacgtcctggggtagctcctgacctccgaccttatgtccaaatttcacacccatggtttttcatttgacccgcccccttctcgctcataatgacacccagctcctttgagaggatcagagcccattgcacaagaagagccgctgccaaccatccttgtcctccgattgcaaaatgacaccccagtaatctagaacattctcaagcccctttaactcagatgtcaagccaccgggcaaaccccgtcaatacctcccaccaaggaatgagatatgtggacctcactgctcccccaacccagcgtcaggctgggacacgccaacgctgttccgggttggaacagcagaggctcagaaactggctctgaaataggcagacctagcaagaggaagatacagggtatcgggcgtttgagtgtttcagaagtcattcgggaagataaatccagtgcgctggccgcagccacctgcattcaaagcttggaccagcgggttcttgttcgggaggcaaatttccctaggaaaaagaagacagacttttctaatgtggtccaaatgcggatcactggtcagatggactctagaagcactgagctccctgtctctggaagtatttaagaaaaggctgggccaggcacgatggctcacgcctgtaatcccagactttgggaggccgaggcaggcggatcacctgaggtgaggagtttgagaacagcctggccaacatggtgaaacctcatctctactaaaaatacaaaaattagccaggcgtggtggcaggtgcctgtaatcccagctacttgggaggctgaggcatgagaatcacttaaacctgagaggcagaggttacagtgagccaagatcgtgccactgcattccagcctgggcgacagagcaagactctgtctcaaaaaaaataaaaaataatcagggcacagtggctcatgcctgtaatcccagcactctgggaggctgaggtgggtggatcacctgaggtcaggagttcaagaccagcctggtgaacatggcgaaaccccgtctctaataaaaatacaaaaattagccgggcatggtggtgcatgcctgtaatcccagctactcgggaggctgaggcaggagaactgcttgaacccaggaggcagaggttgcagtgatccaagatcatgccactgcactccagcctgggcaacaagagcaaaactccgtctcaaaataaaaa

SEQ ID NO: 109300 - DNA, 530 bp, Homo sapiens
  Payload ID: 1471
  Gene Symbol: ATCAY
  Gene Name: ataxia, cerebellar, Cayman type
  ENST ID: ENST00000598136
  CDS Start-End: 233-530
gttcccacagcagccctgcaaagtgagtgtgcctgagaaacttccgcctcccctgcacccagccctgtttagggcacgaggctgaatcaatggctctgaaggcccggggagcgtgagcgatgcccagctgcacccgggcagggctcgcctttgtttgccagtaaggaggagaggctgtctcagctgcagaggggtcatccctgcttcaagccagtgcctcttcccagctcccatggggaccaccgaagccacgctccggatggaaaacgtggacgtgaaggaggaatggcaggacgaagatcttcccaggccactcccagaagagacgggggtggaactgcttggcagcccggtggaagacacatcctctcctcccaacacgctaaatttcaacggagcgcatcgtaagaggaagacgctggtggccccagagatcaacatttctctggatcagagtgaggggtccctgctgtccgatgacttcttggatacccctgatgacctggatattaacgtggatgacatcgaga

SEQ ID NO: 109301 - DNA, 1957 bp, Homo sapiens
  Payload ID: 1471
  Gene Symbol: ATCAY
  Gene Name: ataxia, cerebellar, Cayman type
  ENST ID: ENST00000597739
  CDS Start-End: 366-590
ctctgccagccctgagctgggaagaagcagctacctcggaggcagggcgcgcaggcgggcggcgatgagagggggcgcagccgcagccccgcgctggggagcccaccgctaaccctgcaccccacccacccctgcacaaaagagctggcgggcgctggccacgtcgccctgggtgaccttcctcggatgcagaatccgcccctgcgagcatcctcttcctcctaggctctgaaggcccggggagcgtgagcgatgcccagctgcacccgggcagggctcgcctttgtttgccagtaaggaggagaggctgtctcagctgcagaggggtcatccctgcttcaagccagtgcctcttcccagctcccatggggaccaccgaagccacgctccggatggaaaacgtggacgtgaaggaggaatggcaggacgaagatcttcccagccaggaattgctttgcacaatcctgggaaccaccaagtccaaaatccacagggcaggctggaaactgtcaggccactcccagaagagacgggggtggaactgcttggcagcccggtggaagacacatcctctcctcccaacacgctaaatttcaacggagcgcatcgtaagaggaagacgctggtggccccagagatcaacatttctctggatcagagtgaggggtccctgctgtccgatgacttcttggatacccctgatgacctggatattaacgtggatgacatcgagacccccgatgagaccgactcgctggagttcctggggaatggcaacgaactggagtgggaagacgacacccccgtggccaccgccaagaacatgcccggggacagcgcggatctatttggggacggcacgacggaggacggcagcgccgccaacgggcgcctgtggcggacagtgatcatcggggagcaagagcaccgtatagacctgcacatgatccggccttacatgaaagtggtcacccacggagggtactacggcgaaggcctcaacgccatcatcgtcttcgcagcctgcttccttccagacagcagcctccccgactaccactacatcatggagaacctcttcctgtacgtcatcagcagcttagagctcctggtggctgaggactacatgatcgtgtacctgaacggtgccacgccccggcggaggatgcctggaatcggctggctgaagaagtgctaccagatgatcgaccggaggttgcggaaaaacctgaagtccttgatcatcgtccacccctcgtggttcattcggactgtgctggccatctctcgccctttcatcagcgtcaagttcatcaacaagatccagtacgtgcacagcttggaagacctggagcaactcatccctatggaacacgtccagatcccagactgcgtcctgcaatacgaagaggaaagactgaaggccaggagggagagcgcgaggccccagccggagtttgtgctgcccaggtctgaagagaagccagaggtggcaccagtggaaaacaggtctgctctggtctcagaagatcaggaaacaagcatgtcctgaggcgacgtgagcataacaaaggacatggaagaagattccagatgccagaaaacctctgtcagacgcccactggccccagatctcatcctgcctcatcctgagtcccaatcttccaagggtgccagcccctccgttcatctctgaaacccagcatccttttcagctgcttgaaaacattgtattttttttttttaacgatgcagtatttgtgcgttccagaaaagggcccagctctgagcccctcacccttccacactcacgaactctcagccgaggaaggcaagaagcgcagggggtggcccgcgtggcgtcggtggcctccgctcctgctcgcagcctctgtggtcagagctggatacaagattcaagacccttctcttgcttgtcacccgctccaggttggag

SEQ ID NO: 109302 - DNA, 10602 bp, Homo sapiens
  Payload ID: 1472
  Gene Symbol: ATXN1
  Gene Name: ataxin 1
  Uniprot ID: P54253
  ENST ID: ENST00000244769
  CDS Start-End: 938-3385
ctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagttttacctcacaaaaactactacaagcaccaagctccctgatggaaaggagcatcgtgcatcaagtcaccagggtggtccattcaagctgcagatttgtttgtcatccttgtacagcaatctcctcctccactgccactacagggaagtgcatcacatgtcagcatactggagcatagtgaaagagtctattttgaagcttcaaacttagtgctgctgcagaccaggaacaagagagaaagagtggatttcagcctgcacggatggtcttgaaacacaaatggtttttggtctaggcgttttacactgagattctccactgccaccctttctactcaagcaaaatcttcgtgaaaagatctgctgcaaggaactgatagcttatggttctccattgtgatgaaagcacatggtacagttttccaaagaaattagaccattttcttcgtgagaaagaaatcgacgtgctgttttcatagggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttcatccagagctgctgttggcggattgtacccacggggagatgattcctcatgaagagcctggatcccctacagaaatcaaatgtgactttccgtttatcagactaaaatcagagccatccagacagtgaaacagtcaccgtggaggggggacggcgaaaaatgaaatccaaccaagagcggagcaacgaatgcctgcctcccaagaagcgcgagatccccgccaccagccggtcctccgaggagaaggcccctaccctgcccagcgacaaccaccgggtggagggcacagcatggctcccgggcaaccctggtggccggggccacgggggcgggaggcatgggccggcagggacctcggtggagcttggtttacaacagggaataggtttacacaaagcattgtccacagggctggactactccccgcccagcgctcccaggtctgtccccgtggccaccacgctgcctgccgcgtacgccaccccgcagccagggaccccggtgtcccccgtgcagtacgctcacctgccgcacaccttccagttcattgggtcctcccaatacagtggaacctatgccagcttcatcccatcacagctgatccccccaaccgccaaccccgtcaccagtgcagtggcctcggccgcaggggccaccactccatcccagcgctcccagctggaggcctattccactctgctggccaacatgggcagtctgagccagacgccgggacacaaggctgagcagcagcagcagcagcagcagcagcagcagcagcagcatcagcatcagcagcagcagcagcagcagcagcagcagcagcagcagcagcacctcagcagggctccggggctcatcaccccggggtcccccccaccagcccagcagaaccagtacgtccacatttccagttctccgcagaacaccggccgcaccgcctctcctccggccatccccgtccacctccacccccaccagacgatgatcccacacacgctcaccctggggcccccctcccaggtcgtcatgcaatacgccgactccggcagccactttgtccctcgggaggccaccaagaaagctgagagcagccggctgcagcaggccatccaggccaaggaggtcctgaacggtgagatggagaagagccggcggtacggggccccgtcctcagccgacctgggcctgggcaaggcaggcggcaagtcggttcctcacccgtacgagtccaggcacgtggtggtccacccgagcccctcagactacagcagtcgtgatccttcgggggtccgggcctctgtgatggtcctgcccaacagcaacacgcccgcagctgacctggaggtgcaacaggccactcatcgtgaagcctccccttctaccctcaacgacaaaagtggcctgcatttagggaagcctggccaccggtcctacgcgctctcaccccacacggtcattcagaccacacacagtgcttcagagccactcccggtgggactgccagccacggccttctacgcagggactcaaccccctgtcatcggctacctgagcggccagcagcaagcaatcacctacgccggcagcctgccccagcacctggtgatccccggcacacagcccctgctcatcccggtcggcagcactgacatggaagcgtcgggggcagccccggccatagtcacgtcatccccccagtttgctgcagtgcctcacacgttcgtcaccaccgcccttcccaagagcgagaacttcaaccctgaggccctggtcacccaggccgcctacccagccatggtgcaggcccagatccacctgcctgtggtgcagtccgtggcctccccggcggcggctccccctacgctgcctccctacttcatgaaaggctccatcatccagttggccaacggggagctaaagaaggtggaagacttaaaaacagaagatttcatccagagtgcagagataagcaacgacctgaagatcgactccagcaccgtagagaggattgaagacagccatagcccgggcgtggccgtgatacagttcgccgtcggggagcaccgagcccaggtcagcgttgaagttttggtagagtatcctttttttgtgtttggacagggctggtcatcctgctgtccggagagaaccagccagctctttgatttgccgtgttccaaactctcagttggggatgtctgcatctcgcttaccctcaagaacctgaagaacggctctgttaaaaagggccagcccgtggatcccgccagcgtcctgctgaagcactcaaaggccgacggcctggcgggcagcagacacaggtatgccgagcaggaaaacggaatcaaccaggggagtgcccagatgctctctgagaatggcgaactgaagtttccagagaaaatgggattgcctgcagcgcccttcctcaccaaaatagaacccagcaagcccgcggcaacgaggaagaggaggtggtcggcgccagagagccgcaaactggagaagtcagaagacgaaccacctttgactcttcctaagccttctctaattcctcaggaggttaagatttgcattgaaggccggtctaatgtaggcaagtagaggcagcgtgggggaaaggaaacgtggctctcccttatcatttgtatccagattactgtactgtaggctaaaataacacagtatttacatgttatcttcttaattttaggtttctgttctaaccttgtcattagagttacagcaggtgtgtcgcaggagactggtgcatatgctttttccacgagtgtctgtcagtgagcgggcgggaggaagggcacagcaggagcggtcagggctccaggcatccccggggaagaaaggaacggggcttcacagtgcctgccttctctagcggcacagaagcagccgggggcgctgactcccgctagtgtcaggagaaaagtcccgtgggaagggtcctgcaggggtgcagggttgcacgcatgtgggggtgcacaggcgctgtggcggcgagtgagggtctctttttctctgcctccctctgcctcactctcttgctatcggcatgggccgggggggttcagagcagtgtcctcctggggttcccacgtgcaaaatcaacatcaggaacccagcttcagggcatcgcggagacgcgtcagatggcagatttggaaagttaaccatttaaaagaacatttttctctccaacatattttacaataaaagcaacttttaattgtatagatatatatttccccctatggggcctgactgcactgatatatattttttttaaagagcaactgccacatgcgggatttcatttctgctttttactagtgcagcgatgtcaccagggtgttgtggtggacagggaagcccctgctgtcatggccccacatggggtaaggggggttgggggtgggggagagggagagagcgaacacccacgctggtttctgtgcagtgttaggaaaaccaatcaggttattgcattgacttcactcccaagaggtagatgcaaactgcccttcagtgagagcaacagaagctcttcacgttgagtttgcgaaatctttttgtctttgaactctagtactgtttatagttcatgactatggacaactcgggtgccactttttttttttttcagattccagtgtgacatgaggaattagattttgaagatgagcatatattactatctttaagcatttaaaaatactgttcacactttattaccaagcatcttggtctctcattcaacaagtactgtatctcactttaaactctttggggaaaaaacaaaaacaaaaaaaactaagttgctttctttttttcaacactgtaactacatttcagctctgcagaattgctgaagagcaagatattgaaagtttcaatgtggtttaaagggatgaatgtgaattatgaactagtatgtgacaataaatgaccaccaagtactacctgacgggaggcacttttcactttgatgtctgagaatcagttcaaggcatatgcagagttggcagagaaactgagagaaaagggatggagaagagaatactcatttttgtccagtgtttttctttttaagatgaacttttaaagaaccttgcgatttgcacatattgagtttataacttgtgtgatattcctgcagtttttatccaataacattgtgggaaaggtttgggggactgaacgagcataaataaatgtagcaaaatttctttctaacctgcctaaactctaggccattttataaggttatgttcctttgaaaattcattttggtctttttaccacatctgtcacaaaaagccaggtcttagcgggctcttagaaactctgagaattttcttcagattcattgagagagttttccataaagacatttatatatgtgagcaagattttttttaaacaattactttattattgttgttattaatgttattttcagaatggcttttttttttctattcaaaatcaaatcgagatttaatgtttggtacaaacccagaaagggtatttcatagtttttaaacctttcattcccagagatccgaaatatcatttgtgggttttgaatgcatctttaaagtgctttaaaaaaaagttttataagtagggagaaatttttaaatattcttacttggatggctgcaactaaactgaacaaatacctgacttttcttttaccccattgaaaatagtactttcttcgtttcacaaattaaaaaaaaaatctggtatcaacccacattttggctgtctagtattcatttacatttagggttcaccaggactaatgatttttataaaccgttttctggggtgtaccaaaaacatttgaataggtttagaatagctagaatagttccttgactttcctcgaatttcattaccctctcagcatgcttgcagagagctgggtgggctcattcttgcagtcatactgcttatttagtgctgtattttttaaacgtttctgttcagagaacttgcttaatcttccatatattctgctcagggcacttgcaattattaggttttgtttttctttttgttttttagcctttgatggtaagaggaatacgggctgccacatagactttgttctcattaatatcactatttacaactcatgtggactcagaaaaacacacaccaccttttggcttacttcgagtattgaattgactggatccactaaaccaacactaagatgggaaaacacacatggtttggagcaataggaacatcatcataatttttgtggttctatttcaggtataggaattataaaataattggttctttctaaacacttgtcccatttcattctcttgcttttttagcatgtgcaatactttctgtgccaatagagtctgaccagtgtgctatatagttaaagctcattcccttttggctttttccttgtttggttgatcttccccattctggccagagcagggctggagggaaggagccaggagggagagagcctcccacctttcccctgctgcggatgctgagtgctggggcggggagccttcaggagccccgtgcgtctgccgccacgttgcagaaagagccagccaaggagacccgggggaggaaccgcagtgtcccctgtcaccacacggaatagtgaatgtggagtgtggagaggaaggaggcagattcatttctaagacgcactctggagccatgtagcctggagtcaacccattttccacggtcttttctgcaagtgggcaggcccctcctcggggtctgtgtccttgagacttggagccctgcctctgagcctggacgggaagtgtggcctgttgtgtgtgtgcgttctgagcgtgttggccagtggctgtggaggggaccacctgccacccacggtcaccactcccttgtggcagctttctcttcaaataggaagaacgcacagagggcaggagcctcctgtttgcagacgttggcgggccccgaggctcccagagcagcctctgtcaccgcttctgtgtagcaaacattaacgatgacaggggtagaaattcttcggtgccgttcagcttacaaggatcagccatgtgcctctgtactatgtccactttgcaatatttaccgacagccgtcttttgttctttctttcctgttttccatttttaaactagtaacagcaggccttttgcgtttacaatggaacacaatcaccaagaaattagtcagggcgaaaagaaaaaaataatactattaataagaaaccaacaaacaagaacctctctttctagggatttctaaatatataaaatgactgttccttagaatgtttaacttaagaattatttcagtttgtctgggccacactggggcagaggggggagggagggatacagagatggatgccacttacctcagatcttttaaagtggaaatccaaattgaattttcatttggactttcaggataattttctatgttggtcaacttttcgttttccctaactcacccagtttagtttgggatgatttgatttctgttgttgttgatcccatttctaacttggaattgtgagcctctatgttttctgttaggtgagtgtgttgggttttttccccccaccaggaagtggcagcatccctccttctcccctaaagggactctgcggaacctttcacacctctttctcagggacggggcaggtgtgtgtgtggtacactgacgtgtccagaagcagcactttgactgctctggagtagggttgtacaatttcaaggaatgtttggatttcctgcatcttgtggattactccttagataccgcatagattgcaatataatgctgcatgttcaagatgaacagtagctcctagtaatcataaaatccactctttgcacagtttgatctttactgaaatatgttgccaaaatttatttttgttgttgtagctctggattttgttttgttttgttttttaaggaaacgattgacaataccctttaacatctgtgactactaaggaaacctatttctttcatagagagaaaaatctccaatgcttttgaagacactaataccgtgctatttcagatatgggtgaggaagcagagctctcggtaccgaaggccgggcttcttgagctgtgttggttgtcatggctactgtttcatgaaccacaagcagctcaacagactggtctgttgccttctgaaaccctttgcacttcaatttgcaccaggtgaaaacagggccagcagactccatggcccaattcggtttcttcggtggtgatgtgaaaggagagaattacactttttttttttttaagtggcgtggaggcctttgcttccacatttgtttttaacccagaatttctgaaatagagaatttaagaacacatcaagtaataaatatacagagaatatacttttttataaagcacatgcatctgctattgtgttgggttggtttcctctcttttccacggacagtgttgtgtttctggcatagggaaactccaaacaacttgcacacctctactccggagctgagatttcttttacatagatgacctcgcttcaaatacgttaccttactgatgataggatcttttcttgtagcactataccttgtgggaatttttttttaaatgtacacctgatttgagaagctgaagaaaacaaaattttgaagcactcactttgaggagtacaggtaatgttttaaaaaattgcacaaaagaaaaatgaatgtcgaaatgattcattcagtgtttgaaagatatggctctgttgaaacaatgagtttcatactttgtttgtaaaaaaaaaaaagcagagaagggttgaaagttacatgtttttttgtatatagaaatttgtcatgtctaaatgatcagatttgtatggttatggcctggaagaattactacgtaaaaggctcttaaactatacctatgcttattgttatttttgttacatatagccctcgtctgagggaggggaactcggtattctgcgatttgagaatactgttcattcctatgctgaaagtacttctctgagctcccttcttagtctaaactcttaagccattgcaacttctttttcttcagagatgatgtttgacattttcagcacttcctgttcctataaacccaaagaatataatcttgaacacgaagtgtttgtaacaagggatccaggctaccaatcaaacaggactcattatggggacaaaaaaaaaaattatttcaccttctttccccccacacctcatttaaatggggggagtaaaaacatgatttcaatgtaaatgcctcattttattttagttttattttgatttttatttaatataaagaggccagaataaatacggagcatcttctcagaatagtattcctgtccaaaaatcaagccggacagtggaaactggacagctgtggggatattaagcacccccacttacaattcttaaattcagaatctcgtcccctcccttctcgttgaaggcaactgttctggtagctaactttctcctgtgtaatggcgggagggaacaccggcttcagtttttcatgtccccatgacttgcatacaaatggttcaactgtattaaaattaagtgcatttggccaataggtagtatctatacaataacaacaatctctaagaatttccataacttttcttatctgaaaggactcaagtcttccactgcagatacattggaggcttcacccacgttttctttccctttagtttgtttgctgtctggatggccaatgagcctgtctccttttctgtggccaatctgaaggccttcgttggaagtgttgtttacagtaatccttaccaagataacatactgtcctccagaataccaagtattaggtgacactagctcaagctgttgtcttcagagcagttaccaagaagctcggtgcacaggttttctctggttcttacaggaaccacctactctttcagttttctggcccaggagtggggtaaatcctttagttagtgcatttgaacttgatacctgtgcattcagttctgtgaatactgccctttttggcggggtttcctcatctccccagcctgaactgctcaactctaaacccaaattagtgtcagccgaaaggaggtttcaagatagtcctgtcagtatttgtggtgaccttcagattagacagtcttcatttccagccagtggagtcctggctccagagccatctctgagactcgtactactggatgttttaatatcagatcattacccaccatatgcctcccacaggccaagggaaaacagacaccagaacttgggttgagggcactaccagactgacatggccagtacagaggagaactagggaaggaatgatgttttgcaccttattgaaaagaaaattttaagtgcatacataatagttaagagcttttattgtgacaggagaacttttttccatatgcgtgcatactctctgtaattccagtgtaaaatattgtacttgcactagcttttttaaacaaatattaaaaaatggaagaattcatattctattttctaatcgtggtgtgtctatttgtaggatacactcgagtctgtttattgaattttatggtccctttctttgatggtgcttgcaggttttctaggtagaaattatttcattattataataaaacaatgtttgattcaaaatttgaacaaaattgttttaaataaattgtctgtataccagtacaagtttattgtttcagtatactcgtactaataaaataacagtgccaattgca

SEQ ID NO: 109303 - DNA, 10587 bp, Homo sapiens
  Payload ID: 1472
  Gene Symbol: ATXN1
  Gene Name: ataxin 1
  Uniprot ID: P54253
  ENST ID: ENST00000436367
  CDS Start-End: 923-3370
gaggagagagcagagtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagagcatcgtgcatcaagtcaccagggtggtccattcaagctgcagatttgtttgtcatccttgtacagcaatctcctcctccactgccactacagggaagtgcatcacatgtcagcatactggagcatagtgaaagagtctattttgaagcttcaaacttagtgctgctgcagaccaggaacaagagagaaagagtggatttcagcctgcacggatggtcttgaaacacaaatggtttttggtctaggcgttttacactgagattctccactgccaccctttctactcaagcaaaatcttcgtgaaaagatctgctgcaaggaactgatagcttatggttctccattgtgatgaaagcacatggtacagttttccaaagaaattagaccattttcttcgtgagaaagaaatcgacgtgctgttttcatagggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttcatccagagctgctgttggcggattgtacccacggggagatgattcctcatgaagagcctggatcccctacagaaatcaaatgtgactttccgtttatcagactaaaatcagagccatccagacagtgaaacagtcaccgtggaggggggacggcgaaaaatgaaatccaaccaagagcggagcaacgaatgcctgcctcccaagaagcgcgagatccccgccaccagccggtcctccgaggagaaggcccctaccctgcccagcgacaaccaccgggtggagggcacagcatggctcccgggcaaccctggtggccggggccacgggggcgggaggcatgggccggcagggacctcggtggagcttggtttacaacagggaataggtttacacaaagcattgtccacagggctggactactccccgcccagcgctcccaggtctgtccccgtggccaccacgctgcctgccgcgtacgccaccccgcagccagggaccccggtgtcccccgtgcagtacgctcacctgccgcacaccttccagttcattgggtcctcccaatacagtggaacctatgccagcttcatcccatcacagctgatccccccaaccgccaaccccgtcaccagtgcagtggcctcggccgcaggggccaccactccatcccagcgctcccagctggaggcctattccactctgctggccaacatgggcagtctgagccagacgccgggacacaaggctgagcagcagcagcagcagcagcagcagcagcagcagcagcatcagcatcagcagcagcagcagcagcagcagcagcagcagcagcagcagcacctcagcagggctccggggctcatcaccccggggtcccccccaccagcccagcagaaccagtacgtccacatttccagttctccgcagaacaccggccgcaccgcctctcctccggccatccccgtccacctccacccccaccagacgatgatcccacacacgctcaccctggggcccccctcccaggtcgtcatgcaatacgccgactccggcagccactttgtccctcgggaggccaccaagaaagctgagagcagccggctgcagcaggccatccaggccaaggaggtcctgaacggtgagatggagaagagccggcggtacggggccccgtcctcagccgacctgggcctgggcaaggcaggcggcaagtcggttcctcacccgtacgagtccaggcacgtggtggtccacccgagcccctcagactacagcagtcgtgatccttcgggggtccgggcctctgtgatggtcctgcccaacagcaacacgcccgcagctgacctggaggtgcaacaggccactcatcgtgaagcctccccttctaccctcaacgacaaaagtggcctgcatttagggaagcctggccaccggtcctacgcgctctcaccccacacggtcattcagaccacacacagtgcttcagagccactcccggtgggactgccagccacggccttctacgcagggactcaaccccctgtcatcggctacctgagcggccagcagcaagcaatcacctacgccggcagcctgccccagcacctggtgatccccggcacacagcccctgctcatcccggtcggcagcactgacatggaagcgtcgggggcagccccggccatagtcacgtcatccccccagtttgctgcagtgcctcacacgttcgtcaccaccgcccttcccaagagcgagaacttcaaccctgaggccctggtcacccaggccgcctacccagccatggtgcaggcccagatccacctgcctgtggtgcagtccgtggcctccccggcggcggctccccctacgctgcctccctacttcatgaaaggctccatcatccagttggccaacggggagctaaagaaggtggaagacttaaaaacagaagatttcatccagagtgcagagataagcaacgacctgaagatcgactccagcaccgtagagaggattgaagacagccatagcccgggcgtggccgtgatacagttcgccgtcggggagcaccgagcccaggtcagcgttgaagttttggtagagtatcctttttttgtgtttggacagggctggtcatcctgctgtccggagagaaccagccagctctttgatttgccgtgttccaaactctcagttggggatgtctgcatctcgcttaccctcaagaacctgaagaacggctctgttaaaaagggccagcccgtggatcccgccagcgtcctgctgaagcactcaaaggccgacggcctggcgggcagcagacacaggtatgccgagcaggaaaacggaatcaaccaggggagtgcccagatgctctctgagaatggcgaactgaagtttccagagaaaatgggattgcctgcagcgcccttcctcaccaaaatagaacccagcaagcccgcggcaacgaggaagaggaggtggtcggcgccagagagccgcaaactggagaagtcagaagacgaaccacctttgactcttcctaagccttctctaattcctcaggaggttaagatttgcattgaaggccggtctaatgtaggcaagtagaggcagcgtgggggaaaggaaacgtggctctcccttatcatttgtatccagattactgtactgtaggctaaaataacacagtatttacatgttatcttcttaattttaggtttctgttctaaccttgtcattagagttacagcaggtgtgtcgcaggagactggtgcatatgctttttccacgagtgtctgtcagtgagcgggcgggaggaagggcacagcaggagcggtcagggctccaggcatccccggggaagaaaggaacggggcttcacagtgcctgccttctctagcggcacagaagcagccgggggcgctgactcccgctagtgtcaggagaaaagtcccgtgggaagggtcctgcaggggtgcagggttgcacgcatgtgggggtgcacaggcgctgtggcggcgagtgagggtctctttttctctgcctccctctgcctcactctcttgctatcggcatgggccgggggggttcagagcagtgtcctcctggggttcccacgtgcaaaatcaacatcaggaacccagcttcagggcatcgcggagacgcgtcagatggcagatttggaaagttaaccatttaaaagaacatttttctctccaacatattttacaataaaagcaacttttaattgtatagatatatatttccccctatggggcctgactgcactgatatatattttttttaaagagcaactgccacatgcgggatttcatttctgctttttactagtgcagcgatgtcaccagggtgttgtggtggacagggaagcccctgctgtcatggccccacatggggtaaggggggttgggggtgggggagagggagagagcgaacacccacgctggtttctgtgcagtgttaggaaaaccaatcaggttattgcattgacttcactcccaagaggtagatgcaaactgcccttcagtgagagcaacagaagctcttcacgttgagtttgcgaaatctttttgtctttgaactctagtactgtttatagttcatgactatggacaactcgggtgccactttttttttttttcagattccagtgtgacatgaggaattagattttgaagatgagcatatattactatctttaagcatttaaaaatactgttcacactttattaccaagcatcttggtctctcattcaacaagtactgtatctcactttaaactctttggggaaaaaacaaaaacaaaaaaaactaagttgctttctttttttcaacactgtaactacatttcagctctgcagaattgctgaagagcaagatattgaaagtttcaatgtggtttaaagggatgaatgtgaattatgaactagtatgtgacaataaatgaccaccaagtactacctgacgggaggcacttttcactttgatgtctgagaatcagttcaaggcatatgcagagttggcagagaaactgagagaaaagggatggagaagagaatactcatttttgtccagtgtttttctttttaagatgaacttttaaagaaccttgcgatttgcacatattgagtttataacttgtgtgatattcctgcagtttttatccaataacattgtgggaaaggtttgggggactgaacgagcataaataaatgtagcaaaatttctttctaacctgcctaaactctaggccattttataaggttatgttcctttgaaaattcattttggtctttttaccacatctgtcacaaaaagccaggtcttagcgggctcttagaaactctgagaattttcttcagattcattgagagagttttccataaagacatttatatatgtgagcaagattttttttaaacaattactttattattgttgttattaatgttattttcagaatggcttttttttttctattcaaaatcaaatcgagatttaatgtttggtacaaacccagaaagggtatttcatagtttttaaacctttcattcccagagatccgaaatatcatttgtgggttttgaatgcatctttaaagtgctttaaaaaaaagttttataagtagggagaaatttttaaatattcttacttggatggctgcaactaaactgaacaaatacctgacttttcttttaccccattgaaaatagtactttcttcgtttcacaaattaaaaaaaaaatctggtatcaacccacattttggctgtctagtattcatttacatttagggttcaccaggactaatgatttttataaaccgttttctggggtgtaccaaaaacatttgaataggtttagaatagctagaatagttccttgactttcctcgaatttcattaccctctcagcatgcttgcagagagctgggtgggctcattcttgcagtcatactgcttatttagtgctgtattttttaaacgtttctgttcagagaacttgcttaatcttccatatattctgctcagggcacttgcaattattaggttttgtttttctttttgttttttagcctttgatggtaagaggaatacgggctgccacatagactttgttctcattaatatcactatttacaactcatgtggactcagaaaaacacacaccaccttttggcttacttcgagtattgaattgactggatccactaaaccaacactaagatgggaaaacacacatggtttggagcaataggaacatcatcataatttttgtggttctatttcaggtataggaattataaaataattggttctttctaaacacttgtcccatttcattctcttgcttttttagcatgtgcaatactttctgtgccaatagagtctgaccagtgtgctatatagttaaagctcattcccttttggctttttccttgtttggttgatcttccccattctggccagagcagggctggagggaaggagccaggagggagagagcctcccacctttcccctgctgcggatgctgagtgctggggcggggagccttcaggagccccgtgcgtctgccgccacgttgcagaaagagccagccaaggagacccgggggaggaaccgcagtgtcccctgtcaccacacggaatagtgaatgtggagtgtggagaggaaggaggcagattcatttctaagacgcactctggagccatgtagcctggagtcaacccattttccacggtcttttctgcaagtgggcaggcccctcctcggggtctgtgtccttgagacttggagccctgcctctgagcctggacgggaagtgtggcctgttgtgtgtgtgcgttctgagcgtgttggccagtggctgtggaggggaccacctgccacccacggtcaccactcccttgtggcagctttctcttcaaataggaagaacgcacagagggcaggagcctcctgtttgcagacgttggcgggccccgaggctcccagagcagcctctgtcaccgcttctgtgtagcaaacattaacgatgacaggggtagaaattcttcggtgccgttcagcttacaaggatcagccatgtgcctctgtactatgtccactttgcaatatttaccgacagccgtcttttgttctttctttcctgttttccatttttaaactagtaacagcaggccttttgcgtttacaatggaacacaatcaccaagaaattagtcagggcgaaaagaaaaaaataatactattaataagaaaccaacaaacaagaacctctctttctagggatttctaaatatataaaatgactgttccttagaatgtttaacttaagaattatttcagtttgtctgggccacactggggcagaggggggagggagggatacagagatggatgccacttacctcagatcttttaaagtggaaatccaaattgaattttcatttggactttcaggataattttctatgttggtcaacttttcgttttccctaactcacccagtttagtttgggatgatttgatttctgttgttgttgatcccatttctaacttggaattgtgagcctctatgttttctgttaggtgagtgtgttgggttttttccccccaccaggaagtggcagcatccctccttctcccctaaagggactctgcggaacctttcacacctctttctcagggacggggcaggtgtgtgtgtggtacactgacgtgtccagaagcagcactttgactgctctggagtagggttgtacaatttcaaggaatgtttggatttcctgcatcttgtggattactccttagataccgcatagattgcaatataatgctgcatgttcaagatgaacagtagctcctagtaatcataaaatccactctttgcacagtttgatctttactgaaatatgttgccaaaatttatttttgttgttgtagctctggattttgttttgttttgttttttaaggaaacgattgacaataccctttaacatctgtgactactaaggaaacctatttctttcatagagagaaaaatctccaatgcttttgaagacactaataccgtgctatttcagatatgggtgaggaagcagagctctcggtaccgaaggccgggcttcttgagctgtgttggttgtcatggctactgtttcatgaaccacaagcagctcaacagactggtctgttgccttctgaaaccctttgcacttcaatttgcaccaggtgaaaacagggccagcagactccatggcccaattcggtttcttcggtggtgatgtgaaaggagagaattacactttttttttttttaagtggcgtggaggcctttgcttccacatttgtttttaacccagaatttctgaaatagagaatttaagaacacatcaagtaataaatatacagagaatatacttttttataaagcacatgcatctgctattgtgttgggttggtttcctctcttttccacggacagtgttgtgtttctggcatagggaaactccaaacaacttgcacacctctactccggagctgagatttcttttacatagatgacctcgcttcaaatacgttaccttactgatgataggatcttttcttgtagcactataccttgtgggaatttttttttaaatgtacacctgatttgagaagctgaagaaaacaaaattttgaagcactcactttgaggagtacaggtaatgttttaaaaaattgcacaaaagaaaaatgaatgtcgaaatgattcattcagtgtttgaaagatatggctctgttgaaacaatgagtttcatactttgtttgtaaaaaaaaaaaagcagagaagggttgaaagttacatgtttttttgtatatagaaatttgtcatgtctaaatgatcagatttgtatggttatggcctggaagaattactacgtaaaaggctcttaaactatacctatgcttattgttatttttgttacatatagccctcgtctgagggaggggaactcggtattctgcgatttgagaatactgttcattcctatgctgaaagtacttctctgagctcccttcttagtctaaactcttaagccattgcaacttctttttcttcagagatgatgtttgacattttcagcacttcctgttcctataaacccaaagaatataatcttgaacacgaagtgtttgtaacaagggatccaggctaccaatcaaacaggactcattatggggacaaaaaaaaaaattatttcaccttctttccccccacacctcatttaaatggggggagtaaaaacatgatttcaatgtaaatgcctcattttattttagttttattttgatttttatttaatataaagaggccagaataaatacggagcatcttctcagaatagtattcctgtccaaaaatcaagccggacagtggaaactggacagctgtggggatattaagcacccccacttacaattcttaaattcagaatctcgtcccctcccttctcgttgaaggcaactgttctggtagctaactttctcctgtgtaatggcgggagggaacaccggcttcagtttttcatgtccccatgacttgcatacaaatggttcaactgtattaaaattaagtgcatttggccaataggtagtatctatacaataacaacaatctctaagaatttccataacttttcttatctgaaaggactcaagtcttccactgcagatacattggaggcttcacccacgttttctttccctttagtttgtttgctgtctggatggccaatgagcctgtctccttttctgtggccaatctgaaggccttcgttggaagtgttgtttacagtaatccttaccaagataacatactgtcctccagaataccaagtattaggtgacactagctcaagctgttgtcttcagagcagttaccaagaagctcggtgcacaggttttctctggttcttacaggaaccacctactctttcagttttctggcccaggagtggggtaaatcctttagttagtgcatttgaacttgatacctgtgcattcagttctgtgaatactgccctttttggcggggtttcctcatctccccagcctgaactgctcaactctaaacccaaattagtgtcagccgaaaggaggtttcaagatagtcctgtcagtatttgtggtgaccttcagattagacagtcttcatttccagccagtggagtcctggctccagagccatctctgagactcgtactactggatgttttaatatcagatcattacccaccatatgcctcccacaggccaagggaaaacagacaccagaacttgggttgagggcactaccagactgacatggccagtacagaggagaactagggaaggaatgatgttttgcaccttattgaaaagaaaattttaagtgcatacataatagttaagagcttttattgtgacaggagaacttttttccatatgcgtgcatactctctgtaattccagtgtaaaatattgtacttgcactagcttttttaaacaaatattaaaaaatggaagaattcatattctattttctaatcgtggtgtgtctatttgtaggatacactcgagtctgtttattgaattttatggtccctttctttgatggtgcttgcaggttttctaggtagaaattatttcattattataataaaacaatgtttgattcaaaatttgaacaaaattgttttaaataaattgtctgtataccagtacaagtttattgtttcagtatactcgtactaataaaataacagtgccaattgca

SEQ ID NO: 109304 - DNA, 3329 bp, Homo sapiens
  Payload ID: 1473
  Gene Symbol: ATXN10
  Gene Name: ataxin 10
  Uniprot ID: Q9UBB4
  ENST ID: ENST00000252934
  CDS Start-End: 266-1693
ggcgggacttccgccggcgccccctcccccgcggcgccgtctcctcctcccgcctgaggcgagtctgggctcagcctagagctctccggcggcggcgcagcttcagggcagcgcgggctgcagcggcggcggcggttagggctgtgtagggcgaggcctcccccttcctcctcgccatcctactcctccctcctcgtcatcctcccccttcgtcctcctcgccttcctcctcctcgtcaggctcgacccagctgtgagcggcaagatggcggcgcccaggccgccgcctgccaggctgtcgggcgtcatggtgccggcgcccatccaagacctggaggccctgcgcgcgctcacggcgctcttcaaagagcagcggaaccgagaaacagcacccaggactatcttccaaagagttctggatatcctaaagaaatcttctcatgctgttgagcttgcctgcagagatccatcccaagtggaaaacctggcttccagtctgcagttaataacagaatgcttcaggtgtcttcgcaatgcttgcatagagtgttctgtgaaccagaattcaatcaggaacttggatacgattggtgttgctgttgatttgattcttctgtttcgtgaactgcgagtggaacaggaatctctgttgacagcttttcgctgtggcctgcagtttttaggcaacattgcctcacggaatgaagattcccagtctattgtttgggtgcatgctttcccagaactgtttttgtcttgcttaaatcatccggacaaaaaaattgttgcctactcttcaatgattttgtttacatcccttaatcatgaaagaatgaaagaactggaggagaacctcaatattgcaattgatgtcatagatgcttaccaaaaacatcctgaatcagaatggccgttcttgattattacagacctctttctgaaaagcccggaattggtacaagccatgtttcccaaactgaacaatcaagaaagagttacactgttagaccttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggaggcactggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggtaaatgagctggatggtatcccgttgatcctggacaactgcaacatcagtgacagtaacccctttctgacccagtgggtgatatatgccatccgaaaccttaccgaagacaacagccaaaaccaagatttgattgcaaagatggaggaacaggggctggcagatgcatccctacttaaaaaagtgggttttgaagttgaaaagaaaggcgaaaagctgatcctgaaatctactagagacacccctaagccatgaatgaactacatccaaatacctgaatttttggaatctgtttcatggatttttcatcttctaccgtatgtgaaattgcaagtgtttgaagatttataagtacaaatttgggaacatacaaatcttttaggtagtagagtttaacgtgtataagctaaaagtgaaagtaactgagtgttctcttgtttctttgcattaatgtaactgtgtggtttgcctttgtccccctggatagaacgtgcatttaaagaatatattgtacttactgtgacagcagataataaaccagtctcttggagggcacaacccttatttgacaaaacttggatgttggcttgactgtgtttgtcccttcagatggcaagtcagcatcattctttatattcctcttctcattgggttttctgaactctggcaggcggttgaagtagtttctcactgtgattaattctagcaatctcttttcacccctctgcctttccaaaacattgacaagactcatttccagttaattaattcgagaaccctccctcttcattttgggtactgggctgtcttgtcactgagccctatccctttggaatgtggcagggagtgaggttggtgagagaacatgtgggcacttaactcttcatgttccagttcatcccagaagtagacatcccaggacccattctgtgtcaaggtgaatgcctgtgtcctccccagcttcatgcctctgtcatgggggaaggaatagcttatgttctgctctggtgcagtgccgtagattaaaggtacatttctatcttctttgatttaaaaagcaccagtctcataaaggtgccactcagttttagccatgtcttcactgaaattgcaaaagtacttttagggagcaggagtttatttgacatctagttatctgtctgtctgttcatctatctatctgtctgctgtatgagaggtaggactggattaaatgaccactgaactcactgaatccagatcattcatatcatcaacaaaagctctagggggaggtcacgttgtgaatgcttaaaacatattattttcttcaacaaccatatcgctaaactaatatatccagagattttgcacaattcgtgttgaaccttccaaaacaaaaataaagacctgtccaaaagttttgacaaaaatactgattgctcccaaataaagtgcttctaagctttgtgtagacatagtttaactgatttgtaaaaatagcttaagcatgttgagaatgaagtaaaagttttcccatgtgctgtctaatgtactctgtgtaactctgaagacacatcagcttctaggattgcagcaatctatgaataacattttttctctcatttatgactttccatcagtaaagaagccattgcagaatttaaaattacacaaaggagtcattctctcctgggacataaagagttaaagctctgtcctctaaatagaagcctggccaaagggagaaaacagtgggagtcccttttcccttttaacaagtttgcaatagacacttctttttttcctgtctcaatggatgtgtgcacaccagtggaatcgcacaaacttgtcggtatgagctatataataacaaacacaaataaataaaagggagccttgtgagaataca

SEQ ID NO: 109305 - DNA, 3135 bp, Homo sapiens
  Payload ID: 1473
  Gene Symbol: ATXN10
  Gene Name: ataxin 10
  Uniprot ID: Q9UBB4
  ENST ID: ENST00000381061
  CDS Start-End: 267-1502
aggcgggacttccgccggcgccccctcccccgcggcgccgtctcctcctcccgcctgaggcgagtctgggctcagcctagagctctccggcggcggcgcagcttcagggcagcgcgggctgcagcggcggcggcggttagggctgtgtagggcgaggcctcccccttcctcctcgccatcctactcctccctcctcgtcatcctcccccttcgtcctcctcgccttcctcctcctcgtcaggctcgacccagctgtgagcggcaagatggcggcgcccaggccgccgcctgccaggctgtcgggcgtcatggtgccggcgcccatccaagacctggaggccctgcgcgcgctcacggcgctcttcaaagagcagcggaaccggaacttggatacgattggtgttgctgttgatttgattcttctgtttcgtgaactgcgagtggaacaggaatctctgttgacagcttttcgctgtggcctgcagtttttaggcaacattgcctcacggaatgaagattcccagtctattgtttgggtgcatgctttcccagaactgtttttgtcttgcttaaatcatccggacaaaaaaattgttgcctactcttcaatgattttgtttacatcccttaatcatgaaagaatgaaagaactggaggagaacctcaatattgcaattgatgtcatagatgcttaccaaaaacatcctgaatcagaatggccgttcttgattattacagacctctttctgaaaagcccggaattggtacaagccatgtttcccaaactgaacaatcaagaaagagttacactgttagaccttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggaggcactggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggtaaatgagctggatggtatcccgttgatcctggacaactgcaacatcagtgacagtaacccctttctgacccagtgggtgatatatgccatccgaaaccttaccgaagacaacagccaaaaccaagatttgattgcaaagatggaggaacaggggctggcagatgcatccctacttaaaaaagtgggttttgaagttgaaaagaaaggcgaaaagctgatcctgaaatctactagagacacccctaagccatgaatgaactacatccaaatacctgaatttttggaatctgtttcatggatttttcatcttctaccgtatgtgaaattgcaagtgtttgaagatttataagtacaaatttgggaacatacaaatcttttaggtagtagagtttaacgtgtataagctaaaagtgaaagtaactgagtgttctcttgtttctttgcattaatgtaactgtgtggtttgcctttgtccccctggatagaacgtgcatttaaagaatatattgtacttactgtgacagcagataataaaccagtctcttggagggcacaacccttatttgacaaaacttggatgttggcttgactgtgtttgtcccttcagatggcaagtcagcatcattctttatattcctcttctcattgggttttctgaactctggcaggcggttgaagtagtttctcactgtgattaattctagcaatctcttttcacccctctgcctttccaaaacattgacaagactcatttccagttaattaattcgagaaccctccctcttcattttgggtactgggctgtcttgtcactgagccctatccctttggaatgtggcagggagtgaggttggtgagagaacatgtgggcacttaactcttcatgttccagttcatcccagaagtagacatcccaggacccattctgtgtcaaggtgaatgcctgtgtcctccccagcttcatgcctctgtcatgggggaaggaatagcttatgttctgctctggtgcagtgccgtagattaaaggtacatttctatcttctttgatttaaaaagcaccagtctcataaaggtgccactcagttttagccatgtcttcactgaaattgcaaaagtacttttagggagcaggagtttatttgacatctagttatctgtctgtctgttcatctatctatctgtctgctgtatgagaggtaggactggattaaatgaccactgaactcactgaatccagatcattcatatcatcaacaaaagctctagggggaggtcacgttgtgaatgcttaaaacatattattttcttcaacaaccatatcgctaaactaatatatccagagattttgcacaattcgtgttgaaccttccaaaacaaaaataaagacctgtccaaaagttttgacaaaaatactgattgctcccaaataaagtgcttctaagctttgtgtagacatagtttaactgatttgtaaaaatagcttaagcatgttgagaatgaagtaaaagttttcccatgtgctgtctaatgtactctgtgtaactctgaagacacatcagcttctaggattgcagcaatctatgaataacattttttctctcatttatgactttccatcagtaaagaagccattgcagaatttaaaattacacaaaggagtcattctctcctgggacataaagagttaaagctctgtcctctaaatagaagcctggccaaagggagaaaacagtgggagtcccttttcccttttaacaagtttgcaatagacacttctttttttcctgtctcaatggatgtgtgcacaccagtggaatcgcacaaacttgtcggtatgagctatataataacaaacacaaataaataaaagggagccttgtgagaat

SEQ ID NO: 109306 - DNA, 564 bp, Homo sapiens
  Payload ID: 1473
  Gene Symbol: ATXN10
  Gene Name: ataxin 10
  ENST ID: ENST00000402380
  CDS Start-End: 58-438
attttaggcagctattgcttcagaagtcacagtctgttccaccagcctttgccaaggatgcaggtgccacagcatctcaagagaagtcaccaatcacacagctccatgctgaggccctcttgcctgctactgaggagctcttgccacccccgattcctgcctttccccagtgatgcaggacaggtaaatgagctggatggtatcccgttgatcctggacaactgcaacatcagtgacagtaacccctttctgacccagtgggtgatatatgccatccgaaaccttaccgaagacaacagccaaaaccaagatttgattgcaaagatggaggaacaggggctggcagatgcatccctacttaaaaaagtgggttttgaagttgaaaagaaaggcgaaaagctgatcctgaaatctactagagacacccctaagccatgaatgaactacatccaaatacctgaatttttggaatctgtttcatggatttttcatcttctaccgtatgtgaaattgcaagtgtttgaagatttataagtacaaatttgggaacatacaaatctttta

SEQ ID NO: 109307 - DNA, 653 bp, Homo sapiens
  Payload ID: 1473
  Gene Symbol: ATXN10
  Gene Name: ataxin 10
  ENST ID: ENST00000435026
  CDS Start-End: 1-594
cttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggaggcactggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggtaaatgagctggatggtatcccgttgatcctggacaactgcaacatcagtgacagtaacccctatgtatgtacgcatcacccagatggaaatacagaacatgcccatctccctaggcggcttcttgagtgtcccgtctccctcactgccaatccccagatgtaacttctgttctgacttctatgatgttttaatgaataaaaattcccaattttaatgtaaaa

SEQ ID NO: 109308 - DNA, 7886 bp, Homo sapiens
  Payload ID: 1474
  Gene Symbol: ATXN1L
  Gene Name: ataxin 1-like
  Uniprot ID: P0C7T5
  ENST ID: ENST00000427980
  CDS Start-End: 294-2363
gctgtggggggcgctgggtgtggggcggctccggggccggggatggcggcggccgcggttgcggcggctccgggacgagtgagtggatcctgggaagcgctgtgaaatgggctggctcccgagccagccgggaggacacttactacagctgctcagaagcaccactggaaactcagatgtgggcgccccagccagaagcagagaggggtacagggaagctacagagaagccccttctgatgccccagggagcaagtcgactccttccaggctccaggaacaccacaaagcaatatgaaacctgttcatgaaaggagtcaggaatgccttccaccaaagaaacgagacctccccgtgaccagcgaggatatggggagaactaccagctgctccactaaccacacaccctccagtgatgcttctgaatggtcccgaggggttgtggtggctgggcagagccaggcaggagccagagtcagcctggggggtgatggagctgaggccatcaccggtctgacagtggaccagtatggcatgctgtataaggtggctgtgccgcctgccaccttttcaccaactggactcccatctgtggtgaatatgagtcccttgcccccaacgtttaatgtagcgtcttcactaattcaacatccaggcatccactatcctccactccactatgctcagctcccatccacctcgctgcagttcattgggtctccttatagccttccctatgctgtgccacctaatttcctaccgagtcccctcctatctccttctgccaaccttgccacctctcaccttccacactttgtgccatatgcctcacttctggctgaaggagccactcctcccccacaggctccctccccggcccactcatttaacaaagctccctctgccacctccccatctgggcaattgccacatcattcaagtactcagccgctggaccttgctccaggtcggatgcccatttattatcagatgtccaggctacctgctgggtatactttgcatgaaacccctccagcaggtgccagcccagttcttacccctcaggagagccagtctgctctggaagcagctgctgcaaatggaggacagagaccacgagagcgaaatttagtaagacgggaaagtgaagcccttgactcccccaacagcaagggtgaaggccagggactggtgccagtggtagaatgtgtggtggatggacagttgttttcaggttctcagactccacgggtagaggtagcagcaccagcacaccgggggaccccggacactgaccttgaggtccagcgggtggttggcgctttagcttctcaggactatcgtgtggtggcagctcagaggaaggaggaacccagccccctcaacctatcccatcatacccccgaccatcagggtgaggggcgagggtcagccaggaaccctgcagagctggcagagaaaagtcaggcccgtgggttctaccctcagtcccatcaggaaccagtaaaacatagacctttacccaaagcaatggttgtagccaatggcaacctggtgcccactggaactgactcaggcctgctgcctgtgggctcggagatcctggtagcatcaagtctggacgtgcaggccagagccaccttcccagacaaggagccaacgccgccccccattacctcctctcacttgccttcccatttcatgaaaggcgccatcatccagctggctacgggagagctgaagcgggtggaggacctccagacccaggattttgtgcgcagtgccgaagtgagcggggggctgaagattgactctagcacggtcgtggacattcaggagagccaatggcctggatttgtcatgctgcattttgtggttggtgagcagcagagcaaagtgagcatcgaagtgccccccgagcaccccttctttgtatatggccagggttggtcctcttgcagccctgggcggacgacacaactcttctctctgccctgccatcggctacaggtgggagatgtctgcatctctatcagtttacagagcttgaacagtaactcagtttctcaggccagctgtgctcccccaagccagctgggtcccccccgagaaaggcctgagaggacggtcttgggatccagagagctatgtgacagtgaggggaagagccagccggcaggagagggctcccgtgtggtagagccttcccagcctgagtccggtgctcaggcctgctggccagccccgagcttccaaagatacagcatgcaaggggaggaggcacgggctgcgctgctccgtccctctttcattccacaggaggtaaagctgtccattgaagggcgttccaatgcgggaaaatgaacctcttccccagaccaggactggggctttaccccagagcctcgcctcgccgccgtgagcaggcagaggatttgcacacgccgagcagggaatggctttcttggcagtgagatttgggggaaaggggaggcatgaagtcagcctcccaaggcaggatctgttgttcattaccccatggcatcctttcaggacaaccccagagggtgttgtgatggggagcagcaggcctggggcaaggaaggaagggggtgcacacaggagaagaaacattccaaaatcagggcctccctgttctttcctccccatccctagctcctgcaagagaaagtccaggctttgggagcagatggcagagggagggagtaaagaaagagccaaaaatgatgatccacagcttatagtagcagttaaactgtcagaagttttttttcttttttgtggtagaagggcaggaggccccaaggttggaaataagagggttcccacccagaacccttcttgtgagagatgcgcactttaaagggtgattttgttccagatgtctatggctgggtgtgtgggggaggagcactctcatctgcaggactctgcttgatcctctgcttcatagcccttccccatctctcctcaccattctgcctacaaggcttctagcagcacgggggcccggagggagagccccttcagggttcagagtgaagtactaccttgccagggactcagtcaggggactttgggagaaagacttgatagccaggctgactgggttctaggcaggccctctggaaaggtagctcacctaacaaagctcctccatctcagcatgccagacccactttgaaatctcacagaatcttgctggtaatggtgactttagaactagtagaccctttttcccaggcactgaccccccacctttgtctgtgttgtgcccaagtgcctgcgccacccccaccctcctgctgcgctgaccgctgcatggtgtcgtgacctgggcctcatttgtagctgcactgcctttccttgtctgcaaagttggttttgtccactctgaccaagacctctagtttttggtgggtagggggtctctctggtttccccttcagctataatctctatttttaaaatctcaaaatcatgtcccctccacttccactgccaaacagcttggtgaagaaacaagaagggaactatgccctgggccagggcgaatgcgtggctgggcagtgcccatcatggcattttcacatgtcccatatgcccctcctgtcttattccactgcttctcccagcattctggtgcctccaagccatcccctcccaccaccagctctaagattctaggatagtcttgataacatttcagtacctgaatagatgtcattttgtgttggtatattcctctgcaaaaagtattttcaatcttggttgcattggcaccccccctaccccccaccaatgtcttaatcccacattttcttcacaacttttagcatcagctcagaccgtggggttccactgggtattgggaattaggctcccccactagctttcaggtgggtaagtttttttgtttgttttttgggggtctttagactcttgaaggcaactcagggtattgtccacgcagctctctggttagacttctcccaggctatgatcctggcatgtcctttataaggtatacttggattggccgagacctggcctggcatcaggagtccaaacctctgaggtctgatctctgctctgtcaaggactttcggcaagtctcgtgacctctggctctttcacttcctccccacctgccaaatggggataaataatcttacctacctcctggggggaggggaagttctgagaatggagtcattcttagtgttcaggtgctaaaggttgttctcctgggggaacagagtgactgaaactggcttgtttgctacaagccctaccctccactctttcattccttgaaagcagtttgcctggtcagtcagcttttgggggtccatcaaaggaggttgctgacctgaccgtgagtgcttcagtatctggtttgtgtcagaaccagacgccaactttgtactgcatttgggatcatatctttccccttctctgtcccccattctctgaatgctgctttctctggcttgtttcctacagtgggggcctgtggggttgagtcttgaggaatcccctcaaatgagaaggccttgggagaaggcctcatctctggctgtttcatgagcaactcattcctagagttcattgtttgcatgggtttctcacaagcgtccttcctcataggaaggctcatcaactgaatttagtgacatgtacacagtagatgctcaagcagtgtctgcaaggacacaagctgagctttctccttatggggcaaacctatgtctaaccagatacagaccaattagtttagatcaaatcaccttccacttgggctacttgtgactttccaacctggtaacttccactgaattctggaaagagaaattcttgaggaccctggcaagttgggccctgacctttctgttgctgtctcttgctggtgaagcaataccagcagttcctgtaataccacaatatcgttccatgcatatataacatattaatacttgattttgctgagctgcaaaggtatctgtcataaaatatggtccccaggaaaagaatctctgtgctctaaatctcggtcagagctgtggcctcccccttgcctttaacctctagtttagtcttttcctccaggcatgaaaaatatgactaacctgtggtgtgtccattcttccttataggaatttcctgagtttgcaggagacatgagagcagtttttagcgagtattttagtgggaagttgccaactttttaagaatgagcagttgacaagggccagagcctgtcccttgtcagcagtaggacatttccagctcttaggaatagaaaggaggactgctgactgtctggcgctgtataaaaatgtgtataccaatttgggaataggggaacccagtcatggatggataataagccaagtcttgaatcattcctatcaagattagtatacatgaggaagaggtggcatggggggaaggggctctgggagttcagagctgagtacttgtacctgagggagggcccccagccaatctgggctggtccttctatattcttggtcccagttggtcataacaccaagggctttgccctgcgctgctttgccactgctgctgtccgctcactgtcctgcctgctgtcctctacagctccctatccttccatgtctttggccatgtagattaagtgtaggcgtccggttcattcttacctgtgttaggccatgttattttatagcgaagtcatgttcgatagggatggtatgaaatgctgctggtgggctggtaaatccaaagggataaggcttcagtgctgttgggagccctctggctccaaatgtctgactatcttgagggagaaacaagcaggtttctactagtggtgtcttctgttgtattaacttctttcctttgtggtatcttgtatcctgttttaaaaactaaatgaagggaaccacattagggcccatgccagcatcccagtgaagttcgtccagctccagttaggtggattctggagttcggagagggtttaaagtttggctgaaatagcacctcaagtggggtttagttttatttttacctgcgggcatcatgggcgatttagggggaagcacaggatggtggtgtggtttaaacctgcagcaagcaggcatgttgaagagttgagtgatcacgctggagatgaagggttggacatggattgactgggaaaaggcctgggtccattggagtaaagataacctagtcgattgaattggccatgggaagttaggtcacagtcttataaacaaagtaaataggacagagactaagttttagggagacatcttggcctcctaggctaagtttactaaaccacactgaagctatagtaccttccagatgggcaaaagtgtacactacagttgaggagctgaaccttattaggttggatgtcgatcaggaacctgtttgccctttgctgggaagccttcactctccagctttcctggggtagggaaggtctcccacattatgcaataataaaataagcatctgggtctttgcagctgtcagttgctctttcaactctaggatccatctttggaccagaagcctggtctgtgcctaggatgacactggccccagagatgctagagtcgactgcactctctccttagctgcagaccatgcacagtgcctggggcggaaggaggagaggtgttgcggtttgccctgctgcctccccagcaggaacaatagtcataaatgcacttttcacactaaaggtttctttattagttctccagttaaacctagatccctccctggtagattgcgaactcaaagttttgtgatcccaaagccattccactgcaaatgcccagcagtgaagatggcctcaaattgggttcttgcctgcagtgtgtgtggcagcagcccatgtgcctttacctgttgtcaaacttgcaagcatttatttgtctttatgactgtcatggggactgaggttcttcagagaaagagtgtgagctgatgacacagtggttttacacccaccccctgggcagggagtttgcacgtagttgtgagctgtgagtggttagtgcattgctggtattgctgaaggcagggttgatccctcacttgactgatacttgcattcaagagaatctagattgtgttgggggagggactgactgtactcatggctaacttaaagtattaaaataaggctgtcccctacaaccttcttagtcacacaggatccctgtagccaaaacagtatatgatccagctgcagagagcagactgctctcagcttgcacagcaccttaggcgagggaagaatatacggatagggaatggggtggagaaaggatgggaatgttgtcatccaggtggctttagggtcctaaggagtggagaaggatggcactggggaggtctggatggatctgtgtaggagttccctgtagataaattactgatcccccatctactatccccagtatgtaatggctgaattaatatgtaatcaactgcattgtatctaaagccttagaactagtcaggtgctccctccacccaataccatttcttaccctctaatcctacctgatctttaacaaagcattaataattctaaggataatctctattttgttgtgcttttttgtaactgttttaaataaatcaatttgtactgtatatttgtacttttgtgagatcctttttgctgttttaccattttaagtctctgtacttggctacacacagattgtatttttattgttaatgctcttcttatggatacctgcatttaacttgtggactatgtaaacacaatatctatcaatatctatatatctatatatctatctatataaactactagcttttcctttt

SEQ ID NO: 109309 - DNA, 4702 bp, Homo sapiens
  Payload ID: 1475
  Gene Symbol: ATXN2
  Gene Name: ataxin 2
  Uniprot ID: Q99700
  ENST ID: ENST00000377617
  CDS Start-End: 163-4104
acccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcctccttctccccctcgccagcccgggcgcccctccggccgcgccaacccgcgcctccccgctcggcgcccgcgcgtccccgccgcgttccggcgtctccttggcgcgcccggctcccggctgtccccgcccggcgtgcgagccggtgtatgggcccctcaccatgtcgctgaagccccagcagcagcagcagcagcagcagcagcagcagcagcagcaacagcagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcagaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgcatgtcccaaattaccatacaacaaggagacaagcccttctttctactttgccatttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactga

SEQ ID NO: 109310 - DNA, 3854 bp, Homo sapiens
  Payload ID: 1475
  Gene Symbol: ATXN2
  Gene Name: ataxin 2
  ENST ID: ENST00000389153
  CDS Start-End: 104-3256
cgcggcgacctccggcggcgggaggcccggcctgggcagaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcaggtaaagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgcatgtcccaaattaccatacaacaaggagacaagcccttctttctactttgccatttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactga

SEQ ID NO: 109311 - DNA, 1794 bp, Homo sapiens
  Payload ID: 1475
  Gene Symbol: ATXN2
  Gene Name: ataxin 2
  ENST ID: ENST00000389154
  CDS Start-End: 1-1275
cccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcaggtaaagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgcatgtcccaaattaccatacaacaaggagacaagcccttctttctactttgccatttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactga

SEQ ID NO: 109312 - DNA, 3205 bp, Homo sapiens
  Payload ID: 1475
  Gene Symbol: ATXN2
  Gene Name: ataxin 2
  Uniprot ID: Q99700
  ENST ID: ENST00000535949
  CDS Start-End: 127-3147
cccgagaaagcaacccagcgcgccgcccgctcctcacgtgtccctcccggccccggggccacctcacgttctgcttccgtctgacccctccgacttccgatttcttttgatggaatctatgcaaatatgaggatggttcatatacttacatcagttgtttgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgtttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctacca

SEQ ID NO: 109313 - DNA, 3443 bp, Homo sapiens
  Payload ID: 1475
  Gene Symbol: ATXN2
  Gene Name: ataxin 2
  ENST ID: ENST00000542287
  CDS Start-End: 164-3385
cccgagaaagcaacccagcgcgccgcccgctcctcacgtgtccctcccggccccggggccacctcacgttctgcttccgtctgacccctccgacttccgaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgcatgtcccaaattaccatacaacaaggagacaagcccttctttctactttgccatttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcagtgcgccagtgaggctctggcaaggtgtgggctagagatgcgactcagttggatctatctctcagaaggctaccttgctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctacca

SEQ ID NO: 109314 - DNA, 4159 bp, Homo sapiens
  Payload ID: 1475
  Gene Symbol: ATXN2
  Gene Name: ataxin 2
  ENST ID: ENST00000483311
  CDS Start-End: 1-2750
acggcaacggcggcggcgcgtttcggcccggctcccggcggctccttggtctcggcgggcctccccgccccttcgtcgtcctccttctccccctcgccagcccgggcgcccctccggccgcgccaacccgcgcctccccgctcggcgcccgcgcgtccccgccgcgttccggcgtctccttggcgcgcccggctcccggctgtccccgcccggcgtgcgagccggtgtatgggcccctcaccatgtcgctgaagccccagcagcagcagcagcagcagcagcagcagcagcagcagcaacagcagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcagaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaataccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgcatgtcccaaattaccatacaacaaggagacaagcccttctttctactttgccatttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagtta

SEQ ID NO: 109315 - DNA, 4648 bp, Homo sapiens
  Payload ID: 1475
  Gene Symbol: ATXN2
  Gene Name: ataxin 2
  Uniprot ID: Q99700
  ENST ID: ENST00000550104
  CDS Start-End: 163-4104
acccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcctccttctccccctcgccagcccgggcgcccctccggccgcgccaacccgcgcctccccgctcggcgcccgcgcgtccccgccgcgttccggcgtctccttggcgcgcccggctcccggctgtccccgcccggcgtgcgagccggtgtatgggcccctcaccatgtcgctgaagccccagcagcagcagcagcagcagcagcagcagcagcagcagcaacagcagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcagaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgcatgtcccaaattaccatacaacaaggagacaagcccttctttctactttgccatttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataat

SEQ ID NO: 109316 - DNA, 887 bp, Homo sapiens
  Payload ID: 1475
  Gene Symbol: ATXN2
  Gene Name: ataxin 2
  ENST ID: ENST00000492467
  CDS Start-End: 1-887
catctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgca

SEQ ID NO: 109317 - DNA, 3104 bp, Homo sapiens
  Payload ID: 1475
  Gene Symbol: ATXN2
  Gene Name: ataxin 2
  ENST ID: ENST00000550844
  CDS Start-End: 1-591
catcctcatgtctatagtcctgtaatacagggtaatgctagaatgatggcaccaccaacacacgcccagcctggtttagtatcttcttcagcaactcagtacggggctcatgagcagacgcatgcgatgtatgcatgtcccaaattaccatacaacaaggagacaagcccttctttctactttgccatttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggtaataccagctttagccaactttctgtgaaggccaagtagaatgtgaaggttatcagtaagcagctagaggctctcccagctaggaaaccctgtgtgtcatgccatttgcctgtctccctttccctctcaaatacacgtgatctggccctaagggaatgtttgtgtggttttgtcatgggatcagtgaaggtgctgattggtcagtcctttagttttccaactgagaccttaaaaatatctttgactctggaatgcaacccagtccttctttcctttctgtgtctgctttgctatgtctatatagcctcactactatatatatgtgtacatatatattcccctacacacttaccttggaagccaggcagggatgatggccttcacagagtctcagctctccgaagtgactaccggggcctgtcaacttgattgttactcacatgagttccagacacatctctccaattgttttccctggttatccatatatctgctttgaccataagttgtactcttgagagggcttggccttggacattggtgcagtgtaactagaagctggaagcacccaggtggtcccatttttctttaagagcagccctggaagcactttggagctcacctccagtgtaagctgctacaggtgaaaggtgtgcttgccatctcagtggttgctgtctgcatcagctgctgacaaaggtccctgcactccagggcccaggggattgtcttaatgaggagaaggagctgcactgaagttgggctctaacgctggccttgaggccctccctggggctgttacgggtgaattggctgtattagatgtctctgctactttcataacagaactctctgaggcgggtctaagtgagacctgccacaatgaattccatttcctgttaaatagtgcgccagtgaggctctggcaaggtgtgggctagagatgcgactcagttggatctatctctcagaaggctaccttgtaagtagagttccacagctctgggaagtttgggcgtcctcaccctgcaaagtttaggttctgtggtgtagcgcactgcagttgatttgctttttgatagtggggagggaagccggtttggtccgtgtgggccagcgtggtttggtggagtcagcttcataagagctggggtcctgtaggtgtctaccagaggctggtggctaagtaggcatgtgaacttacatgtaagtcagggatccctaaaacctcactctgtttttgtgctgaaagggcaaaaaggttaacacagggaagctcaaatttgccatgtgcccgtttgaatatgtgagagtaaaaacggcatttcatccaaggcttatcgtagtctagaacagtgcacagtgtgggaaaaaggaaacaagggctcttcctggccctgccaaccccctgcagagctggaatccagctgtttgggctgactaaaatcacctttccaacttgacagtgagtgagaccaggttgaacttggtacagagacgctgggctggcccagatgacttcaggttactcctttccatctcactggagccattaaaaactccaactcctcctcctcctcctgctccatcagcatatctctgagagagtcacgggggcctaagagtctcttttcactgcctggtgagcagaccagaagcagagggagagaggcaaatgaacagaggtccaagtaattcacatacttgactgtgacagtctctgcttattaatgtaatctgttttcctatttgaaagggatgttatctgcaaaactacctcaggccccacatggcagcctgattctgaagcatcattgaatcttgtatgatattaagttgagaaagctgcccttggatccagtgtctaatctttgtgaagatcttaccccatacatagaatacaatgatcagaaatgtcaagggttaggacagcacagccctgacttctacccaggctcacttgttgcctgctccctgacccttgcaggatctgcccaaaggtgaagcgcgtcttcaggtcaatagataatctactagagattgtccccagagaacagaactgggccctgaggcccaccgttgccctttcctgagagtcccagcccagtgaaaggaacacagttgacatgttgttgaagccggagatgttgcctgtatgcgtaaaagagctctctgtttcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcaggtgaggcgtgtgtgtgcaggggccgccggggcaccccaaagcattctgctcgcacaggtggaatggcaggcagggccagtgcttcaagccccgcatttgagaactagcaagacccgtccaggagtgtgcacaggagggactgtgacgatcagttcagcatcagggcctgaggcttccgggagccgagtctg

SEQ ID NO: 109318 - DNA, 704 bp, Homo sapiens
  Payload ID: 1475
  Gene Symbol: ATXN2
  Gene Name: ataxin 2
  ENST ID: ENST00000550236
  CDS Start-End: 1-704
ttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggctaaagattccaggcttcaagatcagaggcagaactctcctgcagggaataaagaaaatattaaacccaatgaaacatca

SEQ ID NO: 109319 - DNA, 556 bp, Homo sapiens
  Payload ID: 1475
  Gene Symbol: ATXN2
  Gene Name: ataxin 2
  ENST ID: ENST00000548492
  CDS Start-End: 3-556
aaatgctaggagagagagattgcagcaggggacgtggtcgggttcctgaaggcagaaagggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaa

SEQ ID NO: 109320 - DNA, 695 bp, Homo sapiens
  Payload ID: 1475
  Gene Symbol: ATXN2
  Gene Name: ataxin 2
  ENST ID: ENST00000551755
  CDS Start-End: 1-322
gcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagccttggaacatatgaacctgttgaaagaactctgcctgaaataattaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgcatgtcccaaattaccatacaacaaggagacaagcccttctttctactttgcca

SEQ ID NO: 109321 - DNA, 610 bp, Homo sapiens
  Payload ID: 1475
  Gene Symbol: ATXN2
  Gene Name: ataxin 2
  ENST ID: ENST00000475132
  CDS Start-End: 1-360
gcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcaggtgaggcgtgtgtgtgcaggggccgccggggcaccccaaagcattctgctcgcacaggtggaatggcaggcagggccagtgcttcaagccccgcatttgagaactagcaagacccgtccaggagtgtgcacaggagggactgtgacgatcagttcagcatcagggcctgaggcttccgggagccgagtctgtgtgtgttctgatggtatacaggatttggcttgatgagaagcagcagcagcagcaacagcagcctgatgcatgcctaggactcagttggccttccttgttatgacaggctggacagggcagtgttttccttcctgagtcccaaaagtctgacatgtggggggttat

SEQ ID NO: 109322 - DNA, 4376 bp, Homo sapiens
  Payload ID: 1475
  Gene Symbol: ATXN2
  Gene Name: ataxin 2
  ENST ID: ENST00000608853
  CDS Start-End: 317-3778
tcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcctccttctccccctcgccagcccgggcgcccctccggccgcgccaacccgcgcctccccgctcggcgcccgcgcgtccccgccgcgttccggcgtctccttggcgcgcccggctcccggctgtccccgcccggcgtgcgagccggtgtatgggcccctcaccatgtcgctgaagccccagcagcagcagcagcagcagcagcagcagcagcagcagcaacagcagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcagaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgcatgtcccaaattaccatacaacaaggagacaagcccttctttctactttgccatttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactga

SEQ ID NO: 109323 - DNA, 4575 bp, Homo sapiens
  Payload ID: 1475
  Gene Symbol: ATXN2
  Gene Name: ataxin 2
  Uniprot ID: Q99700
  ENST ID: ENST00000616825
  CDS Start-End: 958-3978
acccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcctccttctccccctcgccagcccgggcgcccctccggccgcgccaacccgcgcctccccgctcggcgcccgcgcgtccccgccgcgttccggcgtctccttggcgcgcccggctcccggctgtccccgcccggcgtgcgagccggtgtatgggcccctcaccatgtcgctgaagccccagcagcagcagcagcagcagcagcagcagcagcagcagcaacagcagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcagaggtcgaaacagtaacaaaggactgcctcagtctacgatttcttttgatggaatctatgcaaatatgaggatggttcatatacttacatcagttgtttgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgtttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactg

SEQ ID NO: 109324 - DNA, 3788 bp, Homo sapiens
  Payload ID: 1476
  Gene Symbol: ATXN2L
  Gene Name: ataxin 2-like
  Uniprot ID: Q8WWM7
  ENST ID: ENST00000325215
  CDS Start-End: 168-3356
ccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaa

SEQ ID NO: 109325 - DNA, 4367 bp, Homo sapiens
  Payload ID: 1476
  Gene Symbol: ATXN2L
  Gene Name: ataxin 2-like
  Uniprot ID: Q8WWM7
  ENST ID: ENST00000336783
  CDS Start-End: 168-3395
ccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgtgagttctcattagctgggggaatttggcatggaagagctgaggggctgcaggtggggcaggatgcacgggttctgggtggggagtgaggggtcttggaggcagggctgtcccacagggcgcccgccgacctgcacctgtctgtgaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgaggtaaggtcagtgcagcagacagggccagactggggtgtggggggctgagctgggcacatgagtgagggctctggcttactgggaaacagcgattgacctgtgcttctgacagcccccgagacaccttgaggaggccgctccttcccagacacacccccacgcccccactggacggcattggaggaagggacagctgcttgggttctaatgctcctgctctcttctctttcccctccaaccagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaacttaa

SEQ ID NO: 109326 - DNA, 3807 bp, Homo sapiens
  Payload ID: 1476
  Gene Symbol: ATXN2L
  Gene Name: ataxin 2-like
  Uniprot ID: Q8WWM7
  ENST ID: ENST00000340394
  CDS Start-End: 213-3347
agccgcgagaccccctccccttccgcctcgcggcgcttcctcgcgccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaacttaa

SEQ ID NO: 109327 - DNA, 3739 bp, Homo sapiens
  Payload ID: 1476
  Gene Symbol: ATXN2L
  Gene Name: ataxin 2-like
  Uniprot ID: Q8WWM7
  ENST ID: ENST00000382686
  CDS Start-End: 168-3302
ccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaacttaa

SEQ ID NO: 109328 - DNA, 3981 bp, Homo sapiens
  Payload ID: 1476
  Gene Symbol: ATXN2L
  Gene Name: ataxin 2-like
  Uniprot ID: Q8WWM7
  ENST ID: ENST00000395547
  CDS Start-End: 168-3461
ccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattctatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgaggtaagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaacttaa

SEQ ID NO: 109329 - DNA, 3635 bp, Homo sapiens
  Payload ID: 1476
  Gene Symbol: ATXN2L
  Gene Name: ataxin 2-like
  Uniprot ID: Q8WWM7
  ENST ID: ENST00000570200
  CDS Start-End: 9-3197
ctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaa

SEQ ID NO: 109330 - DNA, 559 bp, Homo sapiens
  Payload ID: 1476
  Gene Symbol: ATXN2L
  Gene Name: ataxin 2-like
  ENST ID: ENST00000569318
  CDS Start-End: 1-559
gacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactc

SEQ ID NO: 109331 - DNA, 2162 bp, Homo sapiens
  Payload ID: 1476
  Gene Symbol: ATXN2L
  Gene Name: ataxin 2-like
  ENST ID: ENST00000566946
  CDS Start-End: 1-1206
aataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgtgagttctcattagctgggggaatttggcatggaagagctgaggggctgcaggtggggcaggatgcacgggttctgggtggggagtgaggggtcttggaggcagggctgtcccacagggcgcccgccgacctgcacctgtctgtgaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgaggtaaggtcagtgcagcagacagggccagactggggtgtggggggctgagctgggcacatgagtgagggctctggcttactgggaaacagcgattgacctgtgcttctgacagcccccgagacaccttgaggaggccgctccttcccagacacacccccacgcccccactggacggcattggaggaagggacagctgcttgggttctaatgctcctgctctcttctctttcccctccaaccagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaa

SEQ ID NO: 109332 - DNA, 770 bp, Homo sapiens
  Payload ID: 1476
  Gene Symbol: ATXN2L
  Gene Name: ataxin 2-like
  ENST ID: ENST00000564162
  CDS Start-End: 1-333
cagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaacttaa

SEQ ID NO: 109333 - DNA, 525 bp, Homo sapiens
  Payload ID: 1476
  Gene Symbol: ATXN2L
  Gene Name: ataxin 2-like
  ENST ID: ENST00000567024
  CDS Start-End: 1-35
cagctctcagtgaccccgactgtctcctgacttagccgagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaa

SEQ ID NO: 109334 - DNA, 471 bp, Homo sapiens
  Payload ID: 1476
  Gene Symbol: ATXN2L
  Gene Name: ataxin 2-like
  ENST ID: ENST00000566007
  CDS Start-End: 1-386
agaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaagctctcagtgaccccgactgtctcctgacttagccgagctcggaccactcccagccccccatccccccgttccccaggggagctggggaattcctgccaagcaccttgaatgggaggg

SEQ ID NO: 109335 - DNA, 1933 bp, Homo sapiens
  Payload ID: 1476
  Gene Symbol: ATXN2L
  Gene Name: ataxin 2-like
  ENST ID: ENST00000562583
  CDS Start-End: 1-1203
aataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgtgagttctcattagctgggggaatttggcatggaagagctgaggggctgcaggtggggcaggatgcacgggttctgggtggggagtgaggggtcttggaggcagggctgtcccacagggcgcccgccgacctgcacctgtctgtgaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaacttaa

SEQ ID NO: 109336 - DNA, 1294 bp, Homo sapiens
  Payload ID: 1476
  Gene Symbol: ATXN2L
  Gene Name: ataxin 2-like
  ENST ID: ENST00000568266
  CDS Start-End: 287-1294
gcccccttcccgtacgtgcgcgtggatgctcggtctcatgacccgggcattcgcgcgccccgggaacacctagggcagggactagttcgtggaggggctcgtctggtggcagtgcatgagtagtggaggccctgctcagtttttcctgtgcgagtgtgtgtgtgttaatggaattaagagtggcagcacacgcaggcgcagtgggctctgatcgctggaggtgggggttcggaaagtcccgtgggttttagtgcgcaggcgcagaccgggcgaggcctcccggtggatggcttttgcggctgcgctgtcccccagccccgccagcggccccctcttcgccctcaaccgccggttacatcagccagcgacgagcagggttacctggcgattggtgatccccgcagagggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttct

SEQ ID NO: 109337 - DNA, 552 bp, Homo sapiens
  Payload ID: 1476
  Gene Symbol: ATXN2L
  Gene Name: ataxin 2-like
  ENST ID: ENST00000564656
  CDS Start-End: 279-552
agccccgccagcggccccctcttcgccctcaaccgccggttacatcagccagcgacgagcagggttacctggcgattggtgatccccgcagagtgggtaacgggctgaatgagtcatgaggtcgaggggatggggtgtggaggggatacccctcctcccacagttttgaggcgtcaggctgctgaaaatgattgtcttttctgtttgggaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattg

SEQ ID NO: 109338 - DNA, 3264 bp, Homo sapiens
  Payload ID: 1476
  Gene Symbol: ATXN2L
  Gene Name: ataxin 2-like
  ENST ID: ENST00000565971
  CDS Start-End: 1-654
ggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggagtaaaagaactctctaccaaggaacctgggagaactctggagccccaggagctggctcggatagctgggaaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgtgagttctcattagctgggggaatttggcatggaagagctgaggggctgcaggtggggcaggatgcacgggttctgggtggggagtgaggggtcttggaggcagggctgtcccacagggcgcccgccgacctgcacctgtctgtgaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgaggtaaggtcagtgcagcagacagggccagactggggtgtggggggctgagctgggcacatgagtgagggctctggcttactgggaaacagcgattgacctgtgcttctgacagcccccgagacaccttgaggaggccgctccttcccagacacacccccacgcccccactggacggcattggaggaagggacagctgcttgggttctaatgctcctgctctcttctctttcccctccaaccagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaacttaa

SEQ ID NO: 109339 - DNA, 3514 bp, Homo sapiens
  Payload ID: 1476
  Gene Symbol: ATXN2L
  Gene Name: ataxin 2-like
  ENST ID: ENST00000564304
  CDS Start-End: 166-3372
gcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagcagccgccccccacgcaacaggccgtggcccgtcggccccccgggggcaccagccctcccaacggcggcctcccggggccgctggccacctctgcggctcctcccgggcctccagcggccgcctccccctgcctggggcctgtggccgctgccgggagcgggctccgccggggagccgaaggcatcttggcgccgcagccgccgccgccgcagcaacaccaggagaggccgggggcagccgccatcggcagcgccaggggacagagcacaggaaagggacccccacagtcacctgtgtttgaaggcgtctacaacaattccagaatgctgcatttccttacagctgttgtgggctccacttgtgatgtaaaggtgaaaaatggtaccacttatgagggtatcttcaagacgctaagctcaaagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaagacaagttcaccgattcagccattgccatgaactcgaaagtgaatggggaacacaaagagaaggtgcttcagcgctgggaggggggtgacagcaacagcgacgactatgacctcgagtctgacatgtccaatggatgggaccccaatgaaatgttcaagttcaatgaggagaactacggtgtgaagactacctatgatagcagtctttcttcttatacggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccagggaggggaagtatatccctctgcctcaacgagtccgggaaggtccccggggaggagttcgatgcagcagctctcggggcggtcggcctggccttagctctttgccacctcgtggccctcaccatctggacaacagcagccctggcccaggttctgaggcccgtggtatcaatggaggcccttcccgcatgtccccaaaggcacaacggcctctgagaggtgccaagactctgtcttcgcccagtaataggccttctggagaaacttctgttccacctcctcctgcagctcccccttttcttccagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatgtaaaagaactctctaccaaggaacctgggagaactctggagccccaggagctggctcggatagctgggaaagtccctggtcttcagaatgaacagaaacgattccaactggaagaactgagaaagtttggggcccagtttaagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgaacaagtaaagaaatcaacgttgaaccctaatgctaaggagttcaatcctacaaagcctctgctgtctgtgaataaatccaccagtaccccaacttctccggggccccggactcattcaactccctccatcccggtgctgacagcaggccagagtgggctatacagcccccagtacatctcctacatacctcagatccacatgggaccagctgtgcaggcacctcagatgtatccatatcctgtatccaattcagtgcctgggcagcagggcaagtaccggggagcaaaaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcctacccacaccatgccacacagctccatgcccaccagccgcagccggctaccacgcctactggaagccagccgcagtcccagcatgcggcccccagtcctgtccagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttg

SEQ ID NO: 109340 - DNA, 1205 bp, Homo sapiens
  Payload ID: 1477
  Gene Symbol: ATXN3
  Gene Name: ataxin 3
  Uniprot ID: P54252
  ENST ID: ENST00000340660
  CDS Start-End: 59-979
ggggcggagctggagggggtggttcggcgtgggggccgttggctccagacaaataaacatggagtccatcttccacgagaaacagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaata

SEQ ID NO: 109341 - DNA, 2584 bp, Homo sapiens
  Payload ID: 1477
  Gene Symbol: ATXN3
  Gene Name: ataxin 3
  ENST ID: ENST00000359366
  CDS Start-End: 39-278
ggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcagaaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaa

SEQ ID NO: 109342 - DNA, 6770 bp, Homo sapiens
  Payload ID: 1477
  Gene Symbol: ATXN3
  Gene Name: ataxin 3
  ENST ID: ENST00000393287
  CDS Start-End: 70-1002
gagaggggcagggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 109343 - DNA, 6713 bp, Homo sapiens
  Payload ID: 1477
  Gene Symbol: ATXN3
  Gene Name: ataxin 3
  ENST ID: ENST00000429774
  CDS Start-End: 70-945
gagaggggcagggggcggagctggagggggtggttcggcgtgggggccgttggctccagacaaataaacatggagtccatcttccacgagaaagttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 109344 - DNA, 619 bp, Homo sapiens
  Payload ID: 1477
  Gene Symbol: ATXN3
  Gene Name: ataxin 3
  ENST ID: ENST00000515746
  CDS Start-End: 12-311
gacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaag

SEQ ID NO: 109345 - DNA, 1259 bp, Homo sapiens
  Payload ID: 1477
  Gene Symbol: ATXN3
  Gene Name: ataxin 3
  Uniprot ID: P54252
  ENST ID: ENST00000502250
  CDS Start-End: 272-820
gtgggggccgttggctccagacaaataaacatggagtccatcttccacgagaaaaaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttca

SEQ ID NO: 109346 - DNA, 1315 bp, Homo sapiens
  Payload ID: 1477
  Gene Symbol: ATXN3
  Gene Name: ataxin 3
  Uniprot ID: P54252
  ENST ID: ENST00000503767
  CDS Start-End: 49-1089
tggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaata

SEQ ID NO: 109347 - DNA, 637 bp, Homo sapiens
  Payload ID: 1477
  Gene Symbol: ATXN3
  Gene Name: ataxin 3
  ENST ID: ENST00000506466
  CDS Start-End: 22-637
gttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacat

SEQ ID NO: 109348 - DNA, 1191 bp, Homo sapiens
  Payload ID: 1477
  Gene Symbol: ATXN3
  Gene Name: ataxin 3
  Uniprot ID: P54252
  ENST ID: ENST00000532032
  CDS Start-End: 11-1105
acaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtaaggcctgctcaccattcatcatgttcgctaccttcacactttatctgacatacgagctccatgtgatttttgctttacattattcttcattccctctttaatcatattaagaatcttaagtaaatttgtaatctactaaatttccctggattaaggagcagttaccaaaagaaaaaaaaaaaaaaaa

SEQ ID NO: 109349 - DNA, 6950 bp, Homo sapiens
  Payload ID: 1477
  Gene Symbol: ATXN3
  Gene Name: ataxin 3
  ENST ID: ENST00000545170
  CDS Start-End: 70-1182
gagaggggcagggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaagtgagactccgtctccaaaaatatatacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 109350 - DNA, 660 bp, Homo sapiens
  Payload ID: 1477
  Gene Symbol: ATXN3
  Gene Name: ataxin 3
  ENST ID: ENST00000556082
  CDS Start-End: 23-262
cgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcagaaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagacagcagcaaaagcagcaacagcagcagcagcagcagcagcagggggacctatcaggacagagttcacatccatgtgaaaggccagccaccagttcaggagcacttgggagtgatc

SEQ ID NO: 109351 - DNA, 901 bp, Homo sapiens
  Payload ID: 1477
  Gene Symbol: ATXN3
  Gene Name: ataxin 3
  ENST ID: ENST00000556288
  CDS Start-End: 23-262
cgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcagaaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatc

SEQ ID NO: 109352 - DNA, 692 bp, Homo sapiens
  Payload ID: 1477
  Gene Symbol: ATXN3
  Gene Name: ataxin 3
  ENST ID: ENST00000556220
  CDS Start-End: 23-692
cgttggctccagacaaataaacatggagtccatcttccacgagaaacagccttctggaaatatggatgacagtggttttttctctattcagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatc

SEQ ID NO: 109353 - DNA, 562 bp, Homo sapiens
  Payload ID: 1477
  Gene Symbol: ATXN3
  Gene Name: ataxin 3
  ENST ID: ENST00000557311
  CDS Start-End: 109-562
cgttggctccagacaaataaacatggagtccatcttccacgagaaagttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctag

SEQ ID NO: 109354 - DNA, 803 bp, Homo sapiens
  Payload ID: 1477
  Gene Symbol: ATXN3
  Gene Name: ataxin 3
  ENST ID: ENST00000555381
  CDS Start-End: 23-803
cgttggctccagacaaataaacatggagtccatcttccacgagaaagttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctag

SEQ ID NO: 109355 - DNA, 943 bp, Homo sapiens
  Payload ID: 1477
  Gene Symbol: ATXN3
  Gene Name: ataxin 3
  ENST ID: ENST00000554350
  CDS Start-End: 23-355
cgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctattggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatc

SEQ ID NO: 109356 - DNA, 924 bp, Homo sapiens
  Payload ID: 1477
  Gene Symbol: ATXN3
  Gene Name: ataxin 3
  ENST ID: ENST00000556315
  CDS Start-End: 23-259
cgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagccttctggaaatatggatgacagtggttttttctctattcagaaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctag

SEQ ID NO: 109357 - DNA, 1010 bp, Homo sapiens
  Payload ID: 1477
  Gene Symbol: ATXN3
  Gene Name: ataxin 3
  ENST ID: ENST00000554592
  CDS Start-End: 23-1010
cgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctag

SEQ ID NO: 109358 - DNA, 1083 bp, Homo sapiens
  Payload ID: 1477
  Gene Symbol: ATXN3
  Gene Name: ataxin 3
  ENST ID: ENST00000556374
  CDS Start-End: 23-367
cgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcagttgctatttttcttaacaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaatcacaactcagaagtagatgaaggaaaattctgatcagctgacatcctcttaatacagcagcaaaagcagcaacagcagcagcagcagcagcagcagggggacctatcaggacagagttcacatccatgtgaaaggccagccaccagttcaggagcacttgggagtgatc

SEQ ID NO: 109359 - DNA, 757 bp, Homo sapiens
  Payload ID: 1477
  Gene Symbol: ATXN3
  Gene Name: ataxin 3
  ENST ID: ENST00000553570
  CDS Start-End: 23-310
cgttggctccagacaaataaacatggagtccatcttccacgagaaacagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatc

SEQ ID NO: 109360 - DNA, 759 bp, Homo sapiens
  Payload ID: 1477
  Gene Symbol: ATXN3
  Gene Name: ataxin 3
  ENST ID: ENST00000554672
  CDS Start-End: 63-759
cgttggctccagacaaataaacatggagtccatcttccacgagaaaccttctggaaatatggatgacagtggttttttctctattcagaaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctag

SEQ ID NO: 109361 - DNA, 921 bp, Homo sapiens
  Payload ID: 1477
  Gene Symbol: ATXN3
  Gene Name: ataxin 3
  ENST ID: ENST00000556671
  CDS Start-End: 23-355
cgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcagtggtttaacttgaattctctcttgacgggtccagaattaatatcagatacatatcttgcacttttcttggctcaattacaacaggaagtcactcaatgagacggctcttccagtcttacaatggagaaagtgaggctcagagactttaagtaacttaccttagacgactttactaggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatc

SEQ ID NO: 109362 - DNA, 913 bp, Homo sapiens
  Payload ID: 1477
  Gene Symbol: ATXN3
  Gene Name: ataxin 3
  ENST ID: ENST00000556274
  CDS Start-End: 23-262
cgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcagaaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaagtaaagtagttgacagcagcaaaagcagcaacagcagcagcagcagcagcagcagggggacctatcaggacagagttcacatccatgtgaaaggccagccaccagttcaggagcacttgggagtgatc

SEQ ID NO: 109363 - DNA, 990 bp, Homo sapiens
  Payload ID: 1477
  Gene Symbol: ATXN3
  Gene Name: ataxin 3
  ENST ID: ENST00000556898
  CDS Start-End: 23-502
cgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctag

SEQ ID NO: 109364 - DNA, 922 bp, Homo sapiens
  Payload ID: 1477
  Gene Symbol: ATXN3
  Gene Name: ataxin 3
  ENST ID: ENST00000554994
  CDS Start-End: 23-475
cgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatc

SEQ ID NO: 109365 - DNA, 760 bp, Homo sapiens
  Payload ID: 1477
  Gene Symbol: ATXN3
  Gene Name: ataxin 3
  ENST ID: ENST00000555816
  CDS Start-End: 23-262
cgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcagaaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctag

SEQ ID NO: 109366 - DNA, 857 bp, Homo sapiens
  Payload ID: 1477
  Gene Symbol: ATXN3
  Gene Name: ataxin 3
  ENST ID: ENST00000553491
  CDS Start-End: 23-857
cgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatc

SEQ ID NO: 109367 - DNA, 807 bp, Homo sapiens
  Payload ID: 1477
  Gene Symbol: ATXN3
  Gene Name: ataxin 3
  ENST ID: ENST00000557030
  CDS Start-End: 22-624
gttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatc

SEQ ID NO: 109368 - DNA, 981 bp, Homo sapiens
  Payload ID: 1477
  Gene Symbol: ATXN3
  Gene Name: ataxin 3
  ENST ID: ENST00000554673
  CDS Start-End: 23-508
cgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaagtcactcaatgagacggctcttccagtcttacaatggagaaagtgaggctcagagactttaagtaacttaccttagacgactttactagttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaa

SEQ ID NO: 109369 - DNA, 1065 bp, Homo sapiens
  Payload ID: 1477
  Gene Symbol: ATXN3
  Gene Name: ataxin 3
  ENST ID: ENST00000553488
  CDS Start-End: 23-262
cgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcagaaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaagtcactcaatgagacggctcttccagtcttacaatggagaaagtgaggctcagagactttaagtaacttaccttagacgactttactagttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaatcacaactcagaagtagatgaaggaaaattctgatcagctgacatcctcttaatacagcagcaaaagcagcaacagcagcagcagcagcagcagcagggggacctatcaggacagagttcacatccatgtgaaaggccagccaccagttcaggagcacttgggagtgatc

SEQ ID NO: 109370 - DNA, 769 bp, Homo sapiens
  Payload ID: 1477
  Gene Symbol: ATXN3
  Gene Name: ataxin 3
  ENST ID: ENST00000556958
  CDS Start-End: 23-322
cgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatc

SEQ ID NO: 109371 - DNA, 597 bp, Homo sapiens
  Payload ID: 1477
  Gene Symbol: ATXN3
  Gene Name: ataxin 3
  ENST ID: ENST00000526872
  CDS Start-End: 1-597
caagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagat

SEQ ID NO: 109372 - DNA, 26812 bp, Homo sapiens
  Payload ID: 1477
  Gene Symbol: ATXN3
  Gene Name: ataxin 3
  Uniprot ID: P54252
  ENST ID: ENST00000558190
  CDS Start-End: 59-1144
ggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttctatttccttttgaatttgtgtttattgttaattcatagctattcaaagtgtgattagagctgggcttggtggcttgcatctacagttccagctacccaggaggcagaagcaggaggattgcttgagcctaggagttcgaggctgcagtgagctatgatcctgccactgaattctagcctgggcgacaaaacaggaaaaaagtatggatggaggaccagcagcatctgtatcacctgtgagtctttcagaaatgcagagtttcaggctacactcggacctactgaatcagaacttgcactttttacaagatccccaggacactaaagtatagagtgaagcttgagaagcgctgttgtgtggattgttcttaaccagctgcagtgatgaatatgaataacgcaggccagcacagtccattgatattctattccagcttactgcctgccaaaaggtccattattactggatcctcagtcttttccaagagaagctaagaattccaaatttttatttgaaatatattttttaaatgtttgttcaactggcccagtgccagtggctcatgcctttaatcctagcactttgagaggccgaggtggaaggatcacttgaccccaggagtttgagaccagcctgggcaacataaagagaccccatctctattaaaaaaaaatagagacaatgctgccttaaaaaagtcaaataaatgtttgctcaactgatttttaatactgagggccaaacaaagcacatcaaatttttaagtgctgcttttcctcattttatccaactctggacaccagaatccaaatgtagtgattggaatccacctagactgattgaggaatatattgtcctcaaattttatgagggttgactattcattttaactttaattaggattgggcacaaattttgaaacataataacattacaggaccggggcccgatccagaccccaagagagggttcttggatcttgtgcaagaatgaattcagggcaagtccataaattgaaagctagttcattaagaaagtagaggaataaaagaatggctaccccataggtagagcagccctgagggctgctggttgccatgtccacccccgcgccccctccccccgctttgttgttgttgtttaagacagagcttcgctgtgtcatcaggctggagtgcagtggcatgatagctcactgcaacctctgcctcccgcgttcaagcaattctcctgcctcagcctcctgagtagctgggactacaggcgtgcaccaccacgcccagctaatttttgtatttttagtagagatgcggtttcaccatgttggccaggaaggtctcaatctcttgacttcgtgatccacccgccttggcctcccaaagtgctgggatgagccacctcgcctggctggttatttcttgatgatatgctaaacaaggggtggattattcatgcctgccctttttagaccatttagggtaacttcccggcattgccatggcatttgtcaactgtcatggtgccaatgggagtgtagcagtgaggaggaccagaggtcactttcatcaccattttggctttttcagccggcttctttactgcaacctgttttatcagcaaggtttttatgatctgtatcttgtgcagaccttctatctcatcctgtgacttagaatgccttaaccatctgggaatgcagcctagtaggtcttggcctcattttaccaaccccctattcaagatggagttgctctggttcaaatgcctctgatatttccctactcccttttataagaaaacccttaatcctaagggttgcagagggatgaagatccatcttctgtattcttcaggctgaataggggtgatgatattcctgcctatgagagtctcttgtattagggtagagaggagctcagtcagtcagtatggctccctatccttcctcccttccccagcccctgacaactaccattctactttgtctctatgattctaagtatctcctataagtggaatcattcagtatttgtagggtttttttgtgactagtgtatttcacttagcatgtcaaggttcatccatgttgtagcatacgtccaaattttcttctttttaaaaactgaataatattccattgtatgatatatgcacattttgcttattcatttatccatcaaagaaaaccagtagcttttttacataccggcagtaacctggttaaaaaaataagatggaaaataccaagcccgaaaatgtcaaattcttgaataccagacaggtactataatccaagctgagcagagaggaatggcccttgtctcagccctgagccacatgtcactacatgggccccaaggagctcttgtgcccagagtcctgctaaggctcgttcttcacccctctaaagtggctcaaactagcgtaggaggccaggagggagcagattctatgccacctccattgcttccgtgccttctccagatccattttttccaaaagctgtgtttgaattctgcacaggggcatctctgtctccaacactgaaaccccttttgccagacccagagaagatttaactgcctttttttttgagacagggcctcgttctgtcacctaagctggagtgcagtggcacgatcttggctcacggcaacctctgcctcctgggctcaagcaattctcctgcctcagccacccgaatagctgggattataggcgcaggccaccacatccagctaagttttgtatttttagtagagacgcagttttgccatgttgcccaggctggtctagaacttctgagctcaggtgatccacccgcctcggcctcccaaagttctgggatgacaggcatgagccacctaacctggccagatttaactgctttgagccaccgtctcacacatcttccaggagcttctagtcaaatgcagaggattaatagtgtataattccatttacataagatctttggaatagtcaaactcatagagacagaaagtagaatggtggttgccgggggatggttgaggggaaaattaggagttgtttaacgagtatggagtttcagtttgggaagatgaaaaaagttctggagatggacagttgtaatggctgcacaacaacgtgaatgtacttaatgccggtgaaccgtataaccatttaacaactgaaaatggttacaaaattttgtgttatatatatcttatcacaataaaaaatatagaggattgatcactatatttgctcccttccaaaatctcacctaggttaaagtaaagaaaaatatataaacccacaagaacacagggaccaggagaggagatgcattcattggattacgtttggttgtaaaaaaaacaaaaaatcctccccggcacggtggctcacaccttgtaatcccagcactttgggaggctgaggcaggcggatcacgaggtcacgagtttgagaccagcctgaccaacatggtgaaacctcatctctactaaaaatacaaaaattagccgggtgtggtggcgtacgcctgtaatcccagctactgaagtggctgagacaggagaattgcttgaacccgggaggcggaggttgcagtgagccgagatcacgccactgcactccagattaggtgacagaacaagactccatctcaaacaaaaacaaaaacaaaaacaaactaatataacagtgactttacatgctatgggttttttttctcctctcatcttcaagaaatgtggagactgccagtccggggatgatacagcatcacagtgtcaggaatctgctctttctgtataattgttacaggaaaggggtccggatccagaccccaagagagggttcttgaattcagggcaagtccacagtgcaaagtgaaagcaagtttactaagaaagtaaaggaataaaaaaatcgctactccatagacagagcagccctgagggctgctggttgcccatttttatggttatttcttgatgatatgctaaacaaggggtggattattcatgcctcccctttttagaccatatagggtaacttcctgatgttgccatggcatttgcaaactgtcatggtgctggtgggggcgtagcaccaaggaggaccagaggtcactcttgtggcctttgtggttttggtgggttttggccagctcctttactgcaacctgttttatcggcaaggactttatgacctgtattttgtgttgaccttgtatctcatcctgtgacttagaatgccttaaccatctgggaatgcagcccagtaggtttcagcctcattttacccagctcctattcaagatggagttgcagccgggcacggtggttcatgcctgtaatcccagcactttgggaggttgaggcgggtggatcacaaggtcaagagttcaagaccagcctggccaacatggcaaaaccccatctctactaaaaatacaaaaattagccaggcgtggttggtgtgcgcctattatgccagctacttgggaggctgatgcaggagaatcacttggatctgggaggcggaggttgcagtaagcagatatcgcgccatgcactccagcctggatgacagagcaagactccgtctcgggggaaaaaaaaaccaaaatggagttgctctggtttacaggcctctgacataatggctttatgtacatggcttccatggctagggtcagctcatagatctaatatggctgtgttggtgctcatgttgcagcccagcaatcagaaagagaaaggaggctgggtttggtggcttacacctgtcatcccagcatttcgggaggccaaggcgggaggatcacatgagcccatgagtttgagaccagcttgagcaacacagggagacctcatctctacaagaaataaaaataaattagttgggtatggtggcatgcacctgtggtcccagctattcgggaggctgaggtgagaggataccttgagcctggaggtttgaggctgcagtgagctatgatcgcaccactgcactccagcctgggcaacagagtgagaccccatctcaaataattaaaaaaaaaaaaaagaaagaaagaaaaaaaaaaggagagcagaaaaaggctatgtaccttttctttcgggttaccttctcaaagttgtgcatactacttccgtttacattacattggccagaacttaacatgacaactactagctacaaggtggtttttattctgggttgccatgcatcttagcttaagtaccctacaggtcctgagataatgattcctatgaaaatgattatttacttatttaattaatttattttgagatggagtctcactctgtcacccaggctggagatcagtggcgtgatctcggctcactgcaacctctgcctcccaggttcaagcaattctcctgcttcagtctcccgagtagctgggactacaggcatgcgccaccatgcccagcttttttgtatttttagtagagacggggtttcactatgttggccaggctgatctcgaactcctgacctcaggtgatctgcctgcctcggcctcccaaagtgctgggattacaggcgtgagccactgtgcctggctgaaaatgattttttaaaagtgttccaggaggaaatggaaagggcataggggagtaagaaagtggaaataggaaaagaaggaagccaagcaagaggagcctatcaagcaaagcctcagtcctgcagacagtctggaggcaggatattcacatcttagagttgtccaaaacagaacaggcaagctgcataattttcaactctggctgaataaggttgcatttcagctctctgggcacctggaaagtatgggctccagtaacctggaggcagtctgctgactgctggctggtgtgcacaaaagtggtaaagggatgagggagtgcaatatgggcactggcatcttggctgtcatgcatccaggtaaaaagtggaggctcaattactatatatgaaggggagaacagactttggggaacaattagcagtcatttccaggtgagacaacaacagaagagaaatgctaatttttttttttttctttgagatggagtttcgctcttgttgcccaggctggagtgcaatggcgctatatccagctcaccgcaacctccgcctcctgggttcaagtgattctcctgcctcagcctcccgagcagctgagattacaggccaccacacccagctaattttgtatttttagtagagacggggtttctccatgttggtcagggtggtctcaaactcccaacctcaggtgatccgcccgcctcagcctcccaaagtgctgggattacaggcgtgaaccaccgcacccggcgagagatgcgaacattttttttgttttttggaggatgacaagttgatgcaggaatgagcagaaccaggaggctgaatactgagtgttaaagagttcctagcaatatgcaggaaaggaaagcaacaagtatcctgagaggtgggggttagatgtagactgaaatcaggaggtgtggttaaaactctttgaaagaggctgggtgcggtggctcacataatcccagcactttgggaggccaaggcgggtgcatcatgaggtcaggagttcgagaccagcctgaccaacatgtgaaaccccgtctctactaaaaatacaaaaattagccgggcatggtggcgcatgcctgtaatcccagctactaaggaggctaaggcaggagaaccgcttgaacctgggaggcgaaggttgcagtgagccgagatcatgccattggactccagcccaggcgacagagagagatcccatctcaaaaaaaaaaaaaaaaaaaaaaaaaaagaaaggaaaagaagaaaagaaaaaagaaacagcagattccctagagaggagacattcatcactaaaaaaaaaaaaaaaaattaaaataaatcgcagaagtaaaagccctttttgaaagggctcagggtacccagcttaatgtatgaaacaaaagcaaacccacatcaaagcacaccattattaatttcagagcatcagaaataaagagaagatctgacaagcttcttggaagaaaacaaggcatagagaataatcagagtagagtagagcaggaaaacagagtcctgggtagagcgaactgagcctagccaatcgatagaattcttgatgttttgttgaaaacagaagcactttacaattctcttggtaagttttagaaagattctgtagtaatggaaaattgtacaaatttaaaaaatggaatctgttaacttcaggaagaacaaaaggtagaaaaatcaaggcaatataatcttggtacaacatttgacttagctgcaatgaataagacttacatagtcatagaaggtaaacactgattacttactttaccaaaaattatgatatcatcatattgaaagcccagaaggaagggaaataaagggaaatacaagagtgctaaatcttttatttttcaataagttggtaatgtctaaaattaataagaaaatggcaaccataagcctaatgcttagaaattcagaaaagtatcagactaaattttaaagtctactttaaactgagtctttgctttatagttgcataaataaattcattttgatggttttctcagaacagatgaactggctgggtgcggtggttcatgcctgtaatcttagcactttgggaggccaaggccgatggctcacttcaagtcaggagtttgagaccagccaaaaaattagccgggtgtggtggtgcacgtttgtaataccagctactcaggaggctgaggcaggagaatcgcttgaacctgggaggcggaggttgcagtgagccaagatggaacgactgcactccagcctgggtgacacagtgagactccgtctcaaaaaaacacaaagaacagatgaactgttttcctttgaggaatattgatgatcccactgcttgagtaatggaaaccagcttgcagctgatagttattttttgtcttttttcctgttctatccactgtcctaggtttggaatttcagctgggcagcttcgatcccaccacctgtagccactgaggttcacaggctctgtttgaggtgttgtgttagattgtgctgggttggttttgctgcttattgagtgatgaagagcaacatattagctactgagatattttgcagaaaaaggaagagatgtcttcagctcaaatgctatcaaacttgtatgtcttttaactttttattataaaaaatttcaaacatatgcaaaagcaaaagactagtttaatgaaccttatgtacccaccacccagtttcaacaattatcagttcctgacaattcttgtttcacctatcccacctctattatacacacatacaaacacacagacaccacacacacacacacacacacacacacgagagcaaagtcaacttccattattttgaagcacatccaagacatcacatcacattatttatcacattatttattaagtttcttcagtcacagtccatctcacagaaagaaatcccccatgagaaacttttaggacatagcttttatgttaattacttaatttctgcactagccatccttgcctgccttctaattttctgcactagctatccttaccttccttctaattttctaacctgccaaggattctgctgcctcaaggtatttgtttctttctgcctggattgctctttcgcagatacttacatgtctcattctttttcacccaggtgaaataaacagcgttgttgctcacacaaagcctgtttggtagtctcttcacatggacgcgtgtgacatttggtgctgaagacccgggacaggaggactccttcaggagacgggtcccctgtccttgccctcactccgtgaggagatccacctacgacctcgggtcctcagaccaaccagcccaaggaacatctcatgaatttcaaatcgggtaagcggtcttttccatcctctcttgctacccttcaatctccctctctcgctacccttcaatctccctgtccttccaattccagttctttttcctctctagtagagacaaaggagacacattttatccgtggacccaaaattccggcgctggtcacggactcaagaagacagtcttctcttggtgtttaatcactgcagggacgactgcctgattattcacccacactccattggtgtctgatcaccgtgggggtgcctgtcttggtcattcacccacattcccttggtggcaagtcaattgcggggacgcctgctttggctgctcacccacccccttctccgtgtctctacctttctctttaaacttacttccttcactatgggcaacattccgtcctccattcccccttctactcccttagcctgtgttctcaagaacttaaaacctcttcaactcacacctgacctaaaacctaaaagccttattttcttctgcaataccgcttggccccaatacaaactcaacagtagttccaagtggccagagaatagcactttggatttgtctgtcctacaggatctagataatttttgttgaaaaatgggcaaatggtctgaggtgcctcagatccaggcattcttttacacactggtccctccctagtctctgctcccagtgcgactcatcccaaatctttcttctttctctcctgtctgttccttcagtctccaccccaagctccgagtcctttgaatcctccttttctatggactcatctgacctctcccctcttccccaggctgctcctcaccaggctgagccaggtcccaattcttcctcagcctccggtcccccaccctataatccttttatcaccccctcctcacaccgtgtctggcttacagtttctttctgtgactagccctcccctacctgcccaacaatttcttcttaaagaggtggctggagctgaaggcatagccaagggtaatgctcctttttctttatctgacctctcccaaatcagttagcgtttaggctctttttcatcaaatataaaaactcaacccagttcatggcctgtttggcaacaacccttggacactttaccgccctagacccagaatggccagaaggccgtcttattctcaacatgcattttattacccaacccactcccgacattagaaaaagctccaaaaattagattccggccctcaaaccccacaacaggacttaattaacatcaccttcaaggtgtacaataatagagtagaggcagccaagtagtaacgtatttctgagttgcaattccttgcctccactgtgagacaaaccccagccacatctccagcacacaagaccttccaaatgcctgaactgcagcggccaggcattcctccaggactgcctaccccaggatcttgcttcaagtgccggaaatctggccactgggccaaggaatgcccccagcccaggattcctcctaagccatgtcccatctgtgcaggaccccactggaaatcggactgtccaacccggcagccactcccagggcccctagaactctggccaaaggctctctgactgactccttcccagatcttctcagcttagcagctgaagactgatgctgcctgatcgccttggaagccccctggaccattacggatgctgagctttggataactcttacagtagagggtaggtccatcccctgtttaatcgatatgggagctacccactccacattaccttcttttcaagggcctgtttcctttgcccctataactgttgtgggtattgatggccaggattctaaaccccttaaaactcccccactctggcaccaacttggacaacattcttttatgtactcttttttagttatccccacctgcccagttcccttattaggccaagacattttaaccaaattatctgcttccctgattattcctggactacagccacatctcattgccacccttcttcccaacccaaagcctccttcgcctcttcctctcgtatcccccaaccttaacccacaagtatgggacacctccactccctccctggcaaccgatcaaacacccattactatcccattaaaacctaatcacccttacctggctcaatgccactattccatcccacaactggctttaagaggactgaagcctgttatcactcgcctgctacagcatgggcttctaaaacctataaactcttcttacaattctcccattttacctgttcaaaaaccggacaagtcttacaggttacctcaggatctggatcttatcaaccaaattgttttgcctatccaccctgtggtgcccaacccatacacttgtttgtcctcaataccttcctccacaactcactattccgttcttgatctcacagatgcttttttcactattccctacaccactcatcccagcctcttttgcttttacctggactgaccctgacacccatcagtcccagcagcttacctgggctgtactgccgcaaggcttcagggacagccctcattacttcagccaagctctttctcatgatatactttctttccatcccttcgcttctcaccttattcaatatattgatgaccttctactttgtagcccctcctttgaatcttctcaacaagatacttttcaacatttattctccaagggatatcggatgtccccctccaaagctcaaatttcttctccatccgttacctacctcagtataattcttcataaaaacacatgtgctctccctgctgatcatgtctgactgatctctcaaaccccaacaccttctacaaaacaacaactcctttccttcctgggcatggttggatacctttgcctttggatacctggttttgccatcctaacaaaaccattatataaactcacaaaagcaaacctagctgacctcataaatcctaaatcctttccccactcccctttccattccttaaaaaacagccctaaaagctgctcccacactagctctccctaactcatcccaacccttttttcattacacacagctgaaatgcagggctgtgcagttggaattcttacacaagagccaggaccatgccctgtagcctttctgtccaaacaacttgaccttactgttttaggctagcccccacattattcctgataccacacctgacccccatgactgtatctctctaatccacctggcattcactccatttccccatacttccttctttcctattcctcaccctgatcacacttggtttattgatggcagttccacctggcctaatcgccattcaccagcaaaggtgggctatgctatagtagtatcttccacatctatccttgaagctaccgctctgcccccctccactacctctcagcaagctgaactcattgccttaactcgagccctcgctcttgcaaaaggactacatgtcaatatttatactgactctaaatatgccttccatatcctgcaccacaatgctgttatatgggcagaaagaggtttcctcagtacgcaaaggtcctccatcattattgcctccttaataaaaactcttctcaaggccgctttacttccaaaggaagctggagtcattcactgcaagggccatcaaaaggcatcagatcccatcgctcagggcaatgcttatgctgataaggtagctaaagaagctgctagctttctaacttctgtccctcacggccagtttttcttcttctcatcagtcactcccacctattcaccgactgaaacttccacctatcaatctcttctcacacaaggcaaatggttcttagaccaaggaaaatatctccttccagcctcacaggcccattctattctgttgtcatttcataacctcttccatgtaggttacaagccactagcccacctcttagaacctctcatttcctttccatcatggaaatctatcctcaaggaaatcacttctcagtgttccatctgctattctactacccctcagggattattcaggccccctccctaccctatacatcaagttcagggatttgcccccacccaggactagcaaattgactctattcacatgccctgagttaggaaactaaaatacctcttggtctgggaagacactttcactggatgggtagaggcctttcccacagggtctgagaaggccaccacagtcatttcttcccttctgtcagaaataatttctcggtttggccttcccacctttatacagtccgataacggactggcctttactagtcaaatcacccaagcagtttctcaggctcttggtattcagtggaaccttcataccccttaccgtcctcaatcttcaggaaaggtagaacggactaatggtcttttaaagacatctcaccaagctcagcctccaacttaaaaaggactggacagtatttttacctcttgcccttcacagaattagagcccgtcctcgagaagctacagggtacagtccatttgaacttttatatggacgcactttcttgctcagccccaacctcgttccagacaccagccctctaggcgactatcttccagtcctctggcaggctagacaggaaatccaccaggctgctaatcttctcttgtctactccagattcccaactatatgaagacaccctagctggacgatcagttcttattaagaacctgacccctcaaactctacaacctcgatggactggaccctacttagtcatctatagtaccccaactgccgtccgcctgcaggatcctccccactgggttcaccgttccagaataaagctgtgcccatcggacaaccagcctaatctctcttcttcctcctggaagtcacaagtactccccactacttcccttaaagtcactctcatttctgaagaacagtaataacccttatgagcctaatacatcccttcattctattagctctattcatccttaccctactttttgcaacagggctttacacagtcaccccccctacttggactgaaccccaaaaacttgtcatccctactatcttctgtttactcatactcccattcactattctcaactactcataaatgccctaatcttgtttacattgcctgtttacactgtttctctaagccatcacagctggtatctcctggtgctatccccaaaccgccactcttaactccctcttagagtggatagatgatatttgctggcagggcaacctccaatattttcactctgatgaagttctattctttacttttatactcactcttattctcattcccattcttatgccaccctctacctctccccagctatctccaccacactatcaatcttactctctcctagccgtttctaatccctccttagcgaataattgctggctttgcatttccctttcttcctgcacctacacagctgcccccgccttatatacagactgggcaacatctcctgtctccctacacctccaaatttcctttaacagccctcatctttaccctcctgaagaacttcttcactttctagacaggtccagcaaggcctccccagacatttcacatcagcaagctgccgccctcctccacacttacttaaaaaacctttctccttatatcaactctactccccccacatttggatccctcacaacacaaactacttttcctgtggctgctcctttatgtatctctcagcaaagacccactggaattcccctgggtaacctttcaccttcttgatgttcattcactcttcatctccaaagcccaactacacacatcactgaaacaactggagccttccagctccgtattacagataagccttttatcaatacaggcaaacttaaaaacattagaagtaattattgcttaggaagacaccctgtatttcactccatccttggctaccttccccttgctcgtcagaccctcctcccaggccttcttgttatacccagccccgtaaataacagtgaaaggttgctcatagacactcgacgttttctcatacaccatgaaaattgaacctctccctctacacagttaccccatcagtccccattacaacctctgacggctgccgccctagctggatccctaggagtctgggtacaagacacccctttcagcactccttctcatctttttactttgcatttccagttttgcctggcacaagctctcttcttcctctgtggatcctctacctacatgtgtctacctgctaactggacaggcacatgcacactcattttccttaatcccaaaattcaatttgcaaatgggaccaaagagcttcctgttcctctcatgacaccgacatgacaaaaaagggttattccactaattcccttgcttgtcggtttaggactttctgcctcctctattgctctcggtactggaatagaaggcatttcaacctctgtcacaaccttccatagcctctctaatgacttctccactagcatcacagacatatcttaaactttatcagtacttcaggcccaagttgactctctggctgcagttgtcctccaaaactgccaaggccttgacttactcactgctgaaaaaggaaggcgctgtgtgtatgtgtgtgtgtatatatatatatatatatatatatatatattttttttttttttttttttttttttttttgagacggagtcttgctctgtcacccaggcagtggcgcatctcggctcactgctcactgcaagctccacctcctgggttcatgccattctcctgcctcagcctcccaagtagctgggactataggcgcctgccaccacgcccggctaattttttgtatttttttagtacagacagggtttcaccatgttagccaggatggtctcgatctcctgacctcatgatccgcctgcctcggcctcccaaagtgctggggttataggcgtgggccactgcgcccggccgggctctgtatatttttaaatgaagagtgttctttttacctaaatcaatctggcctggtgtatgacaatataaaaaaactcaaggacagagtccaaaaacttgccaaccaagcaagtaattatgctgaacccccttgggcactctctaatcggatgtcctgggtcctcccaattcttagtcctttaatacctgtttttctccttctcttatttggaccttgtgtcttccgtttggtttctcagttcatccaaaaccatatccaggccatcaccaatcattctatatgacaaatgctccttctaacaaccccacagtatcactccttaccacaaaatcttccttcagcttaatctctcccactctaggttcccacaccacccctaataccgctcgaagcagccctgaggaacatcgcccattatctctccatactaccccccaaaattttcaccactccaacacttcaacactattttgttttatttttcttattaatataagaagacaggaatgtctggcctctgagccaaggcctgcatgtatacatccagatggcctgaaggaactgaagaatcacaaaagaagtgaaaatggctgattcctgccttaactgatgacattaccctgtgaaattccttctcctggctcagaagctcccccaccaagcaccttgtgacccccccgcccctgcctgccagagaacaaccccctttgactgtagttttccactacccacccaaatcctataaaactgccccacccctaacaccctttgctgactctcttttgggactcagcccacctgcacccaggtgaaataaacagctttattgctcacacaaagcctgtttggaggtctcttcacacggatgcccgtgacaagtgcctgccaccacatcccactaatttttgtatttttagtagagatggggtttcaccatgttggccaggctggtcttgaacgcctgacctcaggtgatccacctgcctcggccttccaaagtgctgagattacaggcgtaagcccctgcacccggccctgttttttttttttttttttttttttacatcccggagtcacactggatatctgaatgtgcttaaaataaaattcacatctcattctggaagtgtttattaaatgctgtccctgcattcatgtgaacatcacagcccagcggttagatgtgcagactccaacgcctgactgcctgggtctgtcacttactagctgtatgaccttggatgggttacttaacatttctgggcactggtttctcattagtaaaatgaagaatgggcgcctgtagtcccagctacttgggagcctgaggcaggagaatcgctttaacccgggagacgaggttgcagtgagcctaggtcccgccattgcactccagcctgggccacagagcgaggctccatctcaaaaaataaaatttaaaaaaaaaaaattcagctttcacggagaattactactgcctggtgccatcagatcccaaatactggaggcattcccaatgttctgttcacaaactgtgcaatctgtgatagcccctcttgtgaatataatcaaagtgaaagatgccagtatacttattgctatgcttaaaagaactgcagatctatcatatccttttgaaaccaaaaaatgtggaagtctccctggctagatgctgtgtgtccacgtatcctgcaccaattgcttgaaagtcacatgacaacctttcttcctttagggaaggaagcaagcaaggtaggactctgtgtgttacagccagtgtgggtaactaaggactgagggaggtgtgggcacttgcatagctagtgccgccaataccataggagcgttgacactaaacggcacttctctattaagttgccctgctgtcttctaacgagtcattttgaaaaacggttgtccgtttttcaactacttgggtgagggcagcttcatgaaaaaagctcatcgtatgttaaagaaggtagggtttcaattgtgagctataaagccaccagaggagatttctcctatagaaggaaggtgtgtttcctgcttggacacctgaatttgcaacccatcctttcttttttcctttttccttttttttttttgcaacccatccgttctatctttgtagcctcagctcctaccatagtgcctgtcacggagcagctaatcgacacagtgacgcgtgtaagttatttgaagccacttcctgcgcagtggaacgtccccgccaagtctcccggcactgctgggtgtagtcccaattaaaacactaggtttcaacaacacaaggagggtccgcagggtccccggactacccaccaagggtcggctctgctttgaaacgcagctgcaggaggccgaggagcgccgcgatgccccagttatccaggccattccttccccggccgaagctggccgcctgcatgcacctaaccttgcgctaggcactggctgcggttaatccagcccgcgctcggtcctccgcgatcccagcctcccttgcgccaaggacacgtccggcggcttcgcggggcctgtctacgccaccgcggcgcttttctatgatccgctgccgctttccgagcgagtgtcatggcggccggcgtcgagttggcaggagtaacccacggaactgaggaaagtcattagagctgagaaagaagtggcccaatctggacggtgggaattcgtgggaatgagcagaaggccctccgtaggtgactgtgtcactagaggcgggcccctggtaaaattccaggccaggcctctgcgtttctaggcagaacctggagtcggccttgcctgagaacccagctttgtgttatcgtatcctgtctcgcgaaggcaggcgttcaaggatatttggtcggatcgcccggcggcgctaaacgttttcttttttccgagcggaccgggtcgttctctaaactcgccgcgatgtcgtcctggcttgggggcctcggctccggattgggccagtctctgggtcaagtcgggggcagcctggcttccctcactggccagatatcaaactttacaaaggatatgctgatggagggcacggaggaagtggaaggtaacagctggagcgagggaagggagggcttttctaagaccctgggaacgtccgtttggtccctacttccatcagtcaggagacgcggacaggtcgcaaaggaatgctgctcctcccttttttcttcacacacctcctcttgcctcttctcaacagattttctatgatgaaagaccactgggggccaggggaagagtcctggttctcctctctttaaatattctggatatctcaaagtacagtagagtgaaactgctcctacgttaagtcgagtttattttcgtttggttgatccacgcccaccactttgccctcagtttgggggctgatctcattcttaacatcttcctgtattctgacccagtttaaagaattgtatatctgttttctatttttgtaacagttgaaataactcataatttaaacacttggtgagttttgctcttttctgtcttgagtatgttatgaaacacggccatgtttttctatttaattattttttacttttccttattgtgatgatacattatagcgttccagctgagaatgtatttttgtgtataatcgcccatttcgcccatatttcgacagtagaatagggaagacaaccctattcttaaggtacccttagcaatcttcactcatttttgaagtcctcaatctcgttttactaatgaatagtgacccagagttacatggtaatcaatggctacattagttactatccattaattactattttgatttcttggcattttagtaagcaatgtttggatcaaaacagtttttaagtttcaatctaagtctgctccagggagataatgggctgttcttttgggtgagagctgctgctttgacaattgtatttcttataaataaatttaataaattagta

SEQ ID NO: 109373 - DNA, 936 bp, Homo sapiens
  Payload ID: 1477
  Gene Symbol: ATXN3
  Gene Name: ataxin 3
  ENST ID: ENST00000621269
  CDS Start-End: 70-936
gagaggggcagggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagtcggaagagacgagaagcctactttga

SEQ ID NO: 109374 - DNA, 1074 bp, Homo sapiens
  Payload ID: 1477
  Gene Symbol: ATXN3
  Gene Name: ataxin 3
  ENST ID: ENST00000617719
  CDS Start-End: 23-928
cgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaatcacaactcagaagtagatgaaggaaaattctgatcagctgacatcctcttaataatgtttcagacagcagcaaaagcagcaacagcagcagcagcagcagcagcagggggacctatcaggacagagttcacatccatgtgaaaggccagccaccagttcaggagcacttgggagtgatc

SEQ ID NO: 109375 - DNA, 1044 bp, Homo sapiens
  Payload ID: 1477
  Gene Symbol: ATXN3
  Gene Name: ataxin 3
  ENST ID: ENST00000620536
  CDS Start-End: 70-1044
gagaggggcagggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaagccgaggcaggcagattacgaaagacaacagcagcaaaagcagcaacagcagcagcagcagcagcagcaggggcctatcaggacagagttcacatccatgtga

SEQ ID NO: 109376 - DNA, 1717 bp, Homo sapiens
  Payload ID: 1478
  Gene Symbol: ATXN3L
  Gene Name: ataxin 3-like
  Uniprot ID: Q9H3M9
  ENST ID: ENST00000380622
  CDS Start-End: 19-1086
ctcacggatacaattaacatggatttcatctttcatgagaaacaggaaggtttcctgtgtgctcagcactgtctgaacaatctattgcaaggagaatattttagccctgtggaattagcctcaattgcacatcagctagatgaagaagagaggatgagaatggcagaaggaggagtcaccagtgaagagtatcttgcatttttacagcagccttcagaaaacatggatgataccggtttcttctccattcaggtaataagcaatgccttgaagttctggggtttagagatcatccatttcaataatcctgaatatcagaagctcggcattgatcctataaatgaaagatcttttatatgtaattataaacaacactggtttactattagaaaatttggaaaacactggtttaacttgaattctctcttggcgggtccagaattaatatcagatacatgccttgcaaatttcttggctcgattacaacaacaagcatattctgtatttgttgtcaagggtgatctgccagactgtgaagctgaccaactcctgcagatcatcagtgtcgaagagatggatacaccaaaacttaatggaaaaaaattagtaaaacaaaaagagcatagagtctataaaacagtccttgaaaaagtatcagaagaaagtgatgagtctggaacatcagaccaagatgaggaggattttcagagggcccttgaactaagccgccaagaaaccaatagagaagatgaacatctccgcagtactattgagttaagcatgcaaggtagttccggaaacacatcgcaagatcttccaaagacatcatgtgtaactcctgcttcagaacagccgaagaaaataaaagaagactattttgaaaagcatcagcaggaacagaagcagcagcaacaacagtcagatctgccgggccacagttcatacctacacgaaaggccaacaacaagttcgagagcaattgagagtgatctcagtgatgacatcagtgaaggcacagtacaggccgctgtcgacaccattttagaaattatgagaaagaatttgaaaatcaaaggggaaaaataatgcctttaaaaataatttagatagtcatactttccaacattatcctgtgtgattatactgtaggatccattttggtcatctgtcaaagagatgaggaaataaggcttttagacagtttgcaaacaaaatgacgagagagatgtgggactaaataatgatcgttcaactactagccaaggagacattcagcaattaattaaatttaaattagctttcaaaatgttcctttgatttttgagcctgcaatatctaatgtgtctaaaattgggtcatttttcatggatctttttgtataccaacgaattagctcttgccatagaactttttccatatagtctcttctattgtagataatgtggctcattttggttgcttttatttctcatgaaacaatttaacctttcagggaagtgtctcttgtctgtgttgatcatagtaacggttttagaaggataaacagttctccctccaactatgtactgtgcgcttaagtatattcttatgttatttcctctgatcacaatttctgctacctggtccttaattattttccacaagtctttcgaaatatggtaatattttctgaggttttgttttttacgccctctgtggtaagatcattatttcatga

SEQ ID NO: 109377 - DNA, 837 bp, Homo sapiens
  Payload ID: 1478
  Gene Symbol: ATXN3L
  Gene Name: ataxin 3-like
  ENST ID: ENST00000622204
  CDS Start-End: 19-504
ctcacggatacaattaacatggatttcatctttcatgagaaacaggaaggtttcctgtgtgctcagcactgtctgaacaatctattgcaaggagaatattttagccctgtggaattagcctcaattgcacatcagctagatgaagaagagaggatgagaatggcagaaggaggagtcaccagtgaagagtatcttgcatttttacagcagccttcagaaaacatggatgataccggtttcttctccattcagtggtttaacttgaattctctcttggcgggtccagaattaatatcagatacatgccttgcaaatttcttggctcgattacaacaacaagcatattctgtatttgttgtcaagggtgatctgccagactgtgaagctgaccaactcctgcagatcatcagtgtcgaagagatggatacaccaaaacttaatggaaaaaaattagtaaaacaaaaagagcatagagtctataaacagtccttgaaaaagtatcagaagaaagtgatgagtctggaacatcagaccaagatgaggaggattttcagagggcccttgaactaagccgccaagaaaccaatagagaagatgaacatctccgcagtactattgagttaagcatgcaaggtagttccggaaacacatcgcaagatcttccaaagacatcatgtgtaactcctgcttcagaacagccgaagaaaataaaagaagactattttgaaaagcatcagcaggaacagaagcagcagcaacaacagtcagatctgccgggccacagttcatacctacacgaaaggccaacaacaagttcgagagcaattgagagtgatc

SEQ ID NO: 109378 - DNA, 7224 bp, Homo sapiens
  Payload ID: 1479
  Gene Symbol: ATXN7
  Gene Name: ataxin 7
  Uniprot ID: O15265
  ENST ID: ENST00000295900
  CDS Start-End: 551-3229
aaagggtgaaagagaaacttggcgacctcccggaggagttcgcgaagcgaccaggagcgtgttgccatcgtcctcacccggcacccaattccaccacagagtcgggatttcgtcggtgatcgtgatggggtgcttttatttttctctttgattttcaaaaaatgtctatgtgactgtccctatcttaaggggaagttgaaagtgggggcgggggtgctcaatgagaaacgttgccttgtgtgtagttgtttggagcacactgcaaattatattggcatctctttccaaaagtcactttgattcaacttcgatagctttctcgtaaatggcacgtttaggtggtgagaggtggatgaggaaacaggcaccagtgcagctgatttgacctccagtgggatagatacgattagcaccaggatcgtgtctcattttgaacccagatctgaacagaattaagacgaacgagctttcacaattgcagcagatgaagatccattggtaaattgatcaggatttttggcctaccctccaaagaaaaggagcggaaagaatgtcggagcgggccgcggatgacgtcaggggggagccgcgccgcgcggcggcggcggcgggcggagcagcggccgcggccgcccggcagcagcagcagcagcagcagcagcagcagccgccgcctccgcagccccagcggcagcagcacccgccaccgccgccacggcgcacacggccggaggacggcgggcccggcgccgcctccacctcggccgccgcaatggcgacggtcggggagcgcaggcctctgcccagtcctgaagtgatgctgggacagtcgtggaatctgtgggttgaggcttccaaacttcctgggaaggacgggacagaattggacgaaagtttcaaggagtttgggaaaaaccgcgaagtcatggggctctgtcgggaagacatgccaatatttggtttctgtccagcccatgatgatttctacttggtggtgtgtaacgactgtaatcaggttgtcaaaccgcaggcatttcaatcacattatgaaagaagacatagctcatccagcaagccgcctttggccgttcctcccacttcagtattttccttcttcccttctctgtccaaaagcaaaggaggcagtgcaagtggaagcaaccgttcttccagtggaggtgttcttagcgcatcctcatcaagttccaagttgttgaaatcacccaaagagaaactgcagctcagggggaacaccaggccaatgcatcccattcagcaaagtagagttccccatggtagaatcatgacaccctctgtgaaagtggaaaagattcatccgaaaatggatggcacactactgaaatctgcggtggggccaacctgtcctgctactgtgagttccttagtcaagcctggccttaactgcccctcaataccaaagccaaccttgccttcacctggacagattctgaatggcaaagggcttcctgcaccgcccactctggaaaagaaacctgaagacaattccaataataggaaatttttaaataagagattatcagaaagagagtttgatcctgacatccactgtggggttattgatctcgacaccaagaagccctgcacccggtctttgacatgcaagacacattccttaacccagcgcagggctgtccagggtagaagaaaacgatttgatgtgttattagccgagcacaaaaacaaaaccagggaaaaggaattgattcgccatccggactctcagcaaccaccgcagcctctcagggacccgcatcccgcccctcctagaacgtcacaggagccgcaccaaaaccctcacggagtgattccttccgaatcaaagccttttgtagctagtaaacctaaacctcacacccccagtcttccaaggcctccaggctgccctgctcagcaaggtgggagtgcccccattgaccctcctccagtccatgaatctccacaccctcccctgcctgccactgagccagcttctcggttatccagtgaggagggcgaaggcgatgacaaagaagagtctgttgaaaaactggactgtcattattcaggtcatcatcctcagccagcatctttttgcacatttgggagccggcagataggaagaggctattacgtgtttgactccaggtggaatcgacttcgctgcgccctcaacctcatggtggagaagcatctgaatgcacagctatggaagaaaatcccaccagtgcccagtaccacctcacccatctccacacgtattcctcaccggacaaactctgtgccgacatcacaatgtggagtcagctatctggcagcagccaccgtctctacatccccagtcctgctctcatctacctgcatctccccaaatagcaaatcggtaccagctcatggaaccacactaaatgcacagcctgctgcttcaggggcgatggatcctgtgtgcagtatgcaatccagacaagtgtcctcttcatcctcatccccttccacgccctctggcctttcctcggttccttcctcccccatgtccaggaaacctcagaaattgaaatccagcaaatctttgaggcccaaggagtcttctggtaacagcactaactgtcaaaatgccagtagcagtaccagtggcggctcaggaaagaaacgcaaaaacagttccccactgttggttcactcttcctcctcctcttcctcctcctcctcttcttctcattccatggagtcttttaggaaaaactgtgtggctcactctgggcctccctacccctcaacggtaacatcttcccatagcatcggcctcaactgtgtgacgaataaagcaaatgcggtgaacgtccggcatgaccagtcagggaggggcccccccaccgggagccctgctgaatccatcaagaggatgagtgtgatggtgaacagcagtgattctactctttctcttgggccattcattcaccagtccaatgaactgcctgtcaactcccacggcagtttttcccactcacacactcctctagacaaactcataggaaagaaaagaaagtgctcacccagctcgagcagcatcaacaacagcagcagcaaacccacaaaggttgccaaagtgccagccgtgaacaatgtccacatgaaacacacaggcaccatcccaggggcacaaggactgatgaacagttccctccttcatcagccaaaggcacgtccctgacagctgaaaatagcacggggaggaataatgcggacacttttgaggacaagttacacctccactcagcactctggactccacgatgcctttgagtctgttttcccaacctcctgtgggcctcaagggtagaaacctgccgggctgttgttttaacgaggatttccctgaagctatgtctctagcagtgagtactcataaaggacactggatcaagttcagccaccgaattgcttttatcagtgttaaagtggtctgaactgcttgctaccaatctgtgagaagtttttgtttttgttttgttttttaacttgcagtatatcacagagccactcttcaagtagattggctgggcaaaagaatgttttggcaagagcgttactgtagacctttctccctccttccttttactaccatttttttttaacactgtcatctgtaggtcactctccagcagttaggcaccttaactggagaccagaaaccttccagagaacacagggctgcatcccgagcaaccctctgaagaagggaattaggctttagattttgatagcaatgttccaggaatgaaatatagatgttagcccaagacaccatgacaaaatagcccagccttttgagagtaatttgggaaaagaagctgtcagaagtttctaacttacaaactggtttgaaatttttgatgcccagacagcaagtataaatcattttggaggcttacttttcatgatacaaaagcaattctgtgtgatttttttttttaagaagaaagaaaatgcaagctagttttgagaaaggaaggccaaattgggtcgggggagggtgggagtgaggaagttaaaatcactatagggagaaaaaacttttttcaagatttccaaagagatgaaattttcttaatccttttaagttttcatagtaaacagtatggcagattgggttggttgtcctacctggtctatttttaaaagtcaccttttaaagtgacattattagatacacttaaatgtttccaaggcactctctacattacccttgtttttctctttggatactgtcctgggactaagtgtagatttctgcttcaagcacttctggcattgtgtgtttttgtatgcactccccttcatgccacttcagatgtttatttggatgtggttggggacgagagcagacaccaaggaaagggagttggagagaatgtaagtcctgacctgaaggtcttttgtgatgcatgtataggattgccctgacacacaccctcctttcttgggattataccagccatcttcctgagagttttggagccctctaggatattttttctagtaccccaccccccacccctaaagaaagaccttaatatgttaaaacagcattgcttggagaaggtgtcattgaattccgggacgagccggagcctttaaatgggtgcttccaccactacaggctcctgacacgagtaacaggcactgttgcttagaagaacacacgaagttgccgaacacagggtaaaatttccaaggcgctgatcgttgccctggccagggcctgatgagagccagtcagtacattctttttttcctacagttcttgggtttcaaacttcagtttcagggaatttcaagtcaacaacaggtagaatgaataaacttggttaccagcctaataatgtgaattgctacagaattattcttattatgtaagaaaacaaaaactttatgcagatactttagctataaattgatgtaaaatactgatttttttaaaggaaggagagaacagtatcttgttcaattattatgcaatcaatcagtaaatgtttttaaaatgatactacaggagagcttagtaaggagagggcatggatgggccagtttggcatagttgggagaaatcagtctggtttccatcccagtcggggaagagagaggtgagagggaatcagaacgtacctagttgattccttggtgacaagtgcaatggggtatgggtagaatttattttcagagccaagaggacttgatggttataaataaagttgcctttagcaatggaatttacagatcgatcatgttgttccgaaagatgtgaataggatccacaataacaagttgattcagactaatgtagatatttagattagcaagtattgaacatttgatttcttagactgaggttttaaatgaatttcattatttctcccggtaatacacagagcatcgggattaggaaattagccattttggattctgtctgccacaaacagacctattctaaacagtgctattaaattttagactgttgttcaaatattttattttctcctaaactactttttatggtgatgaataattaagaccatttaaaacacgggagtacaagtatttttttgaattaaattaacttgcaaaaaccaaatttgcagtggttgggttgtttctagacagactttggtatcaatttaaaaccaagataatttttatattctttccaatagaatttcatgacaactcctgcagttttcttaacctacaaaaaaaaaaaaaaagtgctgcaatgatgaacaaagaattatacaaaacctacttttgtatctttattttggaatttcttgttctattataaatatggaagtatccctatttcagaagacatattttgttaaaaatgaattgtacatatttaaatatgtatttttgcacaggtctttttttctgatatcctgttttggtacaattgagatcatctagtatttatttattaattaataaaagtaaatacctttttataatttgaagtggttcactgccaagccaatagttctagaacctgcctcctttacagttttaagggatgcctctgttctgtgaaaagtctttgtcccttttagtgtctcgggagtggattcatacagatgaagtgggcattgcttcttcctggttgcctggtttcccgatagactacatgtaactaagtgacacactgcttttcttttgttagtattttatgtgtgggagtatgtgactgcgtgtgtgtgtgcctgtgcgtgtgtgtgtatactcagcacatgtatgttactatgtgatgtggtttaaaactaatggaaaaaactgaaagtgcctgaaactagttttaagcttagacagaatctctttaaaaagacttgaatgttcagttgaacttttggagtttgctttttccacctaaatattgtttctaaaattttaggggcggagttgaaaaccaccaatgctggtaattttataaggtattttaaaattaagacctcttggttcatagtaattcaattggtgatggattgcctggtggcaccaagggttacagatctttttgtcagccagcaacttacacgatgtgtccgttttgttattcactcatgaaatacaatttaaaatatttaaaatattttgtattccaaaaatataatacaaagaagtacctctgagaacattgaaaaaaatgtataatttgaaaaatgtaacttataagggcagctgtcttcctgcaagagttctgttgccaaggaatttcttaatgtcgctcattctgtccagggggtttggggcgattgggctttgaaaaaatattcttaaaagtttgtttagcagaaaataatcacttttacattttgtgcaaaacattttacattttcagataatttaaatgagcactacatactgtcagtgtgaatgtagggccttgaaagcattttgcttttttttttttttttttttttttgagcttggttataaaagcaatctcctgtgttaaaaacgtgtgaatagtttgataatttgtacacataatcaagagcatctcagctggactttgtgttggctgctgtatagaacatgaacaaatgtcaagggatagaaaattactttggatatttaaaagagaagaaatatatagtctatttgttttgtaacaagtttctgtaaataaaataatttatactatttataagaaaa

SEQ ID NO: 109379 - DNA, 728 bp, Homo sapiens
  Payload ID: 1479
  Gene Symbol: ATXN7
  Gene Name: ataxin 7
  ENST ID: ENST00000474513
  CDS Start-End: 652-728
gaaaaagggtgaaagagaaacttggcgacctcccggaggagttcgcgaagcgaccaggagcgtgttgccatcgtcctcacccggcacccaattccaccacagagtcgggatttcgtcggtgatcgtgatggggtgcttttatttttctctttgattttcaaaaaatgtctatgtgactgtccctatcttaaggggaagttgaaagtgggggcgggggtgctcaatgagaaacgttgccttgtgtgtagttgtttggagcacactgcaaattatattggcatctctttccaaaagtcactttgattcaacttcgatagctttctcgtaaatggcacgtttaggtggtgagaggtggatgaggaaacaggcaccagtgcagctgatttgacctccagtgggatagatacgattagcaccaggatcgtgtctcattttgaacccaggctggagcgcagtggcacaatcgtggcttactgcagcgttgacctcctggcctcaagcagtcctcccactgcagcttctcaagaagccggggatacagatctgaacagaattaagacgaacgagctttcacaattgcagcagatgaagatccattggtaaattgatcaggatttttggcctaccctccaaagaaaaggagcggaaagaatgtcggagcgggccgcggatgacgtcaggggggagccgcgccgcgcggcggcggcggcgggcggagcagcggccgc

SEQ ID NO: 109380 - DNA, 3683 bp, Homo sapiens
  Payload ID: 1479
  Gene Symbol: ATXN7
  Gene Name: ataxin 7
  Uniprot ID: O15265
  ENST ID: ENST00000487717
  CDS Start-End: 265-2943
ctgccctggggccggccggccggctcctccataggtggctgcatttccgacttcgccctggctccagtccgggggcttgacgtgcaaacttcgccggagcgagctgagagggagggaccggcaagtgggaggaggcggcgggaggcgtctccgcttaagggagccggccgggtgccgccgctcggacggacgcgcggacggaaggaaggagcggggcagccgggccgggcccggggatgcaagcggccgaagggagcggaaagaatgtcggagcgggccgcggatgacgtcaggggggagccgcgccgcgcggcggcggcggcgggcggagcagcggccgcggccgcccggcagcagcagcagcagcagcagcagcagcagccgccgcctccgcagccccagcggcagcagcacccgccaccgccgccacggcgcacacggccggaggacggcgggcccggcgccgcctccacctcggccgccgcaatggcgacggtcggggagcgcaggcctctgcccagtcctgaagtgatgctgggacagtcgtggaatctgtgggttgaggcttccaaacttcctgggaaggacgggacagaattggacgaaagtttcaaggagtttgggaaaaaccgcgaagtcatggggctctgtcgggaagacatgccaatatttggtttctgtccagcccatgatgatttctacttggtggtgtgtaacgactgtaatcaggttgtcaaaccgcaggcatttcaatcacattatgaaagaagacatagctcatccagcaagccgcctttggccgttcctcccacttcagtattttccttcttcccttctctgtccaaaagcaaaggaggcagtgcaagtggaagcaaccgttcttccagtggaggtgttcttagcgcatcctcatcaagttccaagttgttgaaatcacccaaagagaaactgcagctcagggggaacaccaggccaatgcatcccattcagcaaagtagagttccccatggtagaatcatgacaccctctgtgaaagtggaaaagattcatccgaaaatggatggcacactactgaaatctgcggtggggccaacctgtcctgctactgtgagttccttagtcaagcctggccttaactgcccctcaataccaaagccaaccttgccttcacctggacagattctgaatggcaaagggcttcctgcaccgcccactctggaaaagaaacctgaagacaattccaataataggaaatttttaaataagagattatcagaaagagagtttgatcctgacatccactgtggggttattgatctcgacaccaagaagccctgcacccggtctttgacatgcaagacacattccttaacccagcgcagggctgtccagggtagaagaaaacgatttgatgtgttattagccgagcacaaaaacaaaaccagggaaaaggaattgattcgccatccggactctcagcaaccaccgcagcctctcagggacccgcatcccgcccctcctagaacgtcacaggagccgcaccaaaaccctcacggagtgattccttccgaatcaaagccttttgtagctagtaaacctaaacctcacacccccagtcttccaaggcctccaggctgccctgctcagcaaggtgggagtgcccccattgaccctcctccagtccatgaatctccacaccctcccctgcctgccactgagccagcttctcggttatccagtgaggagggcgaaggcgatgacaaagaagagtctgttgaaaaactggactgtcattattcaggtcatcatcctcagccagcatctttttgcacatttgggagccggcagataggaagaggctattacgtgtttgactccaggtggaatcgacttcgctgcgccctcaacctcatggtggagaagcatctgaatgcacagctatggaagaaaatcccaccagtgcccagtaccacctcacccatctccacacgtattcctcaccggacaaactctgtgccgacatcacaatgtggagtcagctatctggcagcagccaccgtctctacatccccagtcctgctctcatctacctgcatctccccaaatagcaaatcggtaccagctcatggaaccacactaaatgcacagcctgctgcttcaggggcgatggatcctgtgtgcagtatgcaatccagacaagtgtcctcttcatcctcatccccttccacgccctctggcctttcctcggttccttcctcccccatgtccaggaaacctcagaaattgaaatccagcaaatctttgaggcccaaggagtcttctggtaacagcactaactgtcaaaatgccagtagcagtaccagtggcggctcaggaaagaaacgcaaaaacagttccccactgttggttcactcttcctcctcctcttcctcctcctcctcttcttctcattccatggagtcttttaggaaaaactgtgtggctcactctgggcctccctacccctcaacggtaacatcttcccatagcatcggcctcaactgtgtgacgaataaagcaaatgcggtgaacgtccggcatgaccagtcagggaggggcccccccaccgggagccctgctgaatccatcaagaggatgagtgtgatggtgaacagcagtgattctactctttctcttgggccattcattcaccagtccaatgaactgcctgtcaactcccacggcagtttttcccactcacacactcctctagacaaactcataggaaagaaaagaaagtgctcacccagctcgagcagcatcaacaacagcagcagcaaacccacaaaggttgccaaagtgccagccgtgaacaatgtccacatgaaacacacaggcaccatcccaggggcacaaggactgatgaacagttccctccttcatcagccaaaggcacgtccctgacagctgaaaatagcacggggaggaataatgcggacacttttgaggacaagttacacctccactcagcactctggactccacgatgcctttgagtctgttttcccaacctcctgtgggcctcaagggtagaaacctgccgggctgttgttttaacgaggatttccctgaagctatgtctctagcagtgagtactcataaaggacactggatcaagttcagccaccgaattgcttttatcagtgttaaagtggtctgaactgcttgctaccaatctgtgagaagtttttgtttttgttttgttttttaacttgcagtatatcacagagccactcttcaagtagattggctgggcaaaagaatgttttggcaagagcgttactgtagacctttctccctccttccttttactaccatttttttttaacactgtcatctgtaggtcactctccagcagttaggcaccttaactggagaccagaaaccttccagagaacacagggctgcatcccgagcaaccctctgaagaagggaattaggctttagattttgatagcaatgttccaggaatgaaatatagatgttagcccaagacaccatgacaaaatagcccagccttttgagagtaatttgggaaaagaagctgtcagaagtttctaacttacaaactggtttgaaatttttgatgcccagacagcaagtataaatcattttggaggcttacttttcatgatacaaaagca

SEQ ID NO: 109381 - DNA, 346 bp, Homo sapiens
  Payload ID: 1479
  Gene Symbol: ATXN7
  Gene Name: ataxin 7
  ENST ID: ENST00000522345
  CDS Start-End: 1-346
gacaaactcataggaaagaaaagaaagtgctcacccagctcgagcagcatcaacaacagcagcagcaaacccacaaaggttgccaaagtgccagccgtgaacaatgtccacatgaaacacacaggcaccatcccaggggcacaaggactgatgaacagttccctccttcatcaggatatctcctcaccttgcttacgaacaggaatttcagcaacatcaccccagagccctgacttaaaatccaaaggcacgtccctgacagctgaaaatagcacggggaggaataatgcggacacttttgaggacaagttacacctccactcagcactctggactccacgatgcc

SEQ ID NO: 109382 - DNA, 2741 bp, Homo sapiens
  Payload ID: 1479
  Gene Symbol: ATXN7
  Gene Name: ataxin 7
  Uniprot ID: O15265
  ENST ID: ENST00000484332
  CDS Start-End: 169-2412
gttttctgttgatctgccaggacctttgtaattcaagtgctttttacagtagtagcaaatgttacataagcccaaacatggagcatatttggagttggtgggcagacccaaatcatgatgcaagcctgcagtagcaagtgtgcaatgaagcacaaccaaattctgtgaatggaaggtagcaagacgcctctccaaagcagcccttctgcgcaggagctgaaagctccactggaaagaagacatagctcatccagcaagccgcctttggccgttcctcccacttcagtattttccttcttcccttctctgtccaaaagcaaaggaggcagtgcaagtggaagcaaccgttcttccagtggaggtgttcttagcgcatcctcatcaagttccaagttgttgaaatcacccaaagagaaactgcagctcagggggaacaccaggccaatgcatcccattcagcaaagtagagttccccatggtagaatcatgacaccctctgtgaaagtggaaaagattcatccgaaaatggatggcacactactgaaatctgcggtggggccaacctgtcctgctactgtgagttccttagtcaagcctggccttaactgcccctcaataccaaagccaaccttgccttcacctggacagattctgaatggcaaagggcttcctgcaccgcccactctggaaaagaaacctgaagacaattccaataataggaaatttttaaataagagattatcagaaagagagtttgatcctgacatccactgtggggttattgatctcgacaccaagaagccctgcacccggtctttgacatgcaagacacattccttaacccagcgcagggctgtccagggtagaagaaaacgatttgatgtgttattagccgagcacaaaaacaaaaccagggaaaaggaattgattcgccatccggactctcagcaaccaccgcagcctctcagggacccgcatcccgcccctcctagaacgtcacaggagccgcaccaaaaccctcacggagtgattccttccgaatcaaagccttttgtagctagtaaacctaaacctcacacccccagtcttccaaggcctccaggctgccctgctcagcaaggtgggagtgcccccattgaccctcctccagtccatgaatctccacaccctcccctgcctgccactgagccagcttctcggttatccagtgaggagggcgaaggcgatgacaaagaagagtctgttgaaaaactggactgtcattattcaggtcatcatcctcagccagcatctttttgcacatttgggagccggcagataggaagaggctattacgtgtttgactccaggtggaatcgacttcgctgcgccctcaacctcatggtggagaagcatctgaatgcacagctatggaagaaaatcccaccagtgcccagtaccacctcacccatctccacacgtattcctcaccggacaaactctgtgccgacatcacaatgtggagtcagctatctggcagcagccaccgtctctacatccccagtcctgctctcatctacctgcatctccccaaatagcaaatcggtaccagctcatggaaccacactaaatgcacagcctgctgcttcaggggcgatggatcctgtgtgcagtatgcaatccagacaagtgtcctcttcatcctcatccccttccacgccctctggcctttcctcggttccttcctcccccatgtccaggaaacctcagaaattgaaatccagcaaatctttgaggcccaaggagtcttctggtaacagcactaactgtcaaaatgccagtagcagtaccagtggcggctcaggaaagaaacgcaaaaacagttccccactgttggttcactcttcctcctcctcttcctcctcctcctcttcttctcattccatggagtcttttaggaaaaactgtgtggctcactctgggcctccctacccctcaacggtaacatcttcccatagcatcggcctcaactgtgtgacgaataaagcaaatgcggtgaacgtccggcatgaccagtcagggaggggcccccccaccgggagccctgctgaatccatcaagaggatgagtgtgatggtgaacagcagtgattctactctttctcttgggccattcattcaccagtccaatgaactgcctgtcaactcccacggcagtttttcccactcacacactcctctagacaaactcataggaaagaaaagaaagtgctcacccagctcgagcagcatcaacaacagcagcagcaaacccacaaaggttgccaaagtgccagccgtgaacaatgtccacatgaaacacacaggcaccatcccaggggcacaaggactgatgaacagttccctccttcatcagccaaaggcacgtccctgacagctgaaaatagcacggggaggaataatgcggacacttttgaggacaagttacacctccactcagcactctggactccacgatgcctttgagtctgttttcccaacctcctgtgggcctcaagggtagaaacctgccgggctgttgttttaacgaggatttccctgaagctatgtctctagcagtgagtactcataaaggacactggatcaagttcagccaccgaattgcttttatcagtgttaaagtggtctgaactgcttgctaccaatctgtgagaagtttttgtttttgttttgttttttaacttgcagtatatcacagagcca

SEQ ID NO: 109383 - DNA, 6842 bp, Homo sapiens
  Payload ID: 1479
  Gene Symbol: ATXN7
  Gene Name: ataxin 7
  Uniprot ID: O15265
  ENST ID: ENST00000538065
  CDS Start-End: 111-2948
atctgaacagaattaagacgaacgagctttcacaattgcagcagatgaagatccattggtaaattgatcaggatttttggcctaccctccaaagaaaaggagcggaaagaatgtcggagcgggccgcggatgacgtcaggggggagccgcgccgcgcggcggcggcggcgggcggagcagcggccgcggccgcccggcagcagcagcagcagcagcagcagcagcagccgccgcctccgcagccccagcggcagcagcacccgccaccgccgccacggcgcacacggccggaggacggcgggcccggcgccgcctccacctcggccgccgcaatggcgacggtcggggagcgcaggcctctgcccagtcctgaagtgatgctgggacagtcgtggaatctgtgggttgaggcttccaaacttcctgggaaggacgggacagaattggacgaaagtttcaaggagtttgggaaaaaccgcgaagtcatggggctctgtcgggaagacatgccaatatttggtttctgtccagcccatgatgatttctacttggtggtgtgtaacgactgtaatcaggttgtcaaaccgcaggcatttcaatcacattatgaaagaagacatagctcatccagcaagccgcctttggccgttcctcccacttcagtattttccttcttcccttctctgtccaaaagcaaaggaggcagtgcaagtggaagcaaccgttcttccagtggaggtgttcttagcgcatcctcatcaagttccaagttgttgaaatcacccaaagagaaactgcagctcagggggaacaccaggccaatgcatcccattcagcaaagtagagttccccatggtagaatcatgacaccctctgtgaaagtggaaaagattcatccgaaaatggatggcacactactgaaatctgcggtggggccaacctgtcctgctactgtgagttccttagtcaagcctggccttaactgcccctcaataccaaagccaaccttgccttcacctggacagattctgaatggcaaagggcttcctgcaccgcccactctggaaaagaaacctgaagacaattccaataataggaaatttttaaataagagattatcagaaagagagtttgatcctgacatccactgtggggttattgatctcgacaccaagaagccctgcacccggtctttgacatgcaagacacattccttaacccagcgcagggctgtccagggtagaagaaaacgatttgatgtgttattagccgagcacaaaaacaaaaccagggaaaaggaattgattcgccatccggactctcagcaaccaccgcagcctctcagggacccgcatcccgcccctcctagaacgtcacaggagccgcaccaaaaccctcacggagtgattccttccgaatcaaagccttttgtagctagtaaacctaaacctcacacccccagtcttccaaggcctccaggctgccctgctcagcaaggtgggagtgcccccattgaccctcctccagtccatgaatctccacaccctcccctgcctgccactgagccagcttctcggttatccagtgaggagggcgaaggcgatgacaaagaagagtctgttgaaaaactggactgtcattattcaggtcatcatcctcagccagcatctttttgcacatttgggagccggcagataggaagaggctattacgtgtttgactccaggtggaatcgacttcgctgcgccctcaacctcatggtggagaagcatctgaatgcacagctatggaagaaaatcccaccagtgcccagtaccacctcacccatctccacacgtattcctcaccggacaaactctgtgccgacatcacaatgtggagtcagctatctggcagcagccaccgtctctacatccccagtcctgctctcatctacctgcatctccccaaatagcaaatcggtaccagctcatggaaccacactaaatgcacagcctgctgcttcaggggcgatggatcctgtgtgcagtatgcaatccagacaagtgtcctcttcatcctcatccccttccacgccctctggcctttcctcggttccttcctcccccatgtccaggaaacctcagaaattgaaatccagcaaatctttgaggcccaaggagtcttctggtaacagcactaactgtcaaaatgccagtagcagtaccagtggcggctcaggaaagaaacgcaaaaacagttccccactgttggttcactcttcctcctcctcttcctcctcctcctcttcttctcattccatggagtcttttaggaaaaactgtgtggctcactctgggcctccctacccctcaacggtaacatcttcccatagcatcggcctcaactgtgtgacgaataaagcaaatgcggtgaacgtccggcatgaccagtcagggaggggcccccccaccgggagccctgctgaatccatcaagaggatgagtgtgatggtgaacagcagtgattctactctttctcttgggccattcattcaccagtccaatgaactgcctgtcaactcccacggcagtttttcccactcacacactcctctagacaaactcataggaaagaaaagaaagtgctcacccagctcgagcagcatcaacaacagcagcagcaaacccacaaaggttgccaaagtgccagccgtgaacaatgtccacatgaaacacacaggcaccatcccaggggcacaaggactgatgaacagttccctccttcatcaggatatctcctcaccttgcttacgaacaggaatttcagcaacatcaccccagagccctgacttaaaatccaaaggcacgtccctgacagctgaaaatagcacggggaggaataatgcggacacttttgaggacaagttacacctccactcagcactctggactccacgatgcctttgagtctgttttcccaacctcctgtgggcctcaagggtagaaacctgccgggctgttgttttaacgaggatttccctgaagctatgtctctagcagtgagtactcataaaggacactggatcaagttcagccaccgaattgcttttatcagtgttaaagtggtctgaactgcttgctaccaatctgtgagaagtttttgtttttgttttgttttttaacttgcagtatatcacagagccactcttcaagtagattggctgggcaaaagaatgttttggcaagagcgttactgtagacctttctccctccttccttttactaccatttttttttaacactgtcatctgtaggtcactctccagcagttaggcaccttaactggagaccagaaaccttccagagaacacagggctgcatcccgagcaaccctctgaagaagggaattaggctttagattttgatagcaatgttccaggaatgaaatatagatgttagcccaagacaccatgacaaaatagcccagccttttgagagtaatttgggaaaagaagctgtcagaagtttctaacttacaaactggtttgaaatttttgatgcccagacagcaagtataaatcattttggaggcttacttttcatgatacaaaagcaattctgtgtgatttttttttttaagaagaaagaaaatgcaagctagttttgagaaaggaaggccaaattgggtcgggggagggtgggagtgaggaagttaaaatcactatagggagaaaaaacttttttcaagatttccaaagagatgaaattttcttaatccttttaagttttcatagtaaacagtatggcagattgggttggttgtcctacctggtctatttttaaaagtcaccttttaaagtgacattattagatacacttaaatgtttccaaggcactctctacattacccttgtttttctctttggatactgtcctgggactaagtgtagatttctgcttcaagcacttctggcattgtgtgtttttgtatgcactccccttcatgccacttcagatgtttatttggatgtggttggggacgagagcagacaccaaggaaagggagttggagagaatgtaagtcctgacctgaaggtcttttgtgatgcatgtataggattgccctgacacacaccctcctttcttgggattataccagccatcttcctgagagttttggagccctctaggatattttttctagtaccccaccccccacccctaaagaaagaccttaatatgttaaaacagcattgcttggagaaggtgtcattgaattccgggacgagccggagcctttaaatgggtgcttccaccactacaggctcctgacacgagtaacaggcactgttgcttagaagaacacacgaagttgccgaacacagggtaaaatttccaaggcgctgatcgttgccctggccagggcctgatgagagccagtcagtacattctttttttcctacagttcttgggtttcaaacttcagtttcagggaatttcaagtcaacaacaggtagaatgaataaacttggttaccagcctaataatgtgaattgctacagaattattcttattatgtaagaaaacaaaaactttatgcagatactttagctataaattgatgtaaaatactgatttttttaaaggaaggagagaacagtatcttgttcaattattatgcaatcaatcagtaaatgtttttaaaatgatactacaggagagcttagtaaggagagggcatggatgggccagtttggcatagttgggagaaatcagtctggtttccatcccagtcggggaagagagaggtgagagggaatcagaacgtacctagttgattccttggtgacaagtgcaatggggtatgggtagaatttattttcagagccaagaggacttgatggttataaataaagttgcctttagcaatggaatttacagatcgatcatgttgttccgaaagatgtgaataggatccacaataacaagttgattcagactaatgtagatatttagattagcaagtattgaacatttgatttcttagactgaggttttaaatgaatttcattatttctcccggtaatacacagagcatcgggattaggaaattagccattttggattctgtctgccacaaacagacctattctaaacagtgctattaaattttagactgttgttcaaatattttattttctcctaaactactttttatggtgatgaataattaagaccatttaaaacacgggagtacaagtatttttttgaattaaattaacttgcaaaaaccaaatttgcagtggttgggttgtttctagacagactttggtatcaatttaaaaccaagataatttttatattctttccaatagaatttcatgacaactcctgcagttttcttaacctacaaaaaaaaaaaaaaagtgctgcaatgatgaacaaagaattatacaaaacctacttttgtatctttattttggaatttcttgttctattataaatatggaagtatccctatttcagaagacatattttgttaaaaatgaattgtacatatttaaatatgtatttttgcacaggtctttttttctgatatcctgttttggtacaattgagatcatctagtatttatttattaattaataaaagtaaatacctttttataatttgaagtggttcactgccaagccaatagttctagaacctgcctcctttacagttttaagggatgcctctgttctgtgaaaagtctttgtcccttttagtgtctcgggagtggattcatacagatgaagtgggcattgcttcttcctggttgcctggtttcccgatagactacatgtaactaagtgacacactgcttttcttttgttagtattttatgtgtgggagtatgtgactgcgtgtgtgtgtgcctgtgcgtgtgtgtgtatactcagcacatgtatgttactatgtgatgtggtttaaaactaatggaaaaaactgaaagtgcctgaaactagttttaagcttagacagaatctctttaaaaagacttgaatgttcagttgaacttttggagtttgctttttccacctaaatattgtttctaaaattttaggggcggagttgaaaaccaccaatgctggtaattttataaggtattttaaaattaagacctcttggttcatagtaattcaattggtgatggattgcctggtggcaccaagggttacagatctttttgtcagccagcaacttacacgatgtgtccgttttgttattcactcatgaaatacaatttaaaatatttaaaatattttgtattccaaaaatataatacaaagaagtacctctgagaacattgaaaaaaatgtataatttgaaaaatgtaacttataagggcagctgtcttcctgcaagagttctgttgccaaggaatttcttaatgtcgctcattctgtccagggggtttggggcgattgggctttgaaaaaatattcttaaaagtttgtttagcagaaaataatcacttttacattttgtgcaaaacattttacattttcagataatttaaatgagcactacatactgtcagtgtgaatgtagggccttgaaagcattttgcttttttttttttttttttttttttgagcttggttataaaagcaatctcctgtgttaaaaacgtgtgaatagtttgataatttgtacacataatcaagagcatctcagctggactttgtgttggctgctgtatagaacatgaacaaatgtcaagggatagaaaattactttggatatttaaaagagaagaaatatatagtctatttgttttgtaacaagtttctgtaaataaaataatttatactattt

SEQ ID NO: 109384 - DNA, 1470 bp, Homo sapiens
  Payload ID: 1480
  Gene Symbol: ATXN7L1
  Gene Name: ataxin 7-like 1
  Uniprot ID: Q9ULK2
  ENST ID: ENST00000318724
  CDS Start-End: 25-465
actcaatgtcggaacgttccgaagatgacgtcggagcgttctcgaatcccgtgtctctcggctgctgctgccgaaggaacagggaaaaagcaacaagaaggaagagcaatggcgacactggatcgcaaagtgcccagtccggaggcgtttctgggcaaaccctggtcctcctggatcgacgccgccaaattacactgctccgacaatgtagatttagaagaggctggaaaagagggtggaaaaagcagggaggttatgaggcttaataaagaagatatgcacttatttggccattacccagcacatgacgacttctatctcgtagtgtgcagtgcctgtaaccaggtcgtcaagccacaggttttccagtcgcactgcgggagaaagcaagacaacaggagaaatgaaggcatctccaggagtggaccagagagcagccaagccatagagaagcatcaggtgtgagaatggaaaacgcagaagagacgtacaacttctgaaagatctcagaggactggcattgtctggagacggcttcctggaagaggagactccagcagagccctgaagtgtggacaagcttccattcactgcaaattcgtgagcacactctggtgtcaggatctagtaaggaaatgggcttgagcagagcagggggtacctgtggggttcttctcttcattttcaccaccacaaagctggtctaagctgccatcaattcccacctggacaactgcaaaagccttccagctgttcctgcttccactcttgctcctctacaattcattctgcacgcagaagtcagaatcaaaatcaaagttcatcatgtcattctcttgacttgtggcttccctttgctcttaagctaaaagtaaaaatcattatcatggctacaaagtcttgtgtggtctgggccacatcctgtgccaggctccctttcattgtctatattccagtcaagctggccttcaaaatttcagcacattgggtctttctgccacaggcccttgcacatacatgcttttccctctgtacatgtgattttctttcatccccgctttccaaagctaactctgactcatccttcagactgcatcttaatgattacttccttctggaagactcccctaattttcacaactagatgagctctcccttatatgttgaaaacaagtatttcttgtgtgaacagaaatgtttaatgtctgccttcccaactcagccacaagctctgtgaggatggggactcagtctttgcatccctcagagcctaacatagtctcagttaatacgtgatagctggagcgtgacatttcattaggaacagtgaggctagttgagaaattatacctcaccagtatataggagagtaccattaggaattcttaatgggatgaaaacctgaattcatgtctagaccctgccacctgctggctgtgctgttttaaataaattgcagatcctctcaga

SEQ ID NO: 109385 - DNA, 5417 bp, Homo sapiens
  Payload ID: 1480
  Gene Symbol: ATXN7L1
  Gene Name: ataxin 7-like 1
  Uniprot ID: Q9ULK2
  ENST ID: ENST00000419735
  CDS Start-End: 47-2632
ccctccctccccctttcagaacactcaatgtcggaacgttccgaagatgacgtcggagcgttctcgaatcccgtgtctctcggctgctgctgccgaaggaacagggaaaaagcaacaagaaggaagagcaatggcgacactggatcgcaaagtgcccagtccggaggcgtttctgggcaaaccctggtcctcctggatcgacgccgccaaattacactgctccgacaatgtagatttagaagaggctggaaaagagggtggaaaaagcagggaggttatgaggcttaataaagaagatatgcacttatttggccattacccagcacatgacgacttctatctcgtagtgtgcagtgcctgtaaccaggtcgtcaagccacaggttttccagtcgcactgcgagagaagacacggttcaatgtgtagaccttctccctctccagtgtctccagcctccaatcccaggacatcactagtacaggtgaaaacaaaagcctgtctcagcggccatcactctgccagcagcacctcaaagccattcaaaacgcccaaagacaatctacttacctccagcagcaaacagcacacagtctttcctgcgaaaggatcaagggataaaccatgtgttccagttcctgtagtcagtttagagaaaattcctaacctagtgaaggcagatggtgccaatgtcaaaatgaactccacaaccactactgcagtttctgcctcctccacctcgtcctctgccgtctccacccctcctttaattaagcctgtcctgatgtccaagtcagtgccaccttcaccagagaagatcttaaatggcaaaggaattctgccaaccaccatagacaagaaacaccaaaatggcaccaaaaacagcaacaagccttacaggagactttcagagagagaatttgacccaaataaacactgtggagtattggatcccgagacaaagaaaccttgcacaagatccctcacctgcaagacacattcgctaagccatcggagggcagtcccaggccggaaaaagcaatttgacctcctcctggcagaacacaaagcaaagtcccgggaaaaagaagttaaagataaagagcatctcctgacttccacgagggaaatacttccaagccaatccgggccggcacaggattctctgctagggtcttcagggagctctgggccagaaccaaaagttgcatcccctgcaaaatccagaccacccaactctgtacttcctagaccatcatctgcaaatagcataagcagcagcacatcttcaaatcatagcggccacactccagagcccccactcccaccggttggaggtgacctcgccagccgactgtccagtgatgaaggggagatggacggagccgacgaatccgagaagctagactgtcagttctccacgcaccaccccagacctctggcgttttgctcatttgggagtcgcctcatgggacgagggtactatgtgtttgatagaagatgggatcgttttcgattcgcactaaactccatggtagaaaaacacctgaattcacagatgtggaagaagatccctcctgcggcagatagccccctgccctcgccagcagcccacatcaccacccccgttccagcatccgttttgcagcctttcagcaaccccagtgctgtgtatcttccttcagctcccatcagctcgaggctcacctcttcttacataatgacatcagccatgctctcaaacgcagctttcgtgacatcgccggacccgagcgccctcatgtcccacaccacagctttccctcatgtggccgcaaccctcagcatcatggactcaaccttcaaggccccatccgccgtgtccccgataccagccgtcatcccttccccatcccacaagccatccaaaaccaaaaccagcaaatcctcaaaagtcaaagacctgtccacccgtagcgacgagtctccaagtaacaaaaaaaggaagccacagtcttcgacttcctcctcctcctcctcctcctcctcttccttgcagacatccctctcgtctccactgtcagggcctcacaaaaagaactgtgttttgaatgccagttctgctttgaactcctatcaggcggcccctccctataacagcctgtctgtgcacaactcaaacaatggggtgagcccactcagtgccaaactggagccctcaggacggacctcgctgcccggcggccccgcggacatagtgagacaggtgggcgcggtgggaggcagcagtgactcctgtcccctctctgtgccctcccttgcgctccacgcaggggacctctctctggcctcacacaatgctgtgtcttctctgcccctctcttttgacaaatcagaaggaaaaaagcgtaagaactcgagttctagtagcaaagcctgtaaaatcactaaaatgcctggtatgaatagcgttcacaaaaagaacccgcccagccttctcgcaccggtgcccgatcccgttaacagcacctcctctcggcaggttgggaaaaatagcagcctagctttgtcacaatccagtccttcaagtatatccagcccaggacacagccgacagaacacaaacagaacgggcaggataaggactcttccataacaagactatgaagccacttccacatcaattccaggccacctaatcccatccgaggaggccatggggaggaggagggaggggagtgggctggggggagagtctgttttctgtgcactccctgtgactctggcctttcttcttctttttttaattgaccaatttttagttaaaaaggcaaaagaaggtgaatttgagatttacagaaaacagttccagtgtttggtttccgctgtctttcctttcatttgccatgtttttacattcttccaaatttggggtcactcccctagctcctgatgctgctactgtaccatccttttgctccagccatgagagcagacattgcagaatgttggttccaggttggcatgctctgaagctcttgaactgtagcacaggcagagccctttttcttcctgtcatctccacccgattccttccatccctacgtctaccactctctgggtcctcactggtcttcaaaggacctggctctcataggatcccctcaggattgtgtgcagggagagggggctttgctggggaggagctgggagtggagagttggagggtgggtggggttccctcatccagtttccacagcccaccatggctggagccaaatgctagaagcgagattgagaacagtggccgtttagtgatgtggtttacctaataccactgtccagctgtgcagctcagaaaggataaaccagtcagggacaggggccagaacaggtttgggaaggtggcagcaagcagagcatggtgggtaggagatgatccctaaaaaaactggagactgtggtggtctgagctggtcaggaatctgcagaatcccttccaggaatcagtgtgccagtgcccacagcagggtgagctaggagggagaaatcccaggaaaaaggtcgtgagaacccagaaagccactccatgaggaggcacggtgaccacagctgctaaaggttcttaggctgccttcctgggctaggaagagccccccagggagagcttccacaaaagggtatgtgtcaaaccttttgtcagaataaataatagcatttcccacccacccccatgccctgggccacagggacttggtgggatcagcacacccatggatcagcttttgctgtcttagagacagccatccccatgaaggaatggtaaggacagccactgctcagtgaagaacagccatttggaagagccacgctggagccctgcagccatagaactattcacactggagttttaaaagaaacagcaataccataagctctagtagggaatcataatcaggaaaggaattcacaacataaaataggtgttctgtgctattaatcatgtaactttgtatatgatgtatagcaaagatactgggaggttttgtttcatccttaaatcagaaatgaatgctagtttcatagctgggcagaaccctcatccccaccccaaagttttccttttctttcccgttcccccaacccaaagatcagactactgttaagtttcaccacacaattggaattgcaaagacgggaggcaaatggagtgattttcatcaatggaattgcactgacagtgagtgtttcttataggattactaaattttttaatataaaatgatttgtttaaaaatcaggagttgatattaagtaccaggacattagttcggatgatttcatttttatttctacagtgttaaaagtgcacttatatgctggtttatttacgtcttgggaaaagagactgcaaattgaagggatgattgttactttttctttttttaaaaaaaaaaggttaaggagattttaagacttataaatgtttaagaaattataaacaaggttagaccctttgaaaaaaagtttagaagatattcttaaagtaaatttttatagtgttaattttgtaataatttatgttttactatattacagagctaactgaccagaatagtttcagaaacaatatgaaacttaggaaagtttaagcaatgtttatatttttaaaatgttctttgaattatgtttttattgtacatttcttcagactgaaaagtatgtacatatctttgttatttttgcacaattttgtcttgttcggtttcagaggtctgttgttttttataatttattttgagttgtaaaacttgcaggagtaaaaacaaaaaacaaaatctccacaacaaaataaccctctgatttataaactcttatagtcaaagagggaaaacaaaggttgagagattaagtggctgcttctgagaaataatgtctcaaggactaaaggagcaattcaataggtttagacattgtagctctctacatcttgaattggaagctggaataaagagcccccacccccccccccaccctcatcgaatgctgcttactttgtcaaaagactggctatgaccaaggtgaggatatttctggaaaactgggcaaaaagggaaagcccacagtattcttccttggcagtcaaccacaggtttactttacaatgatgtattaaaaacttgcagcttgaaaaatggaatgcaaataaaaggttctctttgggtttgtcttaatggagttaaactggagcagcctataaaacatttttagggtgatgtcctctgggtccttctgttctgcacacccactcagtcttctctcccagccccttgactgcacacacccctctttgcctgaagatctcctgacttgtcgccagccatagaggctcgaaagctctggttgtgaagcataacgcaatgcatagacctgtcagccat

SEQ ID NO: 109386 - DNA, 2426 bp, Homo sapiens
  Payload ID: 1480
  Gene Symbol: ATXN7L1
  Gene Name: ataxin 7-like 1
  Uniprot ID: Q9ULK2
  ENST ID: ENST00000477775
  CDS Start-End: 129-2345
actggccagggccctcatccaggagccaggaaacatctactaccacgagtcgcgttgcccagcgtgtgtcagcctccttatccaaacggcaaggcagcctccccgggatgtagagaagacacggttcaatgtgtagaccttctccctctccagtgtctccagcctccaatcccaggacatcactagtacaggtgaaaacaaaagcctgtctcagcggccatcactctgccagcagcacctcaaagccattcaaaacgcccaaagacaatctacttacctccagcagcaaacagcacacagtctttcctgcgaaaggatcaagggataaaccatgtgttccagttcctgtagtcagtttagagaaaattcctaacctagtgaaggcagatggtgccaatgtcaaaatgaactccacaaccactactgcagtttctgcctcctccacctcgtcctctgccgtctccacccctcctttaattaagcctgtcctgatgtccaagtcagtgccaccttcaccagagaagatcttaaatggcaaaggaattctgccaaccaccatagacaagaaacaccaaaatggcaccaaaaacagcaacaagccttacaggagactttcagagagagaatttgacccaaataaacactgtggagtattggatcccgagacaaagaaaccttgcacaagatccctcacctgcaagacacattcgctaagccatcggagggcagtcccaggccggaaaaagcaatttgacctcctcctggcagaacacaaagcaaagtcccgggaaaaagaagttaaagataaagagcatctcctgacttccacgagggaaatacttccaagccaatccgggccggcacaggattctctgctagggtcttcagggagctctgggccagaaccaaaagttgcatcccctgcaaaatccagaccacccaactctgtacttcctagaccatcatctgcaaatagcataagcagcagcacatcttcaaatcatagcggccacactccagagcccccactcccaccggttggaggtgacctcgccagccgactgtccagtgatgaaggggagatggacggagccgacgaatccgagaagctagactgtcagttctccacgcaccaccccagacctctggcgttttgctcatttgggagtcgcctcatgggacgagggtactatgtgtttgatagaagatgggatcgttttcgattcgcactaaactccatggtagaaaaacacctgaattcacagatgtggaagaagatccctcctgcggcagatagccccctgccctcgccagcagcccacatcaccacccccgttccagcatccgttttgcagcctttcagcaaccccagtgctgtgtatcttccttcagctcccatcagctcgaggctcacctcttcttacataatgacatcagccatgctctcaaacgcagctttcgtgacatcgccggacccgagcgccctcatgtcccacaccacagctttccctcatgtggccgcaaccctcagcatcatggactcaaccttcaaggccccatccgccgtgtccccgataccagccgtcatcccttccccatcccacaagccatccaaaaccaaaaccagcaaatcctcaaaagtcaaagacctgtccacccgtagcgacgagtctccaagtaacaaaaaaaggaagccacagtcttcgacttcctcctcctcctcctcctcctcctcttccttgcagacatccctctcgtctccactgtcagggcctcacaaaaagaactgtgttttgaatgccagttctgctttgaactcctatcaggcggcccctccctataacagcctgtctgtgcacaactcaaacaatggggtgagcccactcagtgccaaactggagccctcaggacggacctcgctgcccggcggccccgcggacatagtgagacaggtgggcgcggtgggaggcagcagtgactcctgtcccctctctgtgccctcccttgcgctccacgcaggggacctctctctggcctcacacaatgctgtgtcttctctgcccctctcttttgacaaatcagaaggaaaaaagcgtaagaactcgagttctagtagcaaagcctgtaaaatcactaaaatgcctggtatgaatagcgttcacaaaaagaacccgcccagccttctcgcaccggtgcccgatcccgttaacagcacctcctctcggcaggttgggaaaaatagcagcctagctttgtcacaatccagtccttcaagtatatccagcccaggacacagccgacagaagaacacaaacagaacgggcaggataaggactcttccataacaagactatgaagccacttccacatcaattccaggccacctaatcccatccgaggaggccatggggaggaggagggagggg

SEQ ID NO: 109387 - DNA, 1115 bp, Homo sapiens
  Payload ID: 1480
  Gene Symbol: ATXN7L1
  Gene Name: ataxin 7-like 1
  ENST ID: ENST00000478915
  CDS Start-End: 4-291
gcaatggcgacactggatcgcaaagtgcccagtccggaggcgtttctgggcaaaccctggtcctcctggatcgacgccgccaaattacactgctccgacaatatgcacttatttggccattacccagcacatgacgacttctatctcgtagtgtgcagtgcctgtaaccaggtcgtcaagccacaggttttccagtcgcactgcgggagaaagcaagacaacaggagaaatgaaggcatctccaggagtggaccagagagcagccaagccatagagaagcatcaggtgtgagaatggaaaacgcagaagagacgtacaacttctgaaagatctcagaggactggcattgtctggagacggcttcctggaagaggagactccagcagagccctgaagtgtggacaagcttccattcactgcaaattcgtgagcacactctggtgtcaggatctagtaaggaaatgggcttgagcagagcagggggtacctgtggggttcttctcttcattttcaccaccacaaagctggtctaagctgccatcaattcccacctggacaactgcaaaagccttccagctgttcctgcttccactcttgctcctctacaattcattctgcacgcagaagtcagaatcaaaatcaaagttcatcatgtcattctcttgacttgtggcttccctttgctcttaagctaaaagtaaaaatcattatcatggctacaaagtcttgtgtggtctgggccacatcctgtgccaggctccctttcattgtctatattccagtcaagctggccttcaaaatttcagcacattgggtctttctgccacaggcccttgcacatacatgcttttccctctgtacatgtgattttctttcatccccgctttccaaagctaactctgactcatccttcagactgcatcttaatgattacttccttctggaagactcccctaattttcacaactagatgagctctcccttatatgttgaaaacaagtatttcttgtgtgaacagaaatgtttaatgtctgccttcccaactcagccacaagctctgtgaggatggggactcagtctttgcatccctcagagcctaacatagtctcagttaa

SEQ ID NO: 109388 - DNA, 1963 bp, Homo sapiens
  Payload ID: 1480
  Gene Symbol: ATXN7L1
  Gene Name: ataxin 7-like 1
  ENST ID: ENST00000484475
  CDS Start-End: 1-1725
ccatcatctgcaaatagcataagcagcagcacatcttcaaatcatagcggccacactccagagcccccactcccaccggttggaggtgacctcgccagccgactgtccagtgatgaaggggagatggacggagccgacgaatccgagaagctagactgtcagttctccacgcaccaccccagacctctggcgttttgctcatttgggagtcgcctcatgggacgagggtactatgtgtttgatagaagatgggatcgttttcgattcgcactaaactccatggtagaaaaacacctgaattcacagatgtggaagcacagaaacccgagccacagggcatcaggtccctcccccctgttcaggacttgcctaaccaatctgctgtcactgagcaacattggggctgcctgggtgtcaactctggagagcgtagcaccccgctaccctctcaacctcgctgcccaaaccccaggccccggcgggcccgaacctggagggatggcagccgatgggggcgtggaagacattaggaagaaaaggaacggccaagactcttttttctttaacaagcatttaactctgcatcaggagccgccaacacagtattctctttcagccaggaagatccctcctgcggcagatagccccctgccctcgccagcagcccacatcaccacccccgttccagcatccgttttgcagcctttcagcaaccccagtgctgtgtatcttccttcagctcccatcagctcgaggctcacctcttcttacataatgacatcagccatgctctcaaacgcagctttcgtgacatcgccggacccgagcgccctcatgtcccacaccacagctttccctcatgtggccgcaaccctcagcatcatggactcaaccttcaaggccccatccgccgtgtccccgataccagccgtcatcccttccccatcccacaagccatccaaaaccaaaaccagcaaatcctcaaaagtcaaagacctgtccacccgtagcgacgagtctccaagtaacaaaaaaaggaagccacagtcttcgacttcctcctcctcctcctcctcctcctcttccttgcagacatccctctcgtctccactgtcagggcctcacaaaaagaactgtgttttgaatgccagttctgctttgaactcctatcaggcggcccctccctataacagcctgtctgtgcacaactcaaacaatggggtgagcccactcagtgccaaactggagccctcaggacggacctcgctgcccggcggccccgcggacatagtgagacaggtgggcgcggtgggaggcagcagtgactcctgtcccctctctgtgccctcccttgcgctccacgcaggggacctctctctggcctcacacaatgctgtgtcttctctgcccctctcttttgacaaatcagaaggaaaaaagcgtaagaactcgagttctagtagcaaagcctgtaaaatcactaaaatgcctggtatgaatagcgttcacaaaaagaacccgcccagccttctcgcaccggtgcccgatcccgttaacagcacctcctctcggcaggtaagggacctcctggcaccgccttcaccggctctggggggcagggggagctgggcagcgcccctgcttagccgggcggctccgacaggtaacacaagcttgattcctgttctcgttttccccgaaggcagttttcaccctctgctttgagagcactttactgaacaagtacttgataccacgctcactatgtgctagacactgttctcggcactttacggttattacctcactgagtcctcacgacaccccagtgcagtgagtgcagttatcactttacagatgagtaaactgaggcacagagagattctgagttccccactccacatcggtcagttttatcttttgaggttctgagaacattgtcattaaagagttctgttgctaa

SEQ ID NO: 109389 - DNA, 2324 bp, Homo sapiens
  Payload ID: 1480
  Gene Symbol: ATXN7L1
  Gene Name: ataxin 7-like 1
  ENST ID: ENST00000472195
  CDS Start-End: 96-2324
gatcgcttcaggttccaaaagtacaacatgtttacagtcgtcgtagcatcagattaagttggcagcctgagtctctctagagaagacacggttcaatgtgtagaccttctccctctccagtgtctccagcctccaatcccaggacatcactagtacaggtgaaaacaaaagcctgtctcagcggccatcactctgccagcagcacctcaaagccattcaaaacgcccaaagacaatctacttacctccagcagcaaacagcacacagtctttcctgcgaaaggatcaagggataaaccatgtgttccagttcctgtagtcagtttagagaaaattcctaacctagtgaaggcagatggtgccaatgtcaaaatgaactccacaaccactactgcagtttctgcctcctccacctcgtcctctgccgtctccacccctcctttaattaagcctgtcctgatgtccaagtcagtgccaccttcaccagagaagatcttaaatggcaaaggaattctgccaaccaccatagacaagaaacaccaaaatggcaccaaaaacagcaacaagccttacaggagactttcagagagagaatttgacccaaataaacactgtggagtattggatcccgagacaaagaaaccttgcacaagatccctcacctgcaagacacattcgctaagccatcggagggcagtcccaggccggaaaaagcaatttgacctcctcctggcagaacacaaagcaaagtcccgggaaaaagaagttaaagataaagagcatctcctgacttccacgagggaaatacttccaagccaatccgggccggcacaggattctctgctagggtcttcagggagctctgggccagaaccaaaagttgcatcccctgcaaaatccagaccacccaactctgtacttcctagaccatcatctgcaaatagcataagcagcagcacatcttcaaatcatagcggccacactccagagcccccactcccaccggttggaggtgacctcgccagccgactgtccagtgatgaaggggagatggacggagccgacgaatccgagaagctagactgtcagttctccacgcaccaccccagacctctggcgttttgctcatttgggagtcgcctcatgggacgagggtactatgtgtttgatagaagatgggatcgttttcgattcgcactaaactccatggtagaaaaacacctgaattcacagatgtggaagaagatccctcctgcggcagatagccccctgccctcgccagcagcccacatcaccacccccgttccagcatccgttttgcagcctttcagcaaccccagtgctgtgtatcttccttcagctcccatcagctcgaggctcacctcttcttacataatgacatcagccatgctctcaaacgcagctttcgtgacatcgccggacccgagcgccctcatgtcccacaccacagctttccctcatgtggccgcaaccctcagcatcatggactcaaccttcaaggccccatccgccgtgtccccgataccagccgtcatcccttccccatcccacaagccatccaaaaccaaaaccagcaaatcctcaaaagtcaaagacctgtccacccgtagcgacgagtctccaagtaacaaaaaaaggaagccacagtcttcgacttcctcctcctcctcctcctcctcctcttccttgcagacatccctctcgtctccactgtcagggcctcacaaaaagaactgtgttttgaatgccagttctgctttgaactcctatcaggcggcccctccctataacagcctgtctgtgcacaactcaaacaatggggtgagcccactcagtgccaaactggagccctcaggacggacctcgctgcccggcggccccgcggacatagtgagacaggtgggcgcggtgggaggcagcagtgactcctgtcccctctctgtgccctcccttgcgctccacgcaggggacctctctctggcctcacacaatgctgtgtcttctctgcccctctcttttgacaaatcagaaggaaaaaagcgtaagaactcgagttctagtagcaaagcctgtaaaatcactaaaatgcctggtatgaatagcgttcacaaaaagaacccgcccagccttctcgcaccggtgcccgatcccgttaacagcacctcctctcggcaggtaagggacctcctggcaccgccttcaccggctctggggggcagggggagctgggcagcgcccctgcttagccgggcggctccgacaggtaacacaagcttgattcctgttctcgttttccccgaaggc

SEQ ID NO: 109390 - DNA, 2732 bp, Homo sapiens
  Payload ID: 1480
  Gene Symbol: ATXN7L1
  Gene Name: ataxin 7-like 1
  ENST ID: ENST00000474433
  CDS Start-End: 91-297
caactgccactccaaggagaacagaaatggttccgttattagtggctgctgtgggaccacgacagtctgtgggagagaagacacggttcaatgtgtagaccttctccctctccagtgtctccagcctccaatcccaggacatcactagtacaggtgaaaacaaaagcctgtctcagcggccatcactctgccagcagcacctcaaagccattcaaaacgcccaaagacaatctacttacctccagcagcaaacagcacacagtctttcctgcgaaaggatcaagggataaaccatgacatcactgggcagggaggggaatctacttgatgccaagagaaccatgtttcttaaagccagaggacccgccttgatctagaaagataaattcagacaggccaagcacaaaggaagaagacgtgggcaactaaagcagcacaaaagaaacagagtgttccagttcctgtagtcagtttagagaaaattcctaacctagtgaaggcagatggtgccaatgtcaaaatgaactccacaaccactactgcagtttctgcctcctccacctcgtcctctgccgtctccacccctcctttaattaagcctgtcctgatgtccaagtcagtgccaccttcaccagagaagatcttaaatggcaaaggaattctgccaaccaccatagacaagaaacaccaaaatggcaccaaaaacagcaacaagccttacaggagactttcagagagagaatttgacccaaataaacactgtggagtattggatcccgagacaaagaaaccttgcacaagatccctcacctgcaagacacattcgctaagccatcggagggcagtcccaggccggaaaaagcaatttgacctcctcctggcagaacacaaagcaaagtcccgggaaaaagaagttaaagataaagagcatctcctgacttccacgagggaaatacttccaagccaatccgggccggcacaggattctctgctagggtcttcagggagctctgggccagaaccaaaagttgcatcccctgcaaaatccagaccacccaactctgtacttcctagaccatcatctgcaaatagcataagcagcagcacatcttcaaatcatagcggccacactccagagcccccactcccaccggttggaggtgacctcgccagccgactgtccagtgatgaaggggagatggacggagccgacgaatccgagaagctagactgtcagttctccacgcaccaccccagacctctggcgttttgctcatttgggagtcgcctcatgggacgagggtactatgtgtttgatagaagatgggatcgttttcgattcgcactaaactccatggtagaaaaacacctgaattcacagatgtggaagaagatccctcctgcggcagatagccccctgccctcgccagcagcccacatcaccacccccgttccagcatccgttttgcagcctttcagcaaccccagtgctgtgtatcttccttcagctcccatcagctcgaggctcacctcttcttacataatgacatcagccatgctctcaaacgcagctttcgtgacatcgccggacccgagcgccctcatgtcccacaccacagctttccctcatgtggccgcaaccctcagcatcatggactcaaccttcaaggccccatccgccgtgtccccgataccagccgtcatcccttccccatcccacaagccatccaaaaccaaaaccagcaaatcctcaaaagtcaaagacctgtccacccgtagcgacgagtctccaagtaacaaaaaaaggaagccacagtcttcgacttcctcctcctcctcctcctcctcctcttccttgcagacatccctctcgtctccactgtcagggcctcacaaaaagaactgtgttttgaatgccagttctgctttgaactcctatcaggcggcccctccctataacagcctgtctgtgcacaactcaaacaatggggtgagcccactcagtgccaaactggagccctcaggacggacctcgctgcccggcggccccgcggacatagtgagacaggtgggcgcggtgggaggcagcagtgactcctgtcccctctctgtgccctcccttgcgctccacgcaggggacctctctctggcctcacacaatgctgtgtcttctctgcccctctcttttgacaaatcagaaggaaaaaagcgtaagaactcgagttctagtagcaaagcctgtaaaatcactaaaatgcctggtatgaatagcgttcacaaaaagaacccgcccagccttctcgcaccggtgcccgatcccgttaacagcacctcctctcggcaggtaagggacctcctggcaccgccttcaccggctctggggggcagggggagctgggcagcgcccctgcttagccgggcggctccgacaggtaacacaagcttgattcctgttctcgttttccccgaaggcagttttcaccctctgctttgagagcactttactgaacaagtacttgataccacgctcactatgtgctagacactgttctcggcactttacggttattacctcactgagtcctcacgacaccccagtgcagtgagtgcagttatcactttacagatgagtaaactgaggcacagagagattctgagttccccactccacatcggtcagttttatcttttgaggttctgagaacattgtcattaaagagttctgttgctaa

SEQ ID NO: 109391 - DNA, 2318 bp, Homo sapiens
  Payload ID: 1481
  Gene Symbol: ATXN7L2
  Gene Name: ataxin 7-like 2
  Uniprot ID: Q5T6C5
  ENST ID: ENST00000369870
  CDS Start-End: 16-2184
gcgtccgcggcggtgatggcggtgcgtgaacgcgcggcggcagcaatggccgctctggagcggcgggtgccgagtctcgatgacttcgcgggacagagctggagctcgtgggtggagcgggccgacctgcccgcggctgacggggctgagctggaggagagtagcaaaaacacgaagaagttggatgccatgaccctcattaaagaagacatgtccatcttcgggcactgccctgcccatgatgacttctacttggttgtgtgtaaccactgcagccaagtggtgaagcctcaagctttccagaagcactgcgaaagaagacatgggcccctcagcaagctttatggccgggccccacccccacctccagcccctgccagctctcagaaatgccatgtagtgaatgggcagggcccagcttgtagggccccaggttccacgaaaacctcctccagggagaagggccaggggtcccggagccgtggccaccagcctcctgagaagacccagaaggacaacctctgccagccagggggcctcaccaaggactcccctggaaaacctcccatggctcccccttctaaagaacctcctggcagagagaacatcgagatcatccccagtgaggggtccagtcactgggctgaaggcagccctcctgaaaaggagcccagtgggaccaggctgccccctaaaacccaccggaagatggctcggaaggagtgcgacctcaacaggcagtgtggggtaataaatccagagaccaaaaagatctgtacccgcctgttgacctgcaagatccactcagtacaccagcgccgggaagtccagggccgggccaaggactttgacgtgctggtggcagagctgaaggccaactcccgcaaaggggagtctcccaaggagaagagcccagggcgcaaggagcaagttctcgagcgcccctcccaggagctcccctcctcagtccaggttgtagcagcggtggctgctcccagcagcaccttctctgttcgtgccaagcagacctacccatactgtgcactgcccaggtcccgggcctcctccgagagtgaattggatgatgaaggcccctgtggtggtgatggggacccaggcctgttccccttccccatgccccggggtgggacccaggcctccagcgaagagagtgaggaggaggggacatctgacgacctccacccaccccctgactgccattatgcaacccggcccccacggccacaggcgttctgcacctttgggagccggctggtgagcccaggatgctatgtgtttagccgccggctggaccggttctgctcagcactcagctccatgctggaacggcacctcagcacacacatgtggaagaagatcccaccggcagctgaacctccagctcaccttgtcaactccccgttatctgctcccctgagcccatcctctacaggcacctgcccccgccttccaggtccaaccctgagacctgcctgcccagcctccatgccccccaccaaggacaaccttgtccccagctaccctgcaggctcccccagcgtggcggctgcctgtagccaggcagagtgcatgggcgggagccaggctatcacctcaccactgcctgccaacacgccatccccgtccttcagcaagctgccgccttccaaggccagcaagtcatccaaaggcaaggacggggtggaggtggaggccccttctcgaaagcggaagttatcccctggccctaccactcttaaacggacctgcatcctggagcccactggaaaagggaaaccctctggctgtaggggcctctcggccaaaactaaaacagccctgagcatggggcttaatgggacaatggggccaagagtgaagcgggcagggcccctggactgtcgtggctcccctcatcagctccccacaccagtcaaggcttctcagctggagaaccggggagcagctggacacccagccaaggccctgccaaccaactgcctctctgaggaggaggtggccaagaagcggaaaaacctggccacttattgccggccagtgaaggccaagcactgtcaggctggtgcccctgctgatgtggcctgctctgtgcgccgcaagaagccaggcccggccctggcctttgaggagaagtgctctacactgaagtcaaaagcccattaacgagaaagtgcctgcccactgcaacggagccgccagcacctcctcccctccagatccgggccccaggctgctgccgctttttataactttatattatttttttttaagaaaaaaagctctttaaaatacctcaa

SEQ ID NO: 109392 - DNA, 3022 bp, Homo sapiens
  Payload ID: 1481
  Gene Symbol: ATXN7L2
  Gene Name: ataxin 7-like 2
  ENST ID: ENST00000463678
  CDS Start-End: 476-787
ctattcgatctacaggggagcggagtcgcttcgtggccgccagcccgggaaggggcgccagccagctggcggacgcacggcttagaggggcgtctgggcagagaggtttggggctggggagagatgcagtgagcttgggagagtggactggtagcacaaataatgtgtgcataagggttagaagaggaggtcctggagctttggtcttctcttttccccctgcaattgtgcatttcggagggactcttgctgcaagctcggtaggcaatagcatccgctccaagactacacttcccagaaggctgtgagtgggtggggggggggggggcgcggggaacaggcaacctgtgttgcgcttgcgcaaagactgcgctggaaaggcaggtggggaggaggggaggcgtgcccgcgacggggcgagggggagggggccgcgcggcggcggcgccagggcgggcgcgcgtccgcggcggtgatggcggtgcgtgaacgcgcggcggcagcaatggccgctctggagcggcgggtgccgagtctcgatgacttcgcgggacagagctggagctcgtgggtggagcgggccgacctgcccgcggctgacgaaactgaggtacaagggcaacccctgcccaaaggccctctaagaaggggagggacttgcatagctgaccaaggagactttgaagatgctcaaggaccaaagacagcagtttctctgctctgtgaccatcctatcagtgcaggacctgagaagctgggtgtaactttgacaatgctatggggctgagctggaggagagtagcaaaaacacgaagaagttggatgccatgaccctcattaaagaagacatgtccatcttcgggcactgccctgcccatgatgacttctacttggttgtgtgtaaccactgcagccaagtggtgaagcctcaagctttccagaagcactgcgaaagaagacatgggcccctcagcaagctttatggccgggccccacccccacctccagcccctgccagctctcagaaatgccatgtagtgaatgggcagggcccagcttgtagggccccaggttccacgaaaacctcctccagggagaagggccaggggtcccggagccgtggccaccagcctcctgagaagacccagaaggacaacctctgccttttcgtgcctgtggtgaatctggagaagatgtccagtctcccgaagcctgatggacatggaatcagggtggccccaccctctgcttttctcagccagccagggggcctcaccaaggactcccctggaaaacctcccatggctcccccttctaaagaacctcctggcagagagaacatcgagatcatccccagtgaggggtccagtcactgggctgaaggcagccctcctgaaaaggagcccagtgggaccaggctgccccctaaaacccaccggaagatggctcggaaggagtgcgacctcaacaggcagtgtggggtaataaatccagagaccaaaaagatctgtacccgcctgttgacctgcaagatccactcagtacaccagcgccgggaagtccagggccgggccaaggactttgacgtgctggtggcagagctgaaggccaactcccgcaaaggggagtctcccaaggagaagagcccagggcgcaaggagcaagttctcgagcgcccctcccaggagctcccctcctcagtccaggttgtagcagcggtggctgctcccagcagcaccttctctgttcgtgccaagcagacctacccatactgtgcactgcccaggtcccgggcctcctccgagagtgaattggatgatgaaggcccctgtggtggtgatggggacccaggcctgttccccttccccatgccccggggtgggacccaggcctccagcgaagagagtgaggaggaggggacatctgacgacctccacccaccccctgactgccattatgcaacccggcccccacggccacaggcgttctgcacctttgggagccggctggtgagcccaggatgctatgtgtttagccgccggctggaccggttctgctcagcactcagctccatgctggaacggcacctcagcacacacatgtggaagaagatcccaccggcagctgaacctccagctcaccttgtcaactccccgttatctgctcccctgagcccatcctctacaggcacctgcccccgccttccaggtccaaccctgagacctgcctgcccagcctccatgccccccaccaaggacaaccttgtccccagctaccctgcaggctcccccagcgtggcggctgcctgtagccaggcagagtgcatgggcgggagccaggctatcacctcaccactgcctgccaacacgccatccccgtccttcagcaagctgccgccttccaaggccagcaagtcatccaaaggcaaggacggggtggaggtggaggccccttctcgaaagcggaagttatcccctggccctaccactcttaaacggacctgcatcctggagcccactggaaaagggaaaccctctggctgtaggggcctctcggccaaaactaaaacagccctgagcatggggcttaatgggacaatggggccaagagtgaagcgggcagggcccctggactgtcgtggctcccctcatcagctccccacaccagtcaaggcttctcagctggagaaccggggagcagctggacacccagccaaggccctgccaaccaactgcctctctgaggaggaggtggccaagaagcggaaaaacctggccacttattgccggccagtgaaggccaagcactgtcaggctggtgcccctgctgatgtggcctgctctgtgcgccgcaagaagccaggcccggccctggcctttgaggagaagtgctctacactgaagtcaaaagcccattaacgagaaagtgcctgcccactgcaacggagccgccagcacctcctcccctccagatccgggccccaggctgctgccgctttttataactttatattatttttttt

SEQ ID NO: 109393 - DNA, 2314 bp, Homo sapiens
  Payload ID: 1481
  Gene Symbol: ATXN7L2
  Gene Name: ataxin 7-like 2
  ENST ID: ENST00000615509
  CDS Start-End: 16-1758
gcgtccgcggcggtgatggcggtgcgtgaacgcgcggcggcagcaatggccgctctggagcggcgggtgccgagtctcgatgacttcgcgggacagagctggagctcgtgggtggagcgggccgacctgcccgcggctgacggggctgagctggaggagagtagcaaaaacacgaagaagttggatgccatgaccctcattaaagaagacatgtccatcttcgggcactgccctgcccatgatgacttctacttggttgtgtgtaaccactgcagccaagtggtgaagcctcaagctttccagaagcactgcgaaagaagacatgggcccctcagcaagctttatggccgggccccacccccacctccagcccctgccagctctcagaaatgccatgtagtgaatgggcagggcccagcttgtagggccccaggttccacgaaaacctcctccagggagaagggccaggggtcccggagccgtggccaccagcctcctgagaagacccagaaggacaacctctgccagccagggggcctcaccaaggactcccctggaaaacctcccatggctcccccttctaaagaacctcctggcagagagaacatcgagatcatccccagtgaggggtccagtcactgggctgaaggcagccctcctgaaaaggagcccagtgggaccaggctgccccctaaaacccaccggaagatggctcggaaggagtgcgacctcaacaggcagtgtggggtaataaatccagagaccaaaaagatctgtacccgcctgttgacctgcaagatccactcagtacaccagcgccgggaagtccagggccgggccaaggactttgacgtgctggtggcagagctgaaggccaactcccgcaaaggggagtctcccaaggagaagagcccagggcgcaaggagcaagttctcgagcgcccctcccaggagctcccctcctcagtccaggttgtagcagcggtggctgctcccagcagcaccttctctgttcgtgccaagcagacctacccatactgtgcactgcccaggtcccgggcctcctccgagagtgaattggatgatgaaggcccctgtggtggtgatggggacccaggcctgttccccttccccatgccccggggtgggacccaggcctccagcgaagagagtgaggaggaggggacatctgacgacctccacccaccccctgactgccattatgcaacccggcccccacggccacaggcgttctgcacctttgggagccggctggtgagcccaggatgctatgtgtttagccgccggctggaccggttctgctcagcactcagctccatgctggaacggcacctcagcacacacatgtggaagaagatcccaccggcagctgaacctccagctcaccttgtcaactccccgttatctgctcccctgagcccatcctctacaggcacctgcccccgccttccaggtccaaccctgagacctgcctgcccagcctccatgccccccaccaaggacaaccttgtccccagctaccctgcaggctcccccagcgtggcggctgcctgtagccaggcagagtgcatgggcgagccaggctatcacctcaccactgcctgccaacacgccatccccgtccttcagcaagctgccgccttccaaggccagcaagtcatccaaaggcaaggacggggtggaggtggaggccccttctcgaaagcggaagttatcccctggccctaccactcttaaacggacctgcatcctggagcccactggaaaagggaaaccctctggctgtaggggcctctcggccaaaactaaaacagccctgagcatggggcttaatgggacaatggggccaagagtgaagcgggcagggcccctggactgtcgtggctcccctcatcagctccccacaccagtcaaggcttctcagctggagaaccggggagcagctggacacccagccaaggccctgccaaccaactgcctctctgaggaggaggtggccaagaagcggaaaaacctggccacttattgccggccagtgaaggccaagcactgtcaggctggtgcccctgctgatgtggcctgctctgtgcgccgcaagaagccaggcccggccctggcctttgaggagaagtgctctacactgaagtcaaaagcccattaacgagaaagtgcctgcccactgcaacggagccgccagcacctcctcccctccagatccgggccccaggctgctgccgctttttataactttatattatttttttttaagaaaaaaagctctttaaaatacctc

SEQ ID NO: 109394 - DNA, 3811 bp, Homo sapiens
  Payload ID: 1482
  Gene Symbol: ATXN7L3
  Gene Name: ataxin 7-like 3
  Uniprot ID: Q14CW9
  ENST ID: ENST00000389384
  CDS Start-End: 310-1353
tgctgcctcctatagacccagactctgattggcagtggagtccagggcctgagctcaggcctgggaaagactaggccccctttaggtttcaggccttgaaggaccatccagacttagggagcctgggccttggggagggagagaccctgatgccaggactgagctttgggcagcgaggtggggagggaaggtggccgcattcagaggtgccttggactcacaacaacacccccacccccgtgtgtgcagccgtgttgccgcccgctgtgctatgagcagtcagagcgccgtctccacaagagtttacaaatgaaaatggaggaaatgtctttgtctggcctggataacagcaaactagaggccatcgctcaggagatatacgcggacctggtcgaggattcttgtttgggattctgctttgaggtacaccgggctgtcaagtgtggctacttcttcttggacgacacggaccctgatagcatgaaggattttgagatcgtggaccagccgggcttggacatctttggacaggttttcaaccagtggaagagcaaggagtgtgtttgccccaattgcagtcgcagcattgccgcctcccgctttgctccccatctggagaagtgcctgggaatgggtcggaacagcagccgaatcgccaaccgccggattgccaatagcaacaatatgaataagtctgagagtgaccaagaagataatgatgacatcaatgacaacgactggtcctatggctcggagaagaaagccaagaagagaaagtcagacaagaaccccaattcccctcgaagatccaagtcattaaaacacaaaaatggggaacttagcaattcggatccttttaagtataacaattcaactgggatcagctatgagaccctggggccggaggagcttcgcagcctgctaaccacgcaatgtggggtgatttctgaacacaccaagaagatgtgcacaaggtccctgcgctgcccacagcacacagatgagcagaggcgaaccgtacggatttattttctcgggccctcggctgtccttccagaggtcgagagctccctggataatgacagctttgacatgactgacagccaggccctgatcagccggcttcagtgggacggctcctctgacctctcaccctctgattcaggctcctccaagacgagtgaaaatcagggatggggtctaggtaccaacagctctgagtcacggaaaaccaagaaaaagaaatcccatctgagcctggtagggactgcctccggcctaggttccaacaagaagaagaagccaaagccaccggcacccccgacgcccagcatctatgatgacatcaactgacttgggtgcaagggatagcctttggctgagcagagccctctctcctgacccccacccaggtggcatagcctggcaaatggacggctgctgggggttggggcttgggaagcttggtgggccaggcaggcagaggatccgattatgcgcccctggggggtgtcaaagtcctctgcaatggagcacgactcctcggcgtgcaggactcagacctggacatattatgccttggacataagtttggtggggaggcggttttcctatttattctgtgagttactggatgtccagctaggccaggggcctgacctgggcactgtgccagggcactgcctgccccccaccccaggaactggactaagccctgctgaggggcaatgtggcgacccgggaggctgtgggttggaagctgagcctggagggggcctgcctcggccgccctcagcaatgtgaatgggtccggtgcttggagctgaggggcaaggctgggcatgtcctgtctgtgtgcagaatcttatcaaatgcccccagtcccaggggtaggcaggcacagagtgctgtctgctgaggtgggcgtccagaactgccgccaccttccctgcccctcacaggggcagccctttcccctcagtccccatgggcctccttggcagcaggagctgtccttttgttgggtgccaggaaagggcctccagcctctacagcttcaaggaatgggaaagggagggtaggaagagggagaagtgtcagaattcctccccctgcctctcctccctgacccagggctggtgaggagtggggccccaaggtgagagggaacggtgctgctttatttgaaatgttttcttacctcattccctgccccaggaagggacccagcctcaccctcctggggtggccccgtgttcctcctgcccaccctgccccactgccctaccggggcagcccaggttcccaactgctgcttccacccccttcaccttgactggcttcagttcctctcagcgctcctgcctccaaagcgtgccctgtttcccttccttagcgcttttaagttatttattctgtacttgtggtttggggctctgaggaaaatcctaatcttgtgcctctccccctttgctaggagttgggtgggaagagagggtggcctctgtgccccaggttgtcagtggaggggaaggggtgtcactgcccctctgtgggactgtcatgccagtgtgcccacctgcctggtctacatcctaaagagatgtaccgtcccccctccatgcgggcaccaccactcccaggagccaagctggaggaccgcgacctgggctgggagcagagctgactgacatgggtggaggtgaccctgagccaagttctctggcacttgctggacatgtcccctaccctcttcccaagaggagccatcccacatttgggtagttagtacccaggactggttggactgatcgggttagggaccctagagggttaagggaacaacagagatggggctgcaatgccctgtctggaactccgctctcccgctggggtggttctgattgtggctcatgcctggttgcaaattggtttttaacccacaaattgtgattattttttaaaaagccaaacagattttggcaggagttagaataaatcccggggcctgggcttctctattcttggccctccgtagtctccctccgagaggaggccagagggagaggaggatctcagcaggcctctagccgcttccagatgcagtctggggagtgggctgaaggtgaagggaggaaggctgtgggccactctcccttctgagaggcagctgcagctcaggccctaatacactctttgccctgtggcctctcccttttccccccttctggttggaggagggagaagtgggaagtagcttgggaactggtttgtccacataaacttccccattgttccttggcccgccctcagggcagagccccctgcccaggctgggtaagagatgggcttggtccagcagggaccctgagggaacaaacccttttccttctggggagagagtgccccccctaccatgtagttgaacaggggctaggagctccccactcccctccctctaacagcaggctgtgtgggtttcaattcccatccttcccaccccggctaggtgtcgtccaccctgtatcctgtgtctgagtgtgtgtgggggggttctgtactaatttccatggccggtggcttttccttccatgcatcactcccccccgcatgcccaggggccacccgcctggcattaccgcatgctggggtcattgggggaggggggtggggctcacgctgtcctgtggtcttgagatttttatttttgcatatgtaatccattctgtacaggtagctaactttgtaaacgctgtgtattccctctgcccccatggctgctggtgtaaataaactgcatctcccgttggta

SEQ ID NO: 109395 - DNA, 3523 bp, Homo sapiens
  Payload ID: 1482
  Gene Symbol: ATXN7L3
  Gene Name: ataxin 7-like 3
  Uniprot ID: Q14CW9
  ENST ID: ENST00000454077
  CDS Start-End: 1-1065
atgaaaatggaggaaatgtctttgtctggcctggataacagcaaactagaggccatcgctcaggagatatacgcggacctggtcgaggattcttgtttgggattctgctttgaggtacaccgggctgtcaagtgtggctacttcttcttggacgacacggaccctgatagcatgaaggattttgagatcgtggaccagccgggcttggacatctttggacaggttttcaaccagtggaagagcaaggagtgtgtttgccccaattgcagtcgcagcattgccgcctcccgctttgctccccatctggagaagtgcctgggaatgggtcggaacagcagccgaatcgccaaccgccggattgccaatagcaacaatatgaataagtctgagagtgaccaagaagataatgatgacatcaatgacaacgactggtcctatggctcggagaagaaagccaagaagagaaagtcagacaagctatggtatctcccattccagaaccccaattcccctcgaagatccaagtcattaaaacacaaaaatggggaacttagcaattcggatccttttaagtataacaattcaactgggatcagctatgagaccctggggccggaggagcttcgcagcctgctaaccacgcaatgtggggtgatttctgaacacaccaagaagatgtgcacaaggtccctgcgctgcccacagcacacagatgagcagaggcgaaccgtacggatttattttctcgggccctcggctgtccttccagaggtcgagagctccctggataatgacagctttgacatgactgacagccaggccctgatcagccggcttcagtgggacggctcctctgacctctcaccctctgattcaggctcctccaagacgagtgaaaatcagggatggggtctaggtaccaacagctctgagtcacggaaaaccaagaaaaagaaatcccatctgagcctggtagggactgcctccggcctaggttccaacaagaagaagaagccaaagccaccggcacccccgacgcccagcatctatgatgacatcaactgacttgggtgcaagggatagcctttggctgagcagagccctctctcctgacccccacccaggtggcatagcctggcaaatggacggctgctgggggttggggcttgggaagcttggtgggccaggcaggcagaggatccgattatgcgcccctggggggtgtcaaagtcctctgcaatggagcacgactcctcggcgtgcaggactcagacctggacatattatgccttggacataagtttggtggggaggcggttttcctatttattctgtgagttactggatgtccagctaggccaggggcctgacctgggcactgtgccagggcactgcctgccccccaccccaggaactggactaagccctgctgaggggcaatgtggcgacccgggaggctgtgggttggaagctgagcctggagggggcctgcctcggccgccctcagcaatgtgaatgggtccggtgcttggagctgaggggcaaggctgggcatgtcctgtctgtgtgcagaatcttatcaaatgcccccagtcccaggggtaggcaggcacagagtgctgtctgctgaggtgggcgtccagaactgccgccaccttccctgcccctcacaggggcagccctttcccctcagtccccatgggcctccttggcagcaggagctgtccttttgttgggtgccaggaaagggcctccagcctctacagcttcaaggaatgggaaagggagggtaggaagagggagaagtgtcagaattcctccccctgcctctcctccctgacccagggctggtgaggagtggggccccaaggtgagagggaacggtgctgctttatttgaaatgttttcttacctcattccctgccccaggaagggacccagcctcaccctcctggggtggccccgtgttcctcctgcccaccctgccccactgccctaccggggcagcccaggttcccaactgctgcttccacccccttcaccttgactggcttcagttcctctcagcgctcctgcctccaaagcgtgccctgtttcccttccttagcgcttttaagttatttattctgtacttgtggtttggggctctgaggaaaatcctaatcttgtgcctctccccctttgctaggagttgggtgggaagagagggtggcctctgtgccccaggttgtcagtggaggggaaggggtgtcactgcccctctgtgggactgtcatgccagtgtgcccacctgcctggtctacatcctaaagagatgtaccgtcccccctccatgcgggcaccaccactcccaggagccaagctggaggaccgcgacctgggctgggagcagagctgactgacatgggtggaggtgaccctgagccaagttctctggcacttgctggacatgtcccctaccctcttcccaagaggagccatcccacatttgggtagttagtacccaggactggttggactgatcgggttagggaccctagagggttaagggaacaacagagatggggctgcaatgccctgtctggaactccgctctcccgctggggtggttctgattgtggctcatgcctggttgcaaattggtttttaacccacaaattgtgattattttttaaaaagccaaacagattttggcaggagttagaataaatcccggggcctgggcttctctattcttggccctccgtagtctccctccgagaggaggccagagggagaggaggatctcagcaggcctctagccgcttccagatgcagtctggggagtgggctgaaggtgaagggaggaaggctgtgggccactctcccttctgagaggcagctgcagctcaggccctaatacactctttgccctgtggcctctcccttttccccccttctggttggaggagggagaagtgggaagtagcttgggaactggtttgtccacataaacttccccattgttccttggcccgccctcagggcagagccccctgcccaggctgggtaagagatgggcttggtccagcagggaccctgagggaacaaacccttttccttctggggagagagtgccccccctaccatgtagttgaacaggggctaggagctccccactcccctccctctaacagcaggctgtgtgggtttcaattcccatccttcccaccccggctaggtgtcgtccaccctgtatcctgtgtctgagtgtgtgtgggggggttctgtactaatttccatggccggtggcttttccttccatgcatcactcccccccgcatgcccaggggccacccgcctggcattaccgcatgctggggtcattgggggaggggggtggggctcacgctgtcctgtggtcttgagatttttatttttgcatatgtaatccattctgtacaggtagctaactttgtaaacgctgtgtattccctctgcccccatggctgctggtgtaaataaactgcatctcccgttggta

SEQ ID NO: 109396 - DNA, 539 bp, Homo sapiens
  Payload ID: 1482
  Gene Symbol: ATXN7L3
  Gene Name: ataxin 7-like 3
  ENST ID: ENST00000590537
  CDS Start-End: 322-539
ctttgtcaaatcttttttccttccctgggttctcggctcccccttttcgttaccctttccccaaagctatggtatctcccattccagaaccccaattcccctcgaagatccaagtcattaaaacacaaaaatgggttctctgtctgtacctctgcatcaaacacccttccccttcttttttcttcttcaggggaacttagcaattcggatccttttaagtataacaattcaactgggatcagctatgagaccctggggccggaggagcttcgcagcctgctaaccacgcaatgtggggtgatttctgaacacaccaagaagatgtgcacaaggtccctgcgctgcccacagcacacagatgagcagaggcgaaccgtacggatttattttctcgggccctcggctgtccttccagaggtcgagagctccctggataatgacagctttgacatgactgacagccaggccctgatcagccggcttcagtgggacggctcctctgacctctcaccctctgattcaggctcctccaagacgag

SEQ ID NO: 109397 - DNA, 1341 bp, Homo sapiens
  Payload ID: 1482
  Gene Symbol: ATXN7L3
  Gene Name: ataxin 7-like 3
  ENST ID: ENST00000587097
  CDS Start-End: 418-1341
tcgcggcacacgcgcgcgcgctccgggctcgcgccgcaccccccgcccgggagaggcgggctggagtggggggcggggggaggggcgcgcggacggcgcgcggactgcgcgcgggcggggtgaggtgaggaggaggaggcggcgacgggacaagaagggaggggaaggggccatggccgcccggtgaggcggccaggcgggggggcggcccgaccccccggccccgggccctgggccccggggagaggcgaggacggaccgacggacatggggctccggagcagccgccgccgtcgccgccgccggaggacgcggccctgagaggctgccgggccccggcgcggccccccgggcgggccgtgttgccgcccgctgtgctatgagcagtcagagcgccgtctccacaagagtttacaaatgaaaatggaggaaatgtctttgtctggcctggataacagcaaactagaggccatcgctcaggagatatacgcggacctggtcgaggattcttgtttgggattctgctttgaggtacaccgggctgtcaagtgtggctacttcttcttggacgacacggaccctgatagcatgaaggattttgagatcgtggaccagccgggcttggacatctttggacaggttttcaaccagtggaagagcaaggagtgtgtttgccccaattgcagtcgcagcattgccgcctcccgctttgctccccatctggagaagtgcctgggaatgggtcggaacagcagccgaatcgccaaccgccggattgccaatagcaacaatatgaataagtctgagagtgaccaagaagataatgatgacatcaatgacaacgactggtcctatggctcggagaagaaagccaagaagagaaagtcagacaagaaccccaattcccctcgaagatccaagtcattaaaacacaaaaatggggaacttagcaattcggatccttttaagtataacaattcaactgggatcagctatgagaccctggggccggaggagcttcgcagcctgctaaccacgcaatgtggggtgatttctgaacacaccaagaagatgtgcacaaggtccctgcgctgcccacagcacacagatgagcagaggcgaaccgtacggatttattttctcgggccctcggctgtccttccagaggtcgagagctccctggataatgacagctttgacatgactgacagccaggccctgatcagccggcttcagtgggacggctcctctgacctctcaccctctgattcaggctcctccaagacgagtgaaaatcagggatggggtctaggtaccaacagctctgagtcacggaaaacc

SEQ ID NO: 109398 - DNA, 622 bp, Homo sapiens
  Payload ID: 1482
  Gene Symbol: ATXN7L3
  Gene Name: ataxin 7-like 3
  ENST ID: ENST00000589805
  CDS Start-End: 204-622
ccctcccggactcctctccccggccggccggggctgctggcgggcggggaaggagaggggctgggacgcgtcccactctctgggggtcggtctgtcccggcccggcgccggccccggcggctcggctgtcctccccccagtcgccgtgttgccgcccgctgtgctatgagcagtcagagcgccgtctccacaagagtttacaaatgaaaatggaggaaatgtctttgtctggcctggataacagcaaactagaggccatcgctcaggagatatacgcggacctggtcgaggattcttgtttgggattctgctttgaggtacaccgggctgtcaagtgtggctacttcttcttggacgacacggaccctgatagcatgaaggattttgagatcgtggaccagccgggcttggacatctttggacaggttttcaaccagtggaagagcaaggagtgtgtttgccccaattgcagtcgcagcattgccgcctcccgctttgctccccatctggagaagtgcctgggaatgggtcggaacagcagccgaatcgccaaccgccggattgccaatagcaacaatatgaataagtctgagagtgaccaagaagataatgatgacatcaa

SEQ ID NO: 109399 - DNA, 3017 bp, Homo sapiens
  Payload ID: 1482
  Gene Symbol: ATXN7L3
  Gene Name: ataxin 7-like 3
  ENST ID: ENST00000591295
  CDS Start-End: 1-559
gtcattaaaacacaaaaatggggaacttagcaattcggatccttttaagtataacaattcaactgggatcagctatgagaccctggggccggaggagcttcgcagcctgctaaccacgcttatattcctcttccagcaatgtggggtgatttctgaacacaccaagaagatgtgcacaaggtccctgcgctgcccacagcacacagatgagcagaggcgaaccgtacggatttattttctcgggccctcggctgtccttccagaggtcgagagctccctggataatgacagctttgacatgactgacagccaggccctgatcagccggcttcagtgggacggctcctctgacctctcaccctctgattcaggctcctccaagacgagtgaaaatcagggatggggtctaggtaccaacagctctgagtcacggaaaaccaagaaaaagaaatcccatctgagcctggtagggactgcctccggcctaggttccaacaagaagaagaagccaaagccaccggcacccccgacgcccagcatctatgatgacatcaactgacttgggtgcaagggatagcctttggctgagcagagccctctctcctgacccccacccaggtggcatagcctggcaaatggacggctgctgggggttggggcttgggaagcttggtgggccaggcaggcagaggatccgattatgcgcccctggggggtgtcaaagtcctctgcaatggagcacgactcctcggcgtgcaggactcagacctggacatattatgccttggacataagtttggtggggaggcggttttcctatttattctgtgagttactggatgtccagctaggccaggggcctgacctgggcactgtgccagggcactgcctgccccccaccccaggaactggactaagccctgctgaggggcaatgtggcgacccgggaggctgtgggttggaagctgagcctggagggggcctgcctcggccgccctcagcaatgtgaatgggtccggtgcttggagctgaggggcaaggctgggcatgtcctgtctgtgtgcagaatcttatcaaatgcccccagtcccaggggtaggcaggcacagagtgctgtctgctgaggtgggcgtccagaactgccgccaccttccctgcccctcacaggggcagccctttcccctcagtccccatgggcctccttggcagcaggagctgtccttttgttgggtgccaggaaagggcctccagcctctacagcttcaaggaatgggaaagggagggtaggaagagggagaagtgtcagaattcctccccctgcctctcctccctgacccagggctggtgaggagtggggccccaaggtgagagggaacggtgctgctttatttgaaatgttttcttacctcattccctgccccaggaagggacccagcctcaccctcctggggtggccccgtgttcctcctgcccaccctgccccactgccctaccggggcagcccaggttcccaactgctgcttccacccccttcaccttgactggcttcagttcctctcagcgctcctgcctccaaagcgtgccctgtttcccttccttagcgcttttaagttatttattctgtacttgtggtttggggctctgaggaaaatcctaatcttgtgcctctccccctttgctaggagttgggtgggaagagagggtggcctctgtgccccaggttgtcagtggaggggaaggggtgtcactgcccctctgtgggactgtcatgccagtgtgcccacctgcctggtctacatcctaaagagatgtaccgtcccccctccatgcgggcaccaccactcccaggagccaagctggaggaccgcgacctgggctgggagcagagctgactgacatgggtggaggtgaccctgagccaagttctctggcacttgctggacatgtcccctaccctcttcccaagaggagccatcccacatttgggtagttagtacccaggactggttggactgatcgggttagggaccctagagggttaagggaacaacagagatggggctgcaatgccctgtctggaactccgctctcccgctggggtggttctgattgtggctcatgcctggttgcaaattggtttttaacccacaaattgtgattattttttaaaaagccaaacagattttggcaggagttagaataaatcccggggcctgggcttctctattcttggccctccgtagtctccctccgagaggaggccagagggagaggaggatctcagcaggcctctagccgcttccagatgcagtctggggagtgggctgaaggtgaagggaggaaggctgtgggccactctcccttctgagaggcagctgcagctcaggccctaatacactctttgccctgtggcctctcccttttccccccttctggttggaggagggagaagtgggaagtagcttgggaactggtttgtccacataaacttccccattgttccttggcccgccctcagggcagagccccctgcccaggctgggtaagagatgggcttggtccagcagggaccctgagggaacaaacccttttccttctggggagagagtgccccccctaccatgtagttgaacaggggctaggagctccccactcccctccctctaacagcaggctgtgtgggtttcaattcccatccttcccaccccggctaggtgtcgtccaccctgtatcctgtgtctgagtgtgtgtgggggggttctgtactaatttccatggccggtggcttttccttccatgcatcactcccccccgcatgcccaggggccacccgcctggcattaccgcatgctggggtcattgggggaggggggtggggctcacgctgtcctgtggtcttgagatttttatttttgcatatgtaatccattctgtacaggtagctaactttgtaaacgctgtgtattccctctgcccccatggctgctggtgtaaataaactgcatctcccgttggta

SEQ ID NO: 109400 - DNA, 593 bp, Homo sapiens
  Payload ID: 1482
  Gene Symbol: ATXN7L3
  Gene Name: ataxin 7-like 3
  ENST ID: ENST00000590169
  CDS Start-End: 152-593
ttaggagtctgtgcagttctttgccacaccctgtgggtttgctttgaggccttggagttccttctcctccccctgctgcattgcaccatggccgtgttgccgcccgctgtgctatgagcagtcagagcgccgtctccacaagagtttacaaatgaaaatggaggaaatgtctttgtctggcctggataacagcaaactagaggccatcgctcaggagatatacgcggacctggtcgaggattcttgtttgggattctgctttgaggtacaccgggctgtcaagtgtggctacttcttcttggacgacacggaccctgatagcatgaaggattttgagatcgtggaccagccgggcttggacatctttggacaggttttcaaccagtggaagagcaaggagtgtgtttgccccaattgcagtcgcagcattgccgcctcccgctttgctccccatctggagaagtgcctgggaatgggtcggaacagcagccgaatcgccaaccgccggattgccaatagcaacaatatgaataagtctgagagtgaccaagaagataatgatgacatcaatgacaacgactggtcctatggct

SEQ ID NO: 109401 - DNA, 7604 bp, Homo sapiens
  Payload ID: 1483
  Gene Symbol: ATXN7L3B
  Gene Name: ataxin 7-like 3B
  Uniprot ID: Q96GX2
  ENST ID: ENST00000519948
  CDS Start-End: 287-580
agaggcccaggaggctgggtgaggcgctgagacggtttggcggtgagtcctgggccaggcgcagctgaaaggcccgcaacccgggaaacgtcaaaacaaacagaaggacttgggattccggagcagtcgcccctatcgctgctcctgcagttgcggacgccaccgaccccgccgccggaggactgggcactgaaaggcctctaggcctaggcgcggcccgcggagccagacgtgttgctgccgtgagtaaaacgagcgccctctccgcactcgtttacaaattaaaatggaggaaatttcgttggccaacctggatactaacaagctagaggccatcgctcaggagatttacgtagacctgatagaggattcttgtttgggattctgctttgaggtgcaccgggcagtcaagtgtggctacttctacctggagttcgcagagactggtagcgtgaaggattttggcattcagccagtggaagacaaaggagcgtgccgcctcccgctttgctcccttcccggagaacctgggaatgggcctgatcagcagctgcagcgctcacctccggaattccagtagctgcaaaatgagagtctgaaagtggccaggacaataacatagactggtcctgtggcttcgaggagtaagctaagtagaaaaaagtagaaaaatcagacaaaagttttaattcccccttgaagatcctagcatttaaaaacccaaagtggataatttaggaatcctttttttaaagtgtattacctggagcaagctctgaagccctgggcaggaggagctgcacagcctgcgggccatgcagtgcctgttgatctctaaacacaccaggatgtgcgcaagatcctgtagtgcccccagtgcacaggtgagcagttgtgtgcccagcatataaaatttttggttcctcagcctttctgtctgcctgatgtcaagggcttcttggacagtttggacgttacagttcgtcaggccgtgatcagtggcctgcagtgggactgctcctttgatatctgaacctctgttatgggcttctctgagacaagtaaatgtcaggtgcaagatctggatactaacagtttcagtttgggaaatccaagaaaaagaattatcaagtttgatagggaagctctgtagccttgactccagcaagaagaaaaggtcaaaaccacgtgtttcccaaaagtccagactacaatgattcagctgacttgaggacaaggcctagcatttggctgagcagagccctcttccttgccctccaacctggtggcataggcttggcaaatggacaacttggttgtccagacaggttgaggattcggttatgatcccctggggaggtagcagggacctctgcaactatgcatgatttctcaaacttcaagattcatgtctggatgtattatgctgtggatataagtttagtagggcggtcatttcctactctgagttactggttacctagccagtccatgggtgtgacttggtccttaagtcaggtcactatctgcctcccaccctgggggcaggactgaagtatggaagagcatcatggctgtgcaggaggctgtggtttgaaaactgagcccagagggcactttcagctgccctcaataatgtgaatggattagtgctaggagccaaggagcaggactggattatctcatctgactgtgtgcagaatcctgttgaatgtccctgttttctttggttgggcagtcagagctctgctatggtgaacatccagactgtcaccactttctgtctgccgctcgaaagggatagtcctttccactcggtcccctttggatcttcttgacaacaggagcagtccttttattgttagaagtcagagaaagacctccagaatctcctgactttagggaatggtataggggaagatgggaagtaagagtcacatatcaaaactaccctccactttattccctgagcgagggtttatgaagtataaaggggtgggagccccgaggtgagcgggaacggtgctgctttatttgaaatgttttcttacctcattctgtgccccagtagggggtccagcctcatctgtctggcttggccctgtgttcctcctgtcccctgctccactgcctatctggtgccccaggtgctgcttgccactccagctgtcacattgaacagtttcaattcagctcttaatgctcctgcttccgaagcctgcccaatttcttttttcttggcctctgttttttttttttctttctttttcccttgtttttgtagaagactcagaggagaatctttcttatggctccctctgttgagattggaattggaagagaacttaattttttgtatttaaaatgcagtgtcatgcctataagcatttctcctatataggactgctttgctagtgtgccctcttgctgtgtcttacttcataaggagttgtatcttcccacctccatttcaatactgccggttaggacctaagtagaagagcagtaaaggctgattgacacacagggggatggagttggtccttgtccattctctcacccttgctgtgcatgtatcaatccttatcccagaaggtactatttagactgtatagactgatttagattacatactttagaggattaaggaaaccatagagtttgggccttggaactgttactgccttgtcctagagttgtcctgatcaggcttggggcctagttacagattagtcttaaagaattgcattaacttaaaaaaaatcaaaccttggcaagagctaaaataatttggagatatctttgcccttgacttgtagacgacatctaagaggatgaagaaaggagagtctaagtgagactctggcctacttcctaacaatgtcttggaagtgggatgatggtaaaggagaaaggccacagtccaatccctctgccttcagatagggaactcaaatcctgaaattactgttttctttctggccttttctcctggttagaggaggaagcggaaagtagttttgagtagtattttgttcatattaccccccttttgttttttgtttctggcccctctaccaatagggcagtagcctcctgccctggatgggtataaggtgggcttggtccaacaggtgcccagagggtacatactcctttctggggagagaatgctccctaccatatagttgacagtggttaggaactctccctttccctacctaccttccttttaatagcagaattcctatttttcccttgattatgtgtattgatcaccctgcaatcctattatgtatctgagtgtgtgtgtgtgtgtatgtgtgtgttatgggggaaggggggggttctttaaaatttctgtggtttgtggctttttcttccatacattagttcccaccatcgcatgcccagggaccactgcctggcattatcgcatgctgggatcatcgggggagggtagtgaagctcaccactgtcctttgttttggagatttttatttttgcataagtagtccatcctatacagatagctgattaactgtattcccctttcccctatggctgctggtgtaaataaactgcatctccccattggtaaacagtaataaaattttaaaaaatgactacttggtccttggactctgtatattcatcttttaaagctgtatgttttcaggcattgacataatgagataaacgttgaaatgctattgaaccttaatacttcctccctaacaggagttttatcagaacagagaaactgtccaaccttgtttctcaatttggcctgcaaatttaactgtctgtagcatccagtgaaagagccaaaccgtatacaatcatcccttttccatatgaggtaagaaggtggtaagataaatccagtcctgtcactaaaagcccactgtgacagatagttccatttgaattgaactcaatatatcttagtaagtacattttaccatcattttaagctaatatccttgttctcaaaaggtaaagtgattcacagcagacgatggttctgcctaatttttttctcaatacttaaaaaattacctcaacactttagatctttcatttcatttttaatagtaattctgaggtttttcatcccattcctaacccagagtttgagcacttcccctagaaactacttagtgatcctgtgtcctaatcagtctcttgctatgtgttctaatttattaaagtttcgtattggacataatactgagattaataaaaattacagaaatgagtccagagaagaatctgactcaataggatacctcagggaagcttatagatgtgtaacatggtattgagtcttctcttctaggagcactcgatgtacttgtcactgtccagtttaaataggccagggccaacgtggtgatttgagaaaacttaaaaatttgacgtgtgaaacccatgatgtaaccatagcaggagaaattcttcaaatgaaatttcaccaagattgggtattttgccttaagtaagatttctactacttttattaaaattcactgtagggatctactatcaattagctttcaaatacatctgcagcaaatacttttggttcctgttttgtaggtttggagtttaatatatttagtgctaagctaattagttttctaaaaagataattgcaagacccctgctttaccaaatacttgacaatgggactttgaaggttatttcttatgttttctgactagtatgatctttaaagaaaaaaaaaaacacattgcataccttttaactaccaatgtttaacctcctagatttagcatttaactacagcatgtaccatcaggtcaagaatctgataaatgattgcttgatgttgacaaagtgaaagacaaaatgaagtgtactgaagtaactaaaaattcaggaagaactttcttgtgcacacattaataagtaacattgccttctcttaagacctatctgaagtgttgtgaagtttttcttacaattttttaaaagagatttatgaagaaactatgtgctaaaagcacaacaattattaaatttattttcatgttgttgtttaattatggttaacgaattgccagttttcaagtcagccagagataataccagatttcagaagttttactctgctgtgaaggattacgagctctctgattttcatttatgttccaaaagatgcccataatgttgctttggaggacagcattagaagtgatgttcctattcaaaaaggttttgtggataaaccttaaactcttggcggtgtttttgtttgtatttgttttcccatttttgaaaacattttcaatcatatttcttgagactcattggaaatatgtgagctaaaaaggaaatactaaattgattttagagatgaaaaaaaaatcttcagcagcagtgacttgcccatagttcaaaaagcaaaaatttacaagtggtggaagcaaaagtagaatgctgctgttgtgactcctaggtcagcggtctttgttgaagcaatggagtaataaatcaaacgactaattaaaaacaaaacaatgaaaaatccatgatgcttatgaacaacgttagggcaatgaatttgaaaacaaaaaaagggaagtctattttaaaatagaactcaaaagtaactcaaggaattgttaattttttaagtaaatgaatacatctataacttttaaaacaccacacaattagaattttatagagaatacagtaaatgaaacaacaacaacaaaaacaggcaaaataataccaaaatagattttttttttaaatgaagatgttagcaaaccaactcctttaaaataacaaaagtaaacatcaacaagtcagtttaatcacaggatggcaagatttcatctcaaaatcatcacattaccattagagaaaatccatgtgaaaatttgaactgatactgaaaaatagtttgaaaaaattcaatacgaattattgcctaaaaaacaaagacattaacaatatagaaaccaaagctcaagaacttgtacacactgcaaaagggtatgtaccaaaaatctacaccagttactatacttattaatgaatacttggaagcactccctttaaaagcaggaatggaagaaacaaaatttttactgttctaagatgatatttacatgaacaattttatagaatctagaaacagttgttctcagatgacatctacatctacatggataattttatagaatctacaaacataccattgaaagtagtgagaaaatttagcacagttactggatataagatcaatatctaaaatcagaataccaacatttaaaaagtgttattaaatttagaatgtaattcaacaagttataacagtcctatgaaataatatcacaagaactgtgtaagattttataaagaaaataatattttctaatatgttgggaaaatcccaagtaaatggagagaagatgttcacgcacagaaaatgcaatcaatatcattgctccaaattatgtgaatcggaagcaatctgtattacaatccaaatagatgtgctcatggaacttgacaaattaattttaagatttatatgaacaccagatgctagaatagacaagatctttttgacagatgtatattttagttttggtgcagaaacaatggaatagaatagagtttagaattagatcgaaacacacagattacacgtttatgtcttgatgtgtggttaaatttgtattataatcagtggaatataaaccagtattgtggaacagattatccataaataataaaactgtgctcagacacaaaattaattcctatatggattaaagatttaatgtgtaaaagtaaaaaatgtcaaatctttctagaaaaatataggaggatgtgttcataattgtgtataaggggaaaatttcttaaaagtacaaaacatagagaaaagattgatgtgttcgaccataataaaaatagaactttctgttcattaaatcatactagaaacaaacaaaccaataacctgatgtgctagttgtttagttcttataactgattaaagattactaacaaaatagttgtacaattgccaaatgtataaagtaaaagaacagctcattcttacaaaaagaaatatgaatggccaaaaagttgtaaaagttcccttaggttcaaagaaatgcaaactaaaaacaaaataccaatttaccctactcagtatgattaaatttttttaaatggtgatgacatcaactctgaaaggcatatggagcaattaaaacacttaaactgctagtaggctgtaaattggtaaaaaatgtttttaaaagcaatttagaaatacctgttgtggttgaagacaaaagtaaccaatatcccaatatttccacctgttgcagcattatatgtaatagggaaaaattgaaagtaatatacccatttggaatacatatagtcactatactgaagtgagaataaattaaccagagctgtacaaataaaatagtaaacctatgttcttatactttgttgcctttcttttgatgtttaacaataggcaaatcaatgctgtatgttgtttaaataattgtgaatatgaaataaaaactataccaaaaata

SEQ ID NO: 109402 - DNA, 578 bp, Homo sapiens
  Payload ID: 1484
  Gene Symbol: ATHL1
  Gene Name: ATH1, acid trehalase-like 1 (yeast)
  ENST ID: ENST00000397660
  CDS Start-End: 1-578
ggagatttacgaggctgtgacgtccccccagggccccgccatgacctggagcatgtttgctgtgggctggatggagctgaaggacgcagtgcgggcccggggcctcctggacaggagctttgccaacatggctgaacccttcaaggtgtggacggagaatgcagacgggtcaggcgctgtgaacttcctgacaggcatggggggcttcctgcaggcggtggtcttcgggtgcacggggttcagagtgagcgtctccggcatcttctaccaggggaacaagctcaacttctctttttccgaggactccgtgaccgtggaggtcacagctcgagcagggccctgggctcctcacctggaggctgagctgtggccatcccagtcccggctctccctgttgccaggacacaaggtctcctttccccgctcggctggccggatacaaatgtcacccccgaagctgcctggaagttccagctccgagttccctgggaggactttttcagatgttagggacccgctccagagccccctctgggtcaccctgggttcctccagccccaccgagtcactcactgtgg

SEQ ID NO: 109403 - DNA, 2963 bp, Homo sapiens
  Payload ID: 1484
  Gene Symbol: ATHL1
  Gene Name: ATH1, acid trehalase-like 1 (yeast)
  ENST ID: ENST00000409655
  CDS Start-End: 567-2036
ccggccctggcgtggagcagagggacacaggttcccacgctggcgcccggcgaccgggtggggctgcgtgacccccgtctcttggccactgtgaccaacgcatacctgggcacacgagtgtttcacgacacgctgcacgtgagcggcgtgtacaatggggctggcggggacacgcaccgggccatgctgcccagccccctcaacgtccggctggaggcccctgcagggatgggggagcagctgaccgagaccttcgccctggacaccaacacaggctcctttcttcacaccctggagggcccccgcttccgggcctcccagtgcatctatgcgcatcgcacgctgccccacgtgctggctttccgagtgtccatcgcccgcctggccccggggagcgggcccatcacgctgctcctgcggtcagccttctccccagaaagcccagacctggacctgcatcagggtcctgacttccagggagcccggcatggccacgctctcacaggtacctgtatggccacaccctcacccctgagcagcccggggggccacagcaagaggtacacatgctgtggacaccagcacccccagacctgacccttggggaaggtgaggaggctaggacgtgggacttcctgacagcagtgggcggcagccaggctgaggctcaggcctgcctcactgaggccctgcagctgcaggccaggggagctctgtatacggctcacgcacaggcctgggcccagctctgggtagaatgtggcttggacgtggtggggcccctgcagctgcgccaggccctgcgtggctccctctactacctgctcagtgccctgccccagcccaaggccccaggatacatctgccatggcctcagtcctgggggcctctccaatgggagccgtgaggaatgctactggggccacgtcttctgggaccaggacctctggatgttcccgagtatcctgatgttccacccagaagccgccagggccatcctggagtaccgcatccgcacgctggacggggccctggagaacgcccagaacctgggctaccagggagccaagtttgcctgggagagtgcagactccggcctagaggtttgccctgaggacatttacggagtccaggaggtccacgtcaacggggccgtggtgttggccttcgagctgtactaccataccacccaggacctgcagctatttcgagaggctggtggctgggacgtggtcagggctgtggccgagttttggtgcagtcgtgttgagtggagccccagggaggaaaagtaccacctgaggggagtcatgtcccccgacgagtaccattcaggggtcaacaactctgtgtacaccaacgtcctggtccagaacaggaaaaatctggagatttacgaggctgtgacgtccccccagggccccgccatgacctggagcatgtttgctgtgggctggatggagctgaaggacgcagtgcgggcccggggcctcctggacaggagctttgccaacatggctgaacccttcaaggtgtggacggagaatgcagacgggtcaggcgctgtgaacttcctgacaggcatggggggcttcctgcaggcggtggtcttcgggtgcacggggttcagggtcacccgagcgggtgtgacctttgaccctgtgtgtctgtcggggatctccagagtgagcgtctccggcatcttctaccaggggaacaagctcaacttctctttttccgaggactccgtgaccgtggaggtcacagctcgagcagggccctgggctcctcacctggaggctgagctgtggccatcccagtcccggctctccctgttgccaggacacaaggtctcctttccccgctcggctggccggatacaaatgtcacccccgaagctgcctggaagttccagctccgagttccctgggaggactttttcagatgttagggacccgctccagagccccctctgggtcaccctgggttcctccagccccaccgagtcactcactgtggaccctgcctctgaataatcaggaacggtggcttcagagacgtctcttgggccttccctctggccacgtctgcacccacccctcctgggcaccctcctagcctgccatccctcacctgcagccaggctctcagggaaggtccatgctgcttggcctgagttcaaggctttctgcctgtagcctggactcccgtggacccccgtgggcaggtggcttccccgtggcatctccacaccgcctctgcctgcccctgtggactgatgctatcgcgcaccgtcccacgaccccaccccgagctcctgaagccggggtctgagcctgcatcacctctggcctctcatcccccactctcctgagagcagtggtcacagcggccggccgctctgctgagaaggcagagaggcaggctcaggcctcagcgtggacagcagggataaggggcacgaaggacggggactcggccccttcagaattcctcaggactctcaggtgcagctttgccaaaaaggaacttttcatgtcatgcagttgaggggacttagtctcaatcccaggctcctcttgactctgggcagctttaatcaggttgggcagcctctgctacagcgtggggtgggatggctctcttccctcagccacgccgcttgtgaggacagaggtgggggagtgggaagtgggaagtcaccagagaacaggagagggatttgagggcgagaccccagcgctctccacggaccagccagagggactggagccaggtgtgcatgggttcaaggccctggccctgcccagcctttgtcttgggagctcagccccagggttcggtcgtcagcagtttcccaagaacaagatgtgatggcatctgctgctgaaaccctgatgaggaccaggccccctgcaccgctgtcagcctgaggaattaaagctttggtgctggggagagca

SEQ ID NO: 109404 - DNA, 3062 bp, Homo sapiens
  Payload ID: 1484
  Gene Symbol: ATHL1
  Gene Name: ATH1, acid trehalase-like 1 (yeast)
  ENST ID: ENST00000409479
  CDS Start-End: 259-2553
gggagagacacactcaggggctcagctgggttcctggagatcaacctttggggtctgagcccctctgagagtcgagctcctttcctgcgaggccccgtctaggaggggcctcaggaaaatcggggctgcccagctggttccgcaactccccccagttctgagggaggcttcaggggattacagacggtctcaagagggaggcccagccagtcccgcggcccctgacaccccatcaggccgctcaggcccagcagctccatggaggacgccggcgaggaccccaccacgtttgctgcccactctctgcccagtgacccccgtctcttggccactgtgaccaacgcatacctgggcacacgagtgtttcacgacacgctgcacgtgagcggcgtgtacaatggggctggcggggacacgcaccgggccatgctgcccagccccctcaacgtccggctggaggcccctgcagggatgggggagcagctgaccgagaccttcgccctggacaccaacacaggctcctttcttcacaccctggagggcccccgcttccgggcctcccagtgcatctatgcgcatcgcacgctgccccacgtgctggctttccgagtgtccatcgcccgcctggccccggggagcgggcccatcacgctgctcctgcggtcagccttctccccagaaagcccagacctggacctgcatcagggtcctgacttccagggagcccggtacctgtatggccacaccctcacccctgagcagcccggggggccacagcaagaggtacacatgctgtggacaccagcacccccagacctgacccttggggaaggtgaggaggctaggacgtgggacttcctgacagcagtgggcggcagccaggctgaggctcaggcctgcctcactgaggccctgcagctgcaggccaggggagctctgtatacggctcacgcacaggcctgggcccagctctgggtagaatgtggcttggacgtggtggggcccctgcagctgcgccaggccctgcgtggctccctctactacctgctcagtgccctgccccagcccaaggccccaggatacatctgccatggcctcagtcctgggggcctctccaatgggagccgtgaggaatgctactggggccacgtcttctgggaccaggacctctggatgttcccgagtatcctgatgttccacccagaagccgccagggccatcctggagtaccgcatccgcacgctggacggggccctggagaacgcccagaacctgggctaccagggagccaagtttgcctgggagagtgcagactccggcctagaggtttgccctgaggacatttacggagtccaggaggtccacgtcaacggggccgtggtgttggccttcgagctgtactaccataccacccaggacctgcagctatttcgagaggctggtggctgggacgtggtcagggctgtggccgagttttggtgcagtcgtgttgagtggagccccagggaggaaaaacacctcacgtgtgccagccccacgctgaccaccggcgtggagggaaggcctctgagactctgcactgagcaccatcttggacttgtgtgtccaggagtcatgtcccccgacgagtaccattcaggggtcaacaactctgtgtacaccaacgtcctggtccagaacagcctgcgctttgctgctgccctggcccaggacctgggtcttcccatccccagccagtggctggcggtggctgacaagatcaaggtaccctttgacgtggagcagaacttccacccggagttcgatgggtatgagcctggagaggtggtgaagcaggcagacgtcgtgctcctgggatacccagtccccttctccctgagtcctgatgttcgcaggaaaaatctggagatttacgaggctgtgacgtccccccagggccccgccatgacctggagcatgtttgctgtgggctggatggagctgaaggacgcagtgcgggcccggggcctcctggacaggagctttgccaacatggctgaacccttcaaggtgtggacggagaatgcagacgggtcaggcgctgtgaacttcctgacaggcatggggggcttcctgcaggcggtggtcttcgggtgcacggggttcagggtcacccgagcgggtgtgacctttgaccctgtgtgtctgtcggggatctccagagtgagcgtctccggcatcttctaccaggggaacaagctcaacttctctttttccgaggactccgtgaccgtggaggtcacagctcgagcagggccctgggctcctcacctggaggctgagctgtggccatcccagtcccggctctccctgttgccaggacacaaggtctcctttccccgctcggctggccggatacaaatgtcacccccgaagctgcctggaagttccagctccgagttccctgggaggactttttcagatgttagggacccgctccagagccccctctgggtcaccctgggttcctccagccccaccgagtcactcactgtggaccctgcctctgaataatcaggaacggtggcttcagagacgtctcttgggccttccctctggccacgtctgcacccacccctcctgggcaccctcctagcctgccatccctcacctgcagccaggctctcagggaaggtccatgctgcttggcctgagttcaaggctttctgcctgtagcctggactcccgtggacccccgtgggcaggtggcttccccgtggcatctccacaccgcctctgcctgcccctgtggactgatgctatcgcgcaccgtcccacgaccccaccccgagctcctgaagccggggtctgagcctgcatcacctctggcctctcatcccccactctcctgagagcagtggtcacagcggccggccgctctgctgagaaggcagagaggcaggctcaggcctcagcgtggacagcagggataaggggcacgaaggacggggactcggccccttcagaattcctcaggactctcaggtgcagctttgccaaaaaggaacttttcatgtcatgca

SEQ ID NO: 109405 - DNA, 3687 bp, Homo sapiens
  Payload ID: 1484
  Gene Symbol: ATHL1
  Gene Name: ATH1, acid trehalase-like 1 (yeast)
  Uniprot ID: Q32M88
  ENST ID: ENST00000409548
  CDS Start-End: 116-2329
ggtggcgcggcagccgggcggctcctccttcctcccggccctggcgtggagcagagggacacaggttcccacgctggcgcccggcgaccgggtggggctgcggcccagcagctccatggaggacgccggcgaggaccccaccacgtttgctgcccactctctgcccagtgacccccgtctcttggccactgtgaccaacgcatacctgggcacacgagtgtttcacgacacgctgcacgtgagcggcgtgtacaatggggctggcggggacacgcaccgggccatgctgcccagccccctcaacgtccggctggaggcccctgcagggatgggggagcagctgaccgagaccttcgccctggacaccaacacaggctcctttcttcacaccctggagggcccccgcttccgggcctcccagtgcatctatgcgcatcgcacgctgccccacgtgctggctttccgagtgtccatcgcccgcctggccccggggagcgggcccatcacgctgctcctgcggtcagccttctccccagaaagcccagacctggacctgcatcagggtcctgacttccagggagcccggtacctgtatggccacaccctcacccctgagcagcccggggggccacagcaagaggtacacatgctgtggacaccagcacccccagacctgacccttggggaaggtgaggaggctaggacgtgggacttcctgacagcagtgggcggcagccaggctgaggctcaggcctgcctcactgaggccctgcagctgcaggccaggggagctctgtatacggctcacgcacaggcctgggcccagctctgggtagaatgtggcttggacgtggtggggcccctgcagctgcgccaggccctgcgtggctccctctactacctgctcagtgccctgccccagcccaaggccccaggatacatctgccatggcctcagtcctgggggcctctccaatgggagccgtgaggaatgctactggggccacgtcttctgggaccaggacctctggatgttcccgagtatcctgatgttccacccagaagccgccagggccatcctggagtaccgcatccgcacgctggacggggccctggagaacgcccagaacctgggctaccagggagccaagtttgcctgggagagtgcagactccggcctagaggtttgccctgaggacatttacggagtccaggaggtccacgtcaacggggccgtggtgttggccttcgagctgtactaccataccacccaggacctgcagctatttcgagaggctggtggctgggacgtggtcagggctgtggccgagttttggtgcagtcgtgttgagtggagccccagggaggaaaagtaccacctgaggggagtcatgtcccccgacgagtaccattcaggggtcaacaactctgtgtacaccaacgtcctggtccagaacagcctgcgctttgctgctgccctggcccaggacctgggtcttcccatccccagccagtggctggcggtggctgacaagatcaaggtaccctttgacgtggagcagaacttccacccggagttcgatgggtatgagcctggagaggtggtgaagcaggcagacgtcgtgctcctgggatacccagtccccttctccctgagtcctgatgttcgcaggaaaaatctggagatttacgaggctgtgacgtccccccagggccccgccatgacctggagcatgtttgctgtgggctggatggagctgaaggacgcagtgcgggcccggggcctcctggacaggagctttgccaacatggctgaacccttcaaggtgtggacggagaatgcagacgggtcaggcgctgtgaacttcctgacaggcatggggggcttcctgcaggcggtggtcttcgggtgcacggggttcagggtcacccgagcgggtgtgacctttgaccctgtgtgtctgtcggggatctccagagtgagcgtctccggcatcttctaccaggggaacaagctcaacttctctttttccgaggactccgtgaccgtggaggtcacagctcgagcagggccctgggctcctcacctggaggctgagctgtggccatcccagtcccggctctccctgttgccaggacacaaggtctcctttccccgctcggctggccggatacaaatgtcacccccgaagctgcctggaagttccagctccgagttccctgggaggactttttcagatgttagggacccgctccagagccccctctgggtcaccctgggttcctccagccccaccgagtcactcactgtggaccctgcctctgaataatcaggaacggtggcttcagagacgtctcttgggccttccctctggccacgtctgcacccacccctcctgggcaccctcctagcctgccatccctcacctgcagccaggctctcagggaaggtccatgctgcttggcctgagttcaaggctttctgcctgtagcctggactcccgtggacccccgtgggcaggtggcttccccgtggcatctccacaccgcctctgcctgcccctgtggactgatgctatcgcgcaccgtcccacgaccccaccccgagctcctgaagccggggtctgagcctgcatcacctctggcctctcatcccccactctcctgagagcagtggtcacagcggccggccgctctgctgagaaggcagagaggcaggctcaggcctcagcgtggacagcagggataaggggcacgaaggacggggactcggccccttcagaattcctcaggactctcaggtgcagctttgccaaaaaggaacttttcatgtcatgcagttgaggggacttagtctcaatcccaggctcctcttgactctgggcagctttaatcaggttgggcagcctctgctacagcgtggggtgggatggctctcttccctcagccacgccgcttgtgaggacagaggtgggggagtgggaagtgggaagtcaccagagaacaggagagggatttgagggcgagaccccagcgctctccacggaccagccagagggactggagccaggtgtgcatgggttcaaggccctggccctgcccagcctttgtcttgggagctcagccccagggttcggtcgtcagcagtttcccaagaacaagatgtgatggcatctgctgctgaaaccctgatgaggaccaggccccctgcaccgctgtcagcctgaggaattaaagctttggtgctggggagagcattattcctctgaggagccgctgtgcttccttctgaagtgagggccgtgccccgggtcccatttctcctttcacttgagtcgggaagcacagcaactttaaggctcgcgcccagcaacatggctcccctcgcatctgcatctccctcctgctctggtgttgccgctgcaccctgtcctcggaggacagcagaggtttggacggagactcagggagggagggaaggaggcaaggacgcctgtggaaacatctttcaggcagctctagggtctgggggccaggatgcctgggtctcccaaggcctgtctgctgtctctgccaccctcagcggctgccagaagcagcgtgtgggggaggcatgtgctgcagcacacctgcggccgagaccagcactcagaggtcggctcccctgacaggaaccgtgtagggtgca

SEQ ID NO: 109406 - DNA, 734 bp, Homo sapiens
  Payload ID: 1484
  Gene Symbol: ATHL1
  Gene Name: ATH1, acid trehalase-like 1 (yeast)
  ENST ID: ENST00000482937
  CDS Start-End: 1-611
tgtttcacgacacgctgcacgtgagcggcgtgtacaatggggctggcggggacacgcaccgggccatgctgcccagccccctcaacgtccggctggaggcccctgcagggatgggggagcagctgaccgagaccttcgccctggacaccaacacaggctcctttcttcacaccctggagggcccccgcttccgggcctcccagtgcatctatgcgcatcgcacgctgccccacgtgctggctttccgagtgtccatcgcccgcctggccccggggagcgggcccatcacgctgctcctgcggtcagccttctccccagaaagcccagacctggacctgcatcagggtcctgacttccagggagcccggtacctgtatggccacaccctcacccctgagcagcccggggggccacagcaagaggtacacatgctgtggacaccagcacccccagacctgacccttggggaagtgccctgccccagcccaaggccccaggatacatctgccatggcctcagtcctgggggcctctccaatgggagccgtgaggaatgctactggggccacgtcttctgggaccaggacctctggatgttcccgagtatcctgatgttccacccagaagccgccagggccatcctggagtaccgcatccgcacgctggacggggccctggagaacgcccagaacctgggctaccagggagccaagtttgcctgggagagtgcagact

SEQ ID NO: 109407 - DNA, 4414 bp, Homo sapiens
  Payload ID: 1485
  Gene Symbol: AKNA
  Gene Name: AT-hook transcription factor
  Uniprot ID: Q7Z591
  ENST ID: ENST00000223791
  CDS Start-End: 826-3525
gagagaaacgaccagattcttctgccctcagcccaaggaacacatctggaagcagacaaagacgtcacctaagccactcccttcccgattcattggctccatcagccccctgaatccccagcccaggccaacgcggcagggcaggccgctgcccagacagggagccactctggctggccgctcctcttctaatgcccccaagtatggccgggggcagttgaactacccactccctgatttctccaaggtagggccccgggtgagattccccaaagatgagagctaccgtccccccaagtccagaagccacaacaggaagcctcaggcccctgccaggcccctcatcttcaagtctccagctgagattgtgcaggaggtgctgttgagcagtggagaagcagccctggcaaaggacacgcctcctgcccaccctatcaccagggtaccccaagaatttcagacgcctgagcaagccactgagctggtccatcagctccaggaagactaccacaggctcctcaccaagtacgctgaggccgagaacaccattgaccagctacgcctcggggccaaggtgaacctgttctctgacccaccccagcccaaccacagcatccacacgggaatggtgccccaggggaccaaggtcttgtccttcaccatcccacagccccgctctgcagagtggtggccgggcccggccgaggacccccaggcctctgcggcctcagcctgggggcagccctggccctgccacttggcatcttggtgaccctggggtggccatcagctcgaggagacttgagcccctcctcgcttaccagcatgcccaccctggggtggcttccggagaaccgggacatctctgaggaccagtcctcagcagagcagacccaggcactggcttctcaggccagccagttcctggccaaggtggagtcctttgaaagactgatacaggcaggacgtctcatgccccaggaccaagtcaagggcttccagcggctgaaggctgcccacgcggccctagaggaggagtacctgaaggcttgtcgggagcaacaccctgcccagccgcttgccggctccaaggggacgcctggaagatttgatcctcgcagggagctggaggcagagatataccgtctgggaagctgcctggaagagctgaaggaacacatagaccagacccagcaagagcctgagccgcccgggtcagactcagctctggacagcaccccagccctgccctgcctccatcagccaacgcacctgcctgctccttctggacaagcccccatgccagccatcaagacctcctgccctgagcctgctaccaccactgccgccgccagcactggcccctgcccattgcacgtaaatgtggaggtgagctctggcaacagtgaggtggaggacaggccacaggaccccctggcccgactcaggcacaaggagctgcagatggagcaagtttaccatggcctcatggagcggtacctcagtgtgaagtctctcccagaagccatgagaatggaggaggaggaagaaggagaggaggaggaggaggaagaggggggaggtgactccctggaagttgatggggtggctgcaactccagggaaagcagaggccaccagggtcctcccaaggcagtgcccggtgcaggctgagaaaagtcatggggctcccctggaggaggccacggagaagatggtatctatgaagccaccaggtttccaggcatccctggctagagacgggcacatgtcaggcctgggcaaggctgaggcagcccctccaggccctggcgtgccaccccaccctccaggcaccaagtccgcagcatcccaccaaagtagtatgaccagcctggagggaagcggcatctctgagcgccttccacagaagcctttgcaccgaggcggtgggccccacctggaggagacctggatggcgtccccagagacagacagtggctttgtgggctcagaaacaagcagagtttcacccctcacccagactccagagcaccggctctcccacatcagcacagcaggaacattagcccagccctttgctgcatctgtgcccagggatggagcttcctaccccaaggccaggggttctctgattcccagaagagccacagagcccagcacaccccggagccaagcacagaggtacctctccagcccaagtgggcctctccggcagagggcacccaacttcagcctggagcggacactggcagccgagatggcggttcctggctcagagtttgaggggcacaaacggatttctgaacagccccttcccaacaagacaatcagcccacccccagcccccgcccctgccgctgcgcctctaccctgtggaccaacagagaccatccccagcttcctgctcaccagggcagggcgagaccaggccatctgtgagctgcaagaagaggtgtcccggcttcgtctgcggctggaagacagcctgcaccagccactccagggcagcccgacacgcccagcatctgcctttgaccgccccgcccggacccgcggccggccagcagactccccagccacctggggctcccattatggcagtaaatccacagagagattgcctggtgagcctagaggtgaagagcagattgtccctccaggaaggcagcgagccaggtcttcctcagtgcctcgggaggtgctccgactgtccctgagttcagaatctgagctgccctccctaccactgttctctgagaagagcaagaccaccaaggacagtccacaggcagctcgggatggaaagagaggggtgggcagtgctggatggccagacagggtcaccttccggggccaatacacaggccacgaataccatgttctgtcccctaaggcggtcccaaaaggcaatggcacagtctcctgtccccactgccggcccattaggacccaggatgcgggtggtgctgtcacaggggacccactgggaccgcctcccgctgatacccttcagtgtcccctgtgtggtcaagttgggtctcccccagaggcagatggtccaggctcagccacctctggggcagagaaggccaccacgaggagaaaagcatcttcaactcccagccccaagcagaggagcaagcaggcggggtcgtcgccacgcccaccccccggactgtggtatctggcaacagcgcccccagcaccagcccctccagcctttgcctacatctcctcggttcccatcatgccttatccacctgccgctgtgtactatgcgcctgcaggacctacctcagcccaaccagctgccaagtggccgcccacagcctctcccccaccagcccggagacaccggcactccatccagctcgacctgggcgacctagaggagctcaacaaggccctgagccgggccgtgcaggctgccgagagcgtccgctctaccaccaggcagatgagaagctcgctgtcagccgacctgcgccaggctcacagcctgcggggctcctgcctcttctgacttcactgggggcccagaggcagatgggtgggtgggtgggcaggtggcctgccaggccaggagtgggctggagctgctgaggcccagaaggcccgcatagttcctcaccaggagggtctccctccagcacaggtcccgcctgctcagtccctgtgctttccaagtggagggggtgtcagctcggtcaccaagagaagtgacttcccaggagcaccagtcccctcacagaggtgctgtgagcgaggcctccttcggtccaggcagaacctcaggcagtctctcctggtcctgcatgtgtgcaactccagctaataataggtattttatatacagatggacagatatttttttaaactggggagttttcctgatcttgggtcctctttagggggccagacaagaaaggcctacggtttctggagcaaacctgtcccccacctgtgaccagtcactctggggcaagcatcactgggaagggcatagccggagacctttctcctagtgactggtagtcagtggggcattttaggatgtcagggccccagggtgacatgtgtccagcttttctatggcagcagaggcctttccctcagacaagctacaaagtgcccaggatgccatccaccatggtccccttcagtacctcacgcatggtccccagcttctcctaggatcccagtggcgtttatcagtggccagctacctgccaggcccgggctggggcacggtctgcggccatgaggccaggccgcctcccgcacccctaccccgtggcagcagcatacctctgcatttctggaatgtgtgtgcatcaatgatgtttgtatatttgaggcatttaaaaatctattttcgttacgagggcaaatgaagaatgaatattgatctt

SEQ ID NO: 109408 - DNA, 7380 bp, Homo sapiens
  Payload ID: 1485
  Gene Symbol: AKNA
  Gene Name: AT-hook transcription factor
  Uniprot ID: Q7Z591
  ENST ID: ENST00000307564
  CDS Start-End: 163-4482
gcaactgaagacggaggtgcccaaggtcagaaggaagcaccacacagagggcacaggcaggatggccgatgctgacaggaaccagcggtgactctggggcccctggcagcagctctgtctcctgaagatgaagtggcccaggtgaagcccaggccagccccaatggccagctcggagactgagatccgctgggctgagcctggcctggggaagggcccccagcggcggcgctgggcctgggccgaggacaagagggatgtggatagaagtagttcacaaagctgggaagaagagagactctttcccaatgccaccagccccgagctcctagaggacttccgcctggcccagcagcacctgccgcccctggagtgggacccacacccgcagcccgatgggcatcaggattccgagtcaggagagacttcgggagaagaggctgaagcagaggatgtggacagcccagcaagttcccatgagcctcttgcctggctcccccagcagggccgtcagctggacatgactgaagaggagccagatgggaccctcggaagtctggaggttgaggaggctggagagagctcctcaaggttggggtatgaggctggtctcagcttggaaggccatggaaacaccagccccatggctcttgggcatggtcaggccaggggctgggtggcttctggcgaacaagccagtggggacaaactttctgaacattccgaggtcaacccatccgttgaactcagcccggcaaggtcctggagcagtgggacagtgagcctcgaccaccctagtgacagccttgattctacctgggaaggagagaccgatggcccccagcccactgccctggcagaaaccttgccagagggccccagccaccacctcctaagcccagatggcagaactggaggcagtgttgctcgggcaacccccatggaattccaggactcctcagctcccccagcccagagtccgcagcatgccacagatagatggaggagagaaacgaccagattcttctgccctcagcccaaggaacacatctggaagcagacaaagacgtcacctaagccactcccttcccgattcattggctccatcagccccctgaatccccagcccaggccaacgcggcagggcaggccgctgcccagacagggagccactctggctggccgctcctcttctaatgcccccaagtatggccgggggcagttgaactacccactccctgatttctccaaggtagggccccgggtgagattccccaaagatgagagctaccgtccccccaagtccagaagccacaacaggaagcctcaggcccctgccaggcccctcatcttcaagtctccagctgagattgtgcaggaggtgctgttgagcagtggagaagcagccctggcaaaggacacgcctcctgcccaccctatcaccagggtaccccaagaatttcagacgcctgagcaagccactgagctggtccatcagctccaggaagactaccacaggctcctcaccaagtacgctgaggccgagaacaccattgaccagctacgcctcggggccaaggtgaacctgttctctgacccaccccagcccaaccacagcatccacacgggaatggtgccccaggggaccaaggtcttgtccttcaccatcccacagccccgctctgcagagtggtggccgggcccggccgaggacccccaggcctctgcggcctcagggtggccatcagctcgaggagacttgagcccctcctcgcttaccagcatgcccaccctggggtggcttccggagaaccgggacatctctgaggaccagtcctcagcagagcagacccaggcactggcttctcaggccagccagttcctggccaaggtggagtcctttgaaagactgatacaggcaggacgtctcatgccccaggaccaagtcaagggcttccagcggctgaaggctgcccacgcggccctagaggaggagtacctgaaggcttgtcgggagcaacaccctgcccagccgcttgccggctccaaggggacgcctggaagatttgatcctcgcagggagctggaggcagagatataccgtctgggaagctgcctggaagagctgaaggaacacatagaccagacccagcaagagcctgagccgcccgggtcagactcagctctggacagcaccccagccctgccctgcctccatcagccaacgcacctgcctgctccttctggacaagcccccatgccagccatcaagacctcctgccctgagcctgctaccaccactgccgccgccagcactggcccctgcccattgcacgtaaatgtggaggtgagctctggcaacagtgaggtggaggacaggccacaggaccccctggcccgactcaggcacaaggagctgcagatggagcaagtttaccatggcctcatggagcggtacctcagtgtgaagtctctcccagaagccatgagaatggaggaggaggaagaaggagaggaggaggaggaggaagaggggggaggtgactccctggaagttgatggggtggctgcaactccagggaaagcagaggccaccagggtcctcccaaggcagtgcccggtgcaggctgagaaaagtcatggggctcccctggaggaggccacggagaagatggtatctatgaagccaccaggtttccaggcatccctggctagagacgggcacatgtcaggcctgggcaaggctgaggcagcccctccaggccctggcgtgccaccccaccctccaggcaccaagtccgcagcatcccaccaaagtagtatgaccagcctggagggaagcggcatctctgagcgccttccacagaagcctttgcaccgaggcggtgggccccacctggaggagacctggatggcgtccccagagacagacagtggctttgtgggctcagaaacaagcagagtttcacccctcacccagactccagagcaccggctctcccacatcagcacagcaggaacattagcccagccctttgctgcatctgtgcccagggatggagcttcctaccccaaggccaggggttctctgattcccagaagagccacagagcccagcacaccccggagccaagcacagaggtacctctccagcccaagtgggcctctccggcagagggcacccaacttcagcctggagcggacactggcagccgagatggcggttcctggctcagagtttgaggggcacaaacggatttctgaacagccccttcccaacaagacaatcagcccacccccagcccccgcccctgccgctgcgcctctaccctgtggaccaacagagaccatccccagcttcctgctcaccagggcagggcgagaccaggccatctgtgagctgcaagaagaggtgtcccggcttcgtctgcggctggaagacagcctgcaccagccactccagggcagcccgacacgcccagcatctgcctttgaccgccccgcccggacccgcggccggccagcagactccccagccacctggggctcccattatggcagtaaatccacagagagattgcctggtgagcctagaggtgaagagcagattgtccctccaggaaggcagcgagccaggtcttcctcagtgcctcgggaggtgctccgactgtccctgagttcagaatctgagctgccctccctaccactgttctctgagaagagcaagaccaccaaggacagtccacaggcagctcgggatggaaagagaggggtgggcagtgctggatggccagacagggtcaccttccggggccaatacacaggccacgaataccatgttctgtcccctaaggcggtcccaaaaggcaatggcacagtctcctgtccccactgccggcccattaggacccaggatgcgggtggtgctgtcacaggggacccactgggaccgcctcccgctgatacccttcagtgtcccctgtgtggtcaagttgggtctcccccagaggcagatggtccaggctcagccacctctggggcagagaaggccaccacgaggagaaaagcatcttcaactcccagccccaagcagaggagcaagcaggcggggtcgtcgccacgcccaccccccggactgtggtatctggcaacagcgcccccagcaccagcccctccagcctttgcctacatctcctcggttcccatcatgccttatccacctgccgctgtgtactatgcgcctgcaggacctacctcagcccaaccagctgccaagtggccgcccacagcctctcccccaccagcccggagacaccggcactccatccagctcgacctgggcgacctagaggagctcaacaaggccctgagccgggccgtgcaggctgccgagagcgtccgctctaccaccaggcagatgagaagctcgctgtcagccgacctgcgccaggctcacagcctgcggggctcctgcctcttctgacttcactgggggcccagaggcagatgggtgggtgggtgggcaggtggcctgccaggccaggagtgggctggagctgctgaggcccagaaggcccgcatagttcctcaccaggagggtctccctccagcacaggtcccgcctgctcagtccctgtgctttccaagtggagggggtgtcagctcggtcaccaagagaagtgacttcccaggagcaccagtcccctcacagaggtgctgtgagcgaggcctccttcggtccaggcagaacctcaggcagtctctcctggtcctgcatgtgtgcaactccagctaataataggtattttatatacagatggacagatatttttttaaactggggagttttcctgatcttgggtcctctttagggggccagacaagaaaggcctacggtttctggagcaaacctgtcccccacctgtgaccagtcactctggggcaagcatcactgggaagggcatagccggagacctttctcctagtgactggtagtcagtggggcattttaggatgtcagggccccagggtgacatgtgtccagcttttctatggcagcagaggcctttccctcagacaagctacaaagtgcccaggatgccatccaccatggtccccttcagtacctcacgcatggtccccagcttctcctaggatcccagtggcgtttatcagtggccagctacctgccaggcccgggctggggcacggtctgcggccatgaggccaggccgcctcccgcacccctaccccgtggcagcagcatacctctgcatttctggaatgtgtgtgcatcaatgatgtttgtatatttgaggcatttaaaaatctattttcgttacgagggcaaatgaagaatgaatattgatcttaaaaaaagaaaagaagacaaaaaaaatacccaaagccatccgtgtctctgctgtatgtcattaacttttgccttcaatgtcaagtttatggggtggtaggtttgatgcccagccaagccctttcccaggggacctgttgggtgctctgcctgcctccctctggtggcttctgtttctccagttttccccctttgcctatctcagaaccataaatctttcaactgcggagggccttgaggtggggctgcctagccaagtcccttttgactgaggccagagatgtaaatgaggcacacagcaagttgctgtctacaagagtatgcacctggactctccagtgctcctttctttcttttttttttcttttttctttttctttttttttttttttttgagactgagttttgctctggttgcccaggctggggtacagtggtggaatctcggctcactgcaacctccgcctcccgggttcaagtgattctcttgcctcagcctcccgagtagctgggattacaggcatgcaccaccacgtctggctaattttgtatttttagtagagacagggtttctccatgttggtcgggctgatcttgcactcccagcctcaggtgatccacccacctcagcctcccaaattgctgggattacaggcgtgagccatggcgcccagccttccagtactttcagtagcaaacagcacctgccatttagggagcacctgctagaccctgattccggtgctaagcactgggcattgtctgcttcacacagtccatgtgctaaccctcaggaccctcactctgccccccttttactgatgaggagagtggggttccaatgggccatctgcccaaactggtttgggagagaacctggatttaaactcacattggtctgacccaaagtccacattctttgttatgtgtgttttttgcttcctctacctccatgattctttttctcttgacctctggtttcttcctcacgtggctttttcttccatgttccccacttctcgtctcccttgcttctccctgctctgcccatcatgactcatttctgtttcatttttcagcggatcctcctgagtatggttgaaaatggtgtctcactgaaagtaacactgaaatggacaaacttcctgtaggttctgagccttcagttccaggacattgtgggaccccagaggctgtcctgtccacttgccttctgaggacatcagctcggtgtccccagcctccgtgctgtgggcacagctgtggtttgggtgctgagcaaaggatgctgtagtcttggccctgtggagcttggctgttgggacaggaggtacaaaggggagtggtgcctgtggacacaggactagaccccaggacatcagggcctcgggctcatggtcctatcaccctggatggtatacgcagctgcacacgtggaattgctcaaacaattcaggcccaacttttctgccacggaaggggtgctgcttccctcacgtaacaagaggctgtcaatcacgagcacccaggttggggtgaggccggccctttgtggcttgtgccactgagtgggctgtgcctcgggcttggctccacctcagggctccacatttgcaggatgtcagctgatttccagggaccagcctcacccttacgtgttatctccttcttctgggtctcccaggtgagcaccctaagaacacatccatggagacacccagcccctctggcctgggccccaagccctctgcatcaccccagcccttccctgccctgccctgtcctggcccaggcaaccgcctcttgcctagttgcccacagcagccttcactcaggccttcctgcctccagcctggtccccacaacgtgcctcccccgatggccatggtaatactggaataaggtccttgtgataggcaccacatgcctgaactctccccaccccatccaccttgtatttgtctgttctcacattgctataaagaactacctgagactgggtagtttatg

SEQ ID NO: 109409 - DNA, 3334 bp, Homo sapiens
  Payload ID: 1485
  Gene Symbol: AKNA
  Gene Name: AT-hook transcription factor
  Uniprot ID: Q7Z591
  ENST ID: ENST00000312033
  CDS Start-End: 336-2831
ggctgggcgcttcctgccgaggcgaggcggcctcaaccacggcaggggcggggagaggtggggagcgatgctggtctgtgagcagcagcttgggctggcagaacggcctggaggtgggccagggcgcaatggagacagggggctccctgggtttggaacaaagaattcacaggcaggtcccctgaaactgggtcggcaggacggtggtggagcccgagagagggcacaggcaggatggccgatgctgacaggaaccagcggtgactctggggcccctggcagcagctctgtctcctgaagatgaagtggcccaggtgaagcccaggccagccccaatggccagctcggagactgagatccgctgggctgagcctggcctggggaagggcccccagcggcggcgctgggcctgggccgaggacaagagggatgtggatagaagtagttcacaaagctgggaagaagagagactctttcccaatgccaccagccccgagctcctagaggacttccgcctggcccagcagcacctgccgcccctggagtgggacccacacccgcagcccgatgggcatcaggattccgagtcaggagagacttcgggagaagaggctgaagcagaggatgtggacagcccagcaagttcccatgagcctcttgcctggctcccccagcagggccgtcagctggacatgactgaagaggagccagatgggaccctcggaagtctggaggttgaggaggctggagagagctcctcaaggttggggtatgaggctggtctcagcttggaaggccatggaaacaccagccccatggctcttgggcatggtcaggccaggggctgggtggcttctggcgaacaagccagtggggacaaactttctgaacattccgaggtcaacccatccgttgaactcagcccggcaaggtcctggagcagtgggacagtgagcctcgaccaccctagtgacagccttgattctacctgggaaggagagaccgatggcccccagcccactgccctggcagaaaccttgccagagggccccagccaccacctcctaagcccagatggcagaactggaggcagtgttgctcgggcaacccccatggaattccaggactcctcagctcccccagcccagagtccgcagcatgccacagatagatggaggagagaaacgaccagattcttctgccctcagcccaaggaacacatctggaagcagacaaagacgtcacctaagccactcccttcccgattcattggctccatcagccccctgaatccccagcccaggccaacgcggcagggcaggccgctgcccagacagggagccactctggctggccgctcctcttctaatgcccccaagtatggccgggggcagttgaactacccactccctgatttctccaaggtagggccccgggtgagattccccaaagatgagagctaccgtccccccaagtccagaagccacaacaggaagcctcaggcccctgccaggcccctcatcttcaagtctccagctgagattgtgcaggaggtgctgttgagcagtggagaagcagccctggcaaaggacacgcctcctgcccaccctatcaccagggtaccccaagaatttcagacgcctgagcaagccactgagctggtccatcagctccaggaagactaccacaggctcctcaccaagtacgctgaggccgagaacaccattgaccagctacgcctcggggccaaggtgaacctgttctctgacccaccccagcccaaccacagcatccacacgggaatggtgccccaggggaccaaggtcttgtccttcaccatcccacagccccgctctgcagagtggtggccgggcccggccgaggacccccaggcctctgcggcctcagggtggccatcagctcgaggagacttgagcccctcctcgcttaccagcatgcccaccctggggtggcttccggagaaccgggacatctctgaggaccagtcctcagcagagcagacccaggcactggcttctcaggccagccagttcctggccaaggtggagtcctttgaaagactgatacaggcaggacgtctcatgccccaggaccaagtcaagggcttccagcggctgaaggctgcccacgcggccctagaggaggagtacctgaaggcttgtcgggagcaacaccctgcccagccgcttgccggctccaaggggacgcctggaagatttgatcctcgcagggagctggaggcagagatataccgtctgggaagctgcctggaagagctgaaggaacacatagaccagacccagcaagagcctgagccgcccgggtcagactcagctctggacagcaccccagccctgccctgcctccatcagccaacgcacctgcctgctccttctggacaagcccccatgccagccatcaagacctcctgccctgagcctgctaccaccactgccgccgccagcactggcccctgcccattgcacgtaaatgtggaggtgagctctggcaacagtgaggtggaggacaggccacaggaccccctggcccgactcaggcacaaggagctgcagatggagcaagtttaccatggcctcatggagcggtacctcagtgtgaagtctctcccagaagccatgagaatggaggaggaggaagaaggagaggaggaggaggaggaagaggggggaggtgactccctggaagttgatggggtggctgcaactccagggaaagcagaggccaccagggtcctcccaaggcagtgcccggtgcaggctgagaaaagtcatggggctcccctggagtaagtcactgagcctttcctgcagaatgtttgtttccaccctaaaaccacagggatgatcactgtcagagtgaataagacagcgcttcacagtttagacatggcttacctgtcctgcctcttcaagtgtggaatgtataccactgatagcccttgaaatgattttgggtagtgtgggacatgattttcagtaggacacatgcagtattaaagaacattattctcagctgggcacagtggctcatgcctgtaatcccagcattgagggaggccaaggcaggtggatcacttgagtccaggagttcaagactagcctgagcaaaacggcaaagccccatctcaacaagaaatacaaaaattagccaggcatggtggtacacgcctatagccctagctatttgggaggctgaagcaggtgaatctcttgagcccaggaggcggaggttgcagtgagctgagatcgggccactgcactccagcctgggtgatagtgtgagaccctgtctc

SEQ ID NO: 109410 - DNA, 5038 bp, Homo sapiens
  Payload ID: 1485
  Gene Symbol: AKNA
  Gene Name: AT-hook transcription factor
  Uniprot ID: Q7Z591
  ENST ID: ENST00000374075
  CDS Start-End: 73-4149
gtgatgaggaaatggaagccagagagttgaagtgacttagggtaagttacaaggtgggtgcagagctggtatatgctaagaagtgaatggcctgtctttccagaggctgaagcagaggatgtggacagcccagcaagttcccatgagcctcttgcctggctcccccagcagggccgtcagctggacatgactgaagaggagccagatgggaccctcggaagtctggaggttgaggaggctggagagagctcctcaaggttggggtatgaggctggtctcagcttggaaggccatggaaacaccagccccatggctcttgggcatggtcaggccaggggctgggtggcttctggcgaacaagccagtggggacaaactttctgaacattccgaggtcaacccatccgttgaactcagcccggcaaggtcctggagcagtgggacagtgagcctcgaccaccctagtgacagccttgattctacctgggaaggagagaccgatggcccccagcccactgccctggcagaaaccttgccagagggccccagccaccacctcctaagcccagatggcagaactggaggcagtgttgctcgggcaacccccatggaattccaggactcctcagctcccccagcccagagtccgcagcatgccacagatagatggaggagagaaacgaccagattcttctgccctcagcccaaggaacacatctggaagcagacaaagacgtcacctaagccactcccttcccgattcattggctccatcagccccctgaatccccagcccaggccaacgcggcagggcaggccgctgcccagacagggagccactctggctggccgctcctcttctaatgcccccaagtatggccgggggcagttgaactacccactccctgatttctccaaggtagggccccgggtgagattccccaaagatgagagctaccgtccccccaagtccagaagccacaacaggaagcctcaggcccctgccaggcccctcatcttcaagtctccagctgagattgtgcaggaggtgctgttgagcagtggagaagcagccctggcaaaggacacgcctcctgcccaccctatcaccagggtaccccaagaatttcagacgcctgagcaagccactgagctggtccatcagctccaggaagactaccacaggctcctcaccaagtacgctgaggccgagaacaccattgaccagctacgcctcggggccaaggtgaacctgttctctgacccaccccagcccaaccacagcatccacacgggaatggtgccccaggggaccaaggtcttgtccttcaccatcccacagccccgctctgcagagtggtggccgggcccggccgaggacccccaggcctctgcggcctcagggtggccatcagctcgaggagacttgagcccctcctcgcttaccagcatgcccaccctggggtggcttccggagaaccgggacatctctgaggaccagtcctcagcagagcagacccaggcactggcttctcaggccagccagttcctggccaaggtggagtcctttgaaagactgatacaggcaggacgtctcatgccccaggaccaagtcaagggcttccagcggctgaaggctgcccacgcggccctagaggaggagtacctgaaggcttgtcgggagcaacaccctgcccagccgcttgccggctccaaggggacgcctggaagatttgatcctcgcagggagctggaggcagagatataccgtctgggaagctgcctggaagagctgaaggaacacatagaccagacccagcaagagcctgagccgcccgggtcagactcagctctggacagcaccccagccctgccctgcctccatcagccaacgcacctgcctgctccttctggacaagcccccatgccagccatcaagacctcctgccctgagcctgctaccaccactgccgccgccagcactggcccctgcccattgcacgtaaatgtggaggtgagctctggcaacagtgaggtggaggacaggccacaggaccccctggcccgactcaggcacaaggagctgcagatggagcaagtttaccatggcctcatggagcggtacctcagtgtgaagtctctcccagaagccatgagaatggaggaggaggaagaaggagaggaggaggaggaggaagaggggggaggtgactccctggaagttgatggggtggctgcaactccagggaaagcagaggccaccagggtcctcccaaggcagtgcccggtgcaggctgagaaaagtcatggggctcccctggaggaggccacggagaagatggtatctatgaagccaccaggtttccaggcatccctggctagagacgggcacatgtcaggcctgggcaaggctgaggcagcccctccaggccctggcgtgccaccccaccctccaggcaccaagtccgcagcatcccaccaaagtagtatgaccagcctggagggaagcggcatctctgagcgccttccacagaagcctttgcaccgaggcggtgggccccacctggaggagacctggatggcgtccccagagacagacagtggctttgtgggctcagaaacaagcagagtttcacccctcacccagactccagagcaccggctctcccacatcagcacagcaggaacattagcccagccctttgctgcatctgtgcccagggatggagcttcctaccccaaggccaggggttctctgattcccagaagagccacagagcccagcacaccccggagccaagcacagaggtacctctccagcccaagtgggcctctccggcagagggcacccaacttcagcctggagcggacactggcagccgagatggcggttcctggctcagagtttgaggggcacaaacggatttctgaacagccccttcccaacaagacaatcagcccacccccagcccccgcccctgccgctgcgcctctaccctgtggaccaacagagaccatccccagcttcctgctcaccagggcagggcgagaccaggccatctgtgagctgcaagaagaggtgtcccggcttcgtctgcggctggaagacagcctgcaccagccactccagggcagcccgacacgcccagcatctgcctttgaccgccccgcccggacccgcggccggccagcagactccccagccacctggggctcccattatggcagtaaatccacagagagattgcctggtgagcctagaggtgaagagcagattgtccctccaggaaggcagcgagccaggtcttcctcagtgcctcgggaggtgctccgactgtccctgagttcagaatctgagctgccctccctaccactgttctctgagaagagcaagaccaccaaggacagtccacaggcagctcgggatggaaagagaggggtgggcagtgctggatggccagacagggtcaccttccggggccaatacacaggccacgaataccatgttctgtcccctaaggcggtcccaaaaggcaatggcacagtctcctgtccccactgccggcccattaggacccaggatgcgggtggtgctgtcacaggggacccactgggaccgcctcccgctgatacccttcagtgtcccctgtgtggtcaagttgggtctcccccagaggcagatggtccaggctcagccacctctggggcagagaaggccaccacgaggagaaaagcatcttcaactcccagccccaagcagaggagcaagcaggcggggtcgtcgccacgcccaccccccggactgtggtatctggcaacagcgcccccagcaccagcccctccagcctttgcctacatctcctcggttcccatcatgccttatccacctgccgctgtgtactatgcgcctgcaggacctacctcagcccaaccagctgccaagtggccgcccacagcctctcccccaccagcccggagacaccggcactccatccagctcgacctgggcgacctagaggagctcaacaaggccctgagccgggccgtgcaggctgccgagagcgtccgctctaccaccaggcagatgagaagctcgctgtcagccgacctgcgccaggctcacagcctgcggggctcctgcctcttctgacttcactgggggcccagaggcagatgggtgggtgggtgggcaggtggcctgccaggccaggagtgggctggagctgctgaggcccagaaggcccgcatagttcctcaccaggagggtctccctccagcacaggtcccgcctgctcagtccctgtgctttccaagtggagggggtgtcagctcggtcaccaagagaagtgacttcccaggagcaccagtcccctcacagaggtgctgtgagcgaggcctccttcggtccaggcagaacctcaggcagtctctcctggtcctgcatgtgtgcaactccagctaataataggtattttatatacagatggacagatatttttttaaactggggagttttcctgatcttgggtcctctttagggggccagacaagaaaggcctacggtttctggagcaaacctgtcccccacctgtgaccagtcactctggggcaagcatcactgggaagggcatagccggagacctttctcctagtgactggtagtcagtggggcattttaggatgtcagggccccagggtgacatgtgtccagcttttctatggcagcagaggcctttccctcagacaagctacaaagtgcccaggatgccatccaccatggtccccttcagtacctcacgcatggtccccagcttctcctaggatcccagtggcgtttatcagtggccagctacctgccaggcccgggctggggcacggtctgcggccatgaggccaggccgcctcccgcacccctaccccgtggcagcagcatacctctgcatttctggaatgtgtgtgcatcaatgatgtttgtatatttgaggcatttaaaaatctattttcgttacgagggcaaatgaagaatgaatattgatctt

SEQ ID NO: 109411 - DNA, 2138 bp, Homo sapiens
  Payload ID: 1485
  Gene Symbol: AKNA
  Gene Name: AT-hook transcription factor
  Uniprot ID: Q7Z591
  ENST ID: ENST00000374079
  CDS Start-End: 58-1212
ctggggcacagccaggaagaggcctccactccttctgacacagtcatctgagcgctcatgtctgctggaggcggcaccaggggatactcacccaggagtccaggggccaccagccaggccatctgtgagctgcaagaagaggtgtcccggcttcgtctgcggctggaagacagcctgcaccagccactccagggcagcccgacacgcccagcatctgcctttgaccgccccgcccggacccgcggccggccagcagactccccagccacctggggctcccattatggcagtaaatccacagagagattgcctggtgagcctagaggtgaagagcagattgtccctccaggaaggcagcgagccaggtcttcctcagtgcctcgggaggtgctccgactgtccctgagttcagaatctgagctgccctccctaccactgttctctgagaagagcaagaccaccaaggacagtccacaggcagctcgggatggaaagagaggggtgggcagtgctggatggccagacagggtcaccttccggggccaatacacaggccacgaataccatgttctgtcccctaaggcggtcccaaaaggcaatggcacagtctcctgtccccactgccggcccattaggacccaggatgcgggtggtgctgtcacaggggacccactgggaccgcctcccgctgatacccttcagtgtcccctgtgtggtcaagttgggtctcccccagaggcagatggtccaggctcagccacctctggggcagagaaggccaccacgaggagaaaagcatcttcaactcccagccccaagcagaggagcaagcaggcggggtcgtcgccacgcccaccccccggactgtggtatctggcaacagcgcccccagcaccagcccctccagcctttgcctacatctcctcggttcccatcatgccttatccacctgccgctgtgtactatgcgcctgcaggacctacctcagcccaaccagctgccaagtggccgcccacagcctctcccccaccagcccggagacaccggcactccatccagctcgacctgggcgacctagaggagctcaacaaggccctgagccgggccgtgcaggctgccgagagcgtccgctctaccaccaggcagatgagaagctcgctgtcagccgacctgcgccaggctcacagcctgcggggctcctgcctcttctgacttcactgggggcccagaggcagatgggtgggtgggtgggcaggtggcctgccaggccaggagtgggctggagctgctgaggcccagaaggcccgcatagttcctcaccaggagggtctccctccagcacaggtcccgcctgctcagtccctgtgctttccaagtggagggggtgtcagctcggtcaccaagagaagtgacttcccaggagcaccagtcccctcacagaggtgctgtgagcgaggcctccttcggtccaggcagaacctcaggcagtctctcctggtcctgcatgtgtgcaactccagctaataataggtattttatatacagatggacagatatttttttaaactggggagttttcctgatcttgggtcctctttagggggccagacaagaaaggcctacggtttctggagcaaacctgtcccccacctgtgaccagtcactctggggcaagcatcactgggaagggcatagccggagacctttctcctagtgactggtagtcagtggggcattttaggatgtcagggccccagggtgacatgtgtccagcttttctatggcagcagaggcctttccctcagacaagctacaaagtgcccaggatgccatccaccatggtccccttcagtacctcacgcatggtccccagcttctcctaggatcccagtggcgtttatcagtggccagctacctgccaggcccgggctggggcacggtctgcggccatgaggccaggccgcctcccgcacccctaccccgtggcagcagcatacctctgcatttctggaatgtgtgtgcatcaatgatgtttgtatatttgaggcatttaaaaatctattttcgttacgagggcaaatgaagaatgaatattgatcttaaaaaaagaaaagaagacaaaaaaaatacccaaagcc

SEQ ID NO: 109412 - DNA, 5464 bp, Homo sapiens
  Payload ID: 1485
  Gene Symbol: AKNA
  Gene Name: AT-hook transcription factor
  Uniprot ID: Q7Z591
  ENST ID: ENST00000374088
  CDS Start-End: 218-4537
ccagggcgcaatggagacagggggctccctgggtttggaacaaagaattcacaggcaggtcccctgaaactgggtcggcaggacggtggtggagcccgagagagggcacaggcaggatggccgatgctgacaggaaccagcggtgactctggggcccctggcagcagctctgtctcctgaagatgaagtggcccaggtgaagcccaggccagccccaatggccagctcggagactgagatccgctgggctgagcctggcctggggaagggcccccagcggcggcgctgggcctgggccgaggacaagagggatgtggatagaagtagttcacaaagctgggaagaagagagactctttcccaatgccaccagccccgagctcctagaggacttccgcctggcccagcagcacctgccgcccctggagtgggacccacacccgcagcccgatgggcatcaggattccgagtcaggagagacttcgggagaagaggctgaagcagaggatgtggacagcccagcaagttcccatgagcctcttgcctggctcccccagcagggccgtcagctggacatgactgaagaggagccagatgggaccctcggaagtctggaggttgaggaggctggagagagctcctcaaggttggggtatgaggctggtctcagcttggaaggccatggaaacaccagccccatggctcttgggcatggtcaggccaggggctgggtggcttctggcgaacaagccagtggggacaaactttctgaacattccgaggtcaacccatccgttgaactcagcccggcaaggtcctggagcagtgggacagtgagcctcgaccaccctagtgacagccttgattctacctgggaaggagagaccgatggcccccagcccactgccctggcagaaaccttgccagagggccccagccaccacctcctaagcccagatggcagaactggaggcagtgttgctcgggcaacccccatggaattccaggactcctcagctcccccagcccagagtccgcagcatgccacagatagatggaggagagaaacgaccagattcttctgccctcagcccaaggaacacatctggaagcagacaaagacgtcacctaagccactcccttcccgattcattggctccatcagccccctgaatccccagcccaggccaacgcggcagggcaggccgctgcccagacagggagccactctggctggccgctcctcttctaatgcccccaagtatggccgggggcagttgaactacccactccctgatttctccaaggtagggccccgggtgagattccccaaagatgagagctaccgtccccccaagtccagaagccacaacaggaagcctcaggcccctgccaggcccctcatcttcaagtctccagctgagattgtgcaggaggtgctgttgagcagtggagaagcagccctggcaaaggacacgcctcctgcccaccctatcaccagggtaccccaagaatttcagacgcctgagcaagccactgagctggtccatcagctccaggaagactaccacaggctcctcaccaagtacgctgaggccgagaacaccattgaccagctacgcctcggggccaaggtgaacctgttctctgacccaccccagcccaaccacagcatccacacgggaatggtgccccaggggaccaaggtcttgtccttcaccatcccacagccccgctctgcagagtggtggccgggcccggccgaggacccccaggcctctgcggcctcagggtggccatcagctcgaggagacttgagcccctcctcgcttaccagcatgcccaccctggggtggcttccggagaaccgggacatctctgaggaccagtcctcagcagagcagacccaggcactggcttctcaggccagccagttcctggccaaggtggagtcctttgaaagactgatacaggcaggacgtctcatgccccaggaccaagtcaagggcttccagcggctgaaggctgcccacgcggccctagaggaggagtacctgaaggcttgtcgggagcaacaccctgcccagccgcttgccggctccaaggggacgcctggaagatttgatcctcgcagggagctggaggcagagatataccgtctgggaagctgcctggaagagctgaaggaacacatagaccagacccagcaagagcctgagccgcccgggtcagactcagctctggacagcaccccagccctgccctgcctccatcagccaacgcacctgcctgctccttctggacaagcccccatgccagccatcaagacctcctgccctgagcctgctaccaccactgccgccgccagcactggcccctgcccattgcacgtaaatgtggaggtgagctctggcaacagtgaggtggaggacaggccacaggaccccctggcccgactcaggcacaaggagctgcagatggagcaagtttaccatggcctcatggagcggtacctcagtgtgaagtctctcccagaagccatgagaatggaggaggaggaagaaggagaggaggaggaggaggaagaggggggaggtgactccctggaagttgatggggtggctgcaactccagggaaagcagaggccaccagggtcctcccaaggcagtgcccggtgcaggctgagaaaagtcatggggctcccctggaggaggccacggagaagatggtatctatgaagccaccaggtttccaggcatccctggctagagacgggcacatgtcaggcctgggcaaggctgaggcagcccctccaggccctggcgtgccaccccaccctccaggcaccaagtccgcagcatcccaccaaagtagtatgaccagcctggagggaagcggcatctctgagcgccttccacagaagcctttgcaccgaggcggtgggccccacctggaggagacctggatggcgtccccagagacagacagtggctttgtgggctcagaaacaagcagagtttcacccctcacccagactccagagcaccggctctcccacatcagcacagcaggaacattagcccagccctttgctgcatctgtgcccagggatggagcttcctaccccaaggccaggggttctctgattcccagaagagccacagagcccagcacaccccggagccaagcacagaggtacctctccagcccaagtgggcctctccggcagagggcacccaacttcagcctggagcggacactggcagccgagatggcggttcctggctcagagtttgaggggcacaaacggatttctgaacagccccttcccaacaagacaatcagcccacccccagcccccgcccctgccgctgcgcctctaccctgtggaccaacagagaccatccccagcttcctgctcaccagggcagggcgagaccaggccatctgtgagctgcaagaagaggtgtcccggcttcgtctgcggctggaagacagcctgcaccagccactccagggcagcccgacacgcccagcatctgcctttgaccgccccgcccggacccgcggccggccagcagactccccagccacctggggctcccattatggcagtaaatccacagagagattgcctggtgagcctagaggtgaagagcagattgtccctccaggaaggcagcgagccaggtcttcctcagtgcctcgggaggtgctccgactgtccctgagttcagaatctgagctgccctccctaccactgttctctgagaagagcaagaccaccaaggacagtccacaggcagctcgggatggaaagagaggggtgggcagtgctggatggccagacagggtcaccttccggggccaatacacaggccacgaataccatgttctgtcccctaaggcggtcccaaaaggcaatggcacagtctcctgtccccactgccggcccattaggacccaggatgcgggtggtgctgtcacaggggacccactgggaccgcctcccgctgatacccttcagtgtcccctgtgtggtcaagttgggtctcccccagaggcagatggtccaggctcagccacctctggggcagagaaggccaccacgaggagaaaagcatcttcaactcccagccccaagcagaggagcaagcaggcggggtcgtcgccacgcccaccccccggactgtggtatctggcaacagcgcccccagcaccagcccctccagcctttgcctacatctcctcggttcccatcatgccttatccacctgccgctgtgtactatgcgcctgcaggacctacctcagcccaaccagctgccaagtggccgcccacagcctctcccccaccagcccggagacaccggcactccatccagctcgacctgggcgacctagaggagctcaacaaggccctgagccgggccgtgcaggctgccgagagcgtccgctctaccaccaggcagatgagaagctcgctgtcagccgacctgcgccaggctcacagcctgcggggctcctgcctcttctgacttcactgggggcccagaggcagatgggtgggtgggtgggcaggtggcctgccaggccaggagtgggctggagctgctgaggcccagaaggcccgcatagttcctcaccaggagggtctccctccagcacaggtcccgcctgctcagtccctgtgctttccaagtggagggggtgtcagctcggtcaccaagagaagtgacttcccaggagcaccagtcccctcacagaggtgctgtgagcgaggcctccttcggtccaggcagaacctcaggcagtctctcctggtcctgcatgtgtgcaactccagctaataataggtattttatatacagatggacagatatttttttaaactggggagttttcctgatcttgggtcctctttagggggccagacaagaaaggcctacggtttctggagcaaacctgtcccccacctgtgaccagtcactctggggcaagcatcactgggaagggcatagccggagacctttctcctagtgactggtagtcagtggggcattttaggatgtcagggccccagggtgacatgtgtccagcttttctatggcagcagaggcctttccctcagacaagctacaaagtgcccaggatgccatccaccatggtccccttcagtacctcacgcatggtccccagcttctcctaggatcccagtggcgtttatcagtggccagctacctgccaggcccgggctggggcacggtctgcggccatgaggccaggccgcctcccgcacccctaccccgtggcagcagcatacctctgcatttctggaatgtgtgtgcatcaatgatgtttgtatatttgaggcatttaaaaatctattttcgttacgagggcaaatgaagaatgaatattgatcttaaaaaaagaaaagaagacaaaaaaaatacccaaagcca

SEQ ID NO: 109413 - DNA, 2647 bp, Homo sapiens
  Payload ID: 1486
  Gene Symbol: ATL1
  Gene Name: atlastin GTPase 1
  Uniprot ID: Q8WXF7
  ENST ID: ENST00000358385
  CDS Start-End: 242-1918
agggagggtgtgacgctggtatctgtgtgaactcgggcttgtgatgctgagcttggttcatctgctttctcctcccttttcctccccactccttcccaccagcgccacagcaacatcctcagagtctgagcgaactgcgcccagcgcgggcacggagcctcccaccgccagcaacctgcggccccggagaaggcagcgagcgcagtgacagcgcctcaccgccaccagctcctggaccaccatggccaagaaccgcagggacagaaacagttggggtggattttcggaaaagacatatgaatggagctcagaagaggaggagccagtgaaaaaggcaggaccagtccaagtcctcattgtcaaagatgaccattcctttgagttagatgaaactgcattaaatcggatccttctctcggaggctgtcagagacaaggaggttgttgctgtatctgttgctggagcatttagaaaaggaaaatcattcctgatggacttcatgttgagatacatgtacaaccaggaatcagttgattgggttggagactacaatgaaccattgactggtttttcatggagaggtggatctgagcgagagaccacaggaattcagatatggagtgaaatcttccttatcaataaacctgatggtaaaaaggttgcagtgttattgatggatactcagggaacctttgatagtcagtcaactttgagagattcagccacagtatttgcccttagcacaatgatcagctcaatacaggtatataacttatcccaaaatgtccaggaggatgatcttcagcacctccagcttttcactgagtatggcagactggcaatggaggaaacattcctgaagccatttcagagtctgatatttcttgttcgagactggagtttcccatacgaattttcatatggagccgatggtggtgccaaattcttggaaaaacgcctcaaggtctcagggaaccagcatgaagaactacagaacgtcagaaaacacatccattcctgtttcaccaacatttcctgttttctgctacctcatcctggcttaaaagtagctaccaatccaaactttgatggaaaattgaaagaaatagatgatgaattcatcaaaaacttgaaaatactgattccttggctacttagtcccgagagcctagatattaaagagatcaatgggaataaaatcacctgccggggtctggtggagtacttcaaggcttatataaagatctatcaaggtgaagaattaccacatcccaaatccatgttacaggccacagcagaagctaacaatttagcagccgtggcaactgccaaggacacatacaacaaaaaaatggaagagatttgtggtggtgacaaaccatttctggccccaaatgacttgcagaccaaacacctgcaacttaaggaagaatctgtgaagctattccgaggggtgaagaagatgggtggggaagaatttagccggcgttacctgcagcagttggagagtgaaatagatgaactttacatccaatatatcaagcacaatgatagcaaaaatatcttccatgcagctcgtaccccagccacactgtttgtagtcatctttatcacatatgtgattgctggtgtgactggattcattggtttggacatcatagctagcctatgcaatatgataatgggactgacccttatcaccctgtgcacttgggcatatatccggtactctggagaataccgagagctgggagctgtaatagaccaggtggctgcagctctgtgggaccagggaagtacaaatgaggctttgtacaagctttacagtgcagcagcaacccacagacatctgtatcatcaagctttccctacaccaaagtcggaatctactgaacaatcagaaaagaaaaaaatgtaatgcaaattttaagaaatacaggtgcatgaccaattgtcaattaaatattcagttttatgtctccatgcaaacattcaaagtgcttccatcagaacggagtaaaatactaaacacctctgaagactgcaaactggattagttcttttacttcagtgtttaataagcagatgtatgtatgcatggttatactattttgttaacatgtacaatttcctgatttttcttcaaaaatgctgttataaagtatttgtctatttatgataacagtacacgtgttctgcttgaatttactaaattctactactgggttataattaaatcatgtgatattccacgtttggatatgctcatttaatttctacagaaaaaattttaaattatttcacattagccatttgttaaaacacagcatcataactcagcaggctggatttaatctgtatcatcttatatatatcacaatcttatttttaagcacattttagagttccttagttgctttatcaaaaaccagatattgcttttacatggtttaatagaatataaacctcttgataaaaaatgcacaaaaaatcactttgtatatgtgagtttcactgcattgtatattttttcatttggtacacaaagaatgtattcttcataggtttattcttttaatatgtgaactattattaaagtttactctggttcctaagattaaaaacaaatgcttactgaatttgaaaa

SEQ ID NO: 109414 - DNA, 2853 bp, Homo sapiens
  Payload ID: 1486
  Gene Symbol: ATL1
  Gene Name: atlastin GTPase 1
  Uniprot ID: Q8WXF7
  ENST ID: ENST00000441560
  CDS Start-End: 482-2143
agtcccggcacaccctactgcaccttcctgttttgcaaaccgatcccggtggtaccagtttgaggctgcactgcacacctgcacaacctgccttctacttagttcttctgagacatttctgaaagtctgaattcctaggactgctcaatgacctttgtccctgttgggcacacgcagtgtctcatcgctggtattgcacctttaatgagaccaggagttccgcaaaagtaaaacaaaggggtcacagactggttctggttctaccacttcctcagtatgtgctctgggacaaaacagcatatttggcaacatctcggtgtccttatctgcagcttgaagaggcgccacagcaacatcctcagagtctgagcgaactgcgcccagcgcgggcacggagcctcccaccgccagcaacctgcggccccggagaaggcagcgagcgcagtgacagcgcctcaccgccaccagctcctggaccaccatggccaagaaccgcagggacagaaacagttggggtggattttcggaaaagacatatgaatggagctcagaagaggaggagccagtgaaaaaggcaggaccagtccaagtcctcattgtcaaagatgaccattcctttgagttagatgaaactgcattaaatcggatccttctctcggaggctgtcagagacaaggaggttgttgctgtatctgttgctggagcatttagaaaaggaaaatcattcctgatggacttcatgttgagatacatgtacaaccaggaatcagttgattgggttggagactacaatgaaccattgactggtttttcatggagaggtggatctgagcgagagaccacaggaattcagatatggagtgaaatcttccttatcaataaacctgatggtaaaaaggttgcagtgttattgatggatactcagggaacctttgatagtcagtcaactttgagagattcagccacagtatttgcccttagcacaatgatcagctcaatacaggtatataacttatcccaaaatgtccaggaggatgatcttcagcacctccagcttttcactgagtatggcagactggcaatggaggaaacattcctgaagccatttcagagtctgatatttcttgttcgagactggagtttcccatacgaattttcatatggagccgatggtggtgccaaattcttggaaaaacgcctcaaggtctcagggaaccagcatgaagaactacagaacgtcagaaaacacatccattcctgtttcaccaacatttcctgttttctgctacctcatcctggcttaaaagtagctaccaatccaaactttgatggaaaattgaaagaaatagatgatgaattcatcaaaaacttgaaaatactgattccttggctacttagtcccgagagcctagatattaaagagatcaatgggaataaaatcacctgccggggtctggtggagtacttcaaggcttatataaagatctatcaaggtgaagaattaccacatcccaaatccatgttacaggccacagcagaagctaacaatttagcagccgtggcaactgccaaggacacatacaacaaaaaaatggaagagatttgtggtggtgacaaaccatttctggccccaaatgacttgcagaccaaacacctgcaacttaaggaagaatctgtgaagctattccgaggggtgaagaagatgggtggggaagaatttagccggcgttacctgcagcagttggagagtgaaatagatgaactttacatccaatatatcaagcacaatgatagcaaaaatatcttccatgcagctcgtaccccagccacactgtttgtagtcatctttatcacatatgtgattgctggtgtgactggattcattggtttggacatcatagctagcctatgcaatatgataatgggactgacccttatcaccctgtgcacttgggcatatatccggtactctggagaataccgagagctgggagctgtaatagaccaggtggctgcagctctgtgggaccaggctttgtacaagctttacagtgcagcagcaacccacagacatctgtatcatcaagctttccctacaccaaagtcggaatctactgaacaatcagaaaagaaaaaaatgtaatgcaaattttaagaaatacaggtgcatgaccaattgtcaattaaatattcagttttatgtctccatgcaaacattcaaagtgcttccatcagaacggagtaaaatactaaacacctctgaagactgcaaactggattagttcttttacttcagtgtttaataagcagatgtatgtatgcatggttatactattttgttaacatgtacaatttcctgatttttcttcaaaaatgctgttataaagtatttgtctatttatgataacagtacacgtgttctgcttgaatttactaaattctactactgggttataattaaatcatgtgatattccacgtttggatatgctcatttaatttctacagaaaaaattttaaattatttcacattagccatttgttaaaacacagcatcataactcagcaggctggatttaatctgtatcatcttatatatatcacaatcttatttttaagcacattttagagttccttagttgctttatcaaaaaccagatattgcttttacatggtttaatagaatataaacctcttgataaaaaatgcacaaaaaatcactttgtatatgtgagtttcactgcattgtatattttttcatttggtacacaaagaatgtattcttcataggtttattcttttaatatgtgaactattattaaagtttactctggttcctaagattaaaaacaaa

SEQ ID NO: 109415 - DNA, 383 bp, Homo sapiens
  Payload ID: 1486
  Gene Symbol: ATL1
  Gene Name: atlastin GTPase 1
  ENST ID: ENST00000555266
  CDS Start-End: 1-159
gggaaccagcatgaagaactacagaacgtcagaaaacacatccattcctgtttcaccaacatttcctgttttctgctacctcatcctggcttaaaagtagctaccaatccaaactttgatggaaaattgaaaggcttatataaagatctatcaaggtgaagaattaccacatcccaaatccatgttacaggccacagcagaagctaacaatttagcagccgtggcaactgccaaggacacatacaacaaaaaaatggaagagatttgtggtggtgacaaaccatttctggccccaaatgacttgcagaccaaacacctgcaacttaaggaagaatctgtgaagctattccgaggggtgaagaagatgggtggggaagaattta

SEQ ID NO: 109416 - DNA, 527 bp, Homo sapiens
  Payload ID: 1486
  Gene Symbol: ATL1
  Gene Name: atlastin GTPase 1
  ENST ID: ENST00000553509
  CDS Start-End: 439-527
atctttgcaaatctagtgggaaattttacccagtggatattgagttacagatcgtaatgaatctacagctttcatttatcttgatcttcttgatataaattttgctattctaattttaagacaaactactcagtatacatatacaaaaatgcatgataccctctttactaacatgaccttgcttttaaaatggaaaaaaaaatgggtgcctcgtagataaatgcacattattttagctactttggctatataaatgttgccagcttgtttgtactaatgtataaccgtgcttgaaacagcgccacagcaacatcctcagagtctgagcgaactgcgcccagcgcgggcacggagcctcccaccgccagcaacctgcggccccggagaaggcagcgagcgcagtgacagcgcctcaccgccaccagctcctggaccaccatggccaagaaccgcagggacagaaacagttggggtggattttcggaaaagacatatgaatggagctcagaagaggaggagccagtgaa

SEQ ID NO: 109417 - DNA, 570 bp, Homo sapiens
  Payload ID: 1486
  Gene Symbol: ATL1
  Gene Name: atlastin GTPase 1
  ENST ID: ENST00000557735
  CDS Start-End: 430-570
agaaacagttggggtgagtagcaaatgagaacttctgcagcctgcacggggtcttctggccctccactttctgcttctgtggagacagggagggccaagggctgctaggtgcctgcgtccacggctgggagacgggccgtagccgagccgctccctgtttgggcggaggaaccatggccgagcggtacccgcgtcaccgaatcgcgctgtcggggtggattttcggaaaagacatatgaatggagctcagaagaggaggagccagtgaaaaaggcaggaccagtccaagtcctcattgtcaaagatgaccattcctttgagttagatgaaactgcattaaatcggatccttctctcggaggctgtcagagacaaggaggttgttgctgtatctgttgctggagcatttagaaaaggaaaatcattcctgatggacttcatgttgagatacatgtacaaccaggaatcagttgattgggttggagactacaatgaaccattgactggtttttcatggagaggtggatctgagcgagagaccacaggaattcagatatggagtgaaatcttc

SEQ ID NO: 109418 - DNA, 550 bp, Homo sapiens
  Payload ID: 1486
  Gene Symbol: ATL1
  Gene Name: atlastin GTPase 1
  ENST ID: ENST00000556067
  CDS Start-End: 1-318
cagcagttggagagtgaaatagatgaactttacatccaatatatcaagcacaatgatagcaaaaatatcttccatgcagctcgtaccccagccacactgtttgtagtcatctttatcacatatgtgattgctggtgtgactggattcattggtttggacatcatagctagcctatgcaatatgataatgggactgacccttatcaccctgtgcacttgggcatatatccggtactctggagaataccgagagctgggagctgtaatagaccaggtggctgcagctctgtgggaccagggaagtacaaatgagatctgaagatggtaccatacagacgtaatgccataagaaaatcaaggccaggcgcggtggctcacgcctgtaatcccagcactttgggagactgaggtgggcggatcacgttaggtcaggagttcgagaccagcctggctaacatggctttgtacaagctttacagtgcagcagcaacccacagacatctgtatcatcaagctttccctacaccaaagtcggaatctactgaacaatc

SEQ ID NO: 109419 - DNA, 545 bp, Homo sapiens
  Payload ID: 1486
  Gene Symbol: ATL1
  Gene Name: atlastin GTPase 1
  ENST ID: ENST00000554886
  CDS Start-End: 320-545
acagcaacatcctcagagtctgagcgaactgcgcccagcgcgggcacggagcctcccaccgccagcaacctgcggccccggagaaggcagcgagcgcagtgacagcgcctcaccgccaccagctcctggaccaccatggccaagaaccgcagggacagaaacagttggggaatcagttgattgggttggagactacaatgaaccattgactggtttttcatggagaggtggatctgagcgagagaccacaggaattcagatatggagtgaaatcttccttatcaataaacctgatggtaaaaaggttgcagtgttattgatggatactcagggaacctttgatagtcagtcaactttgagagattcagccacagtatttgcccttagcacaatgatcagctcaatacaggtatataacttatcccaaaatgtccaggaggatgatcttcagcacctccagcttttcactgagtatggcagactggcaatggaggaaacattcctgaagccatttcagagtctgatatttcttgttcgagactgga

SEQ ID NO: 109420 - DNA, 620 bp, Homo sapiens
  Payload ID: 1486
  Gene Symbol: ATL1
  Gene Name: atlastin GTPase 1
  ENST ID: ENST00000555960
  CDS Start-End: 322-620
agaagactacaagtatagatttgggaatcatcagcatggaggtcctgtctgaagccatcatagtaaattacattgagagagtgtagcgtgaggagttgcttaccatgaggaattagcagagatcatggatctggtaattaagaggctggcagtgatctcctaagaaccgatcagtacagagtcgccacagcaacatcctcagagtctgagcgaactgcgcccagcgcgggcacggagcctcccaccgccagcaacctgcggccccggagaaggcagcgagcgcagtgacagcgcctcaccgccaccagctcctggaccaccatggccaagaaccgcagggacagaaacagttggggtggattttcggaaaagacatatgaatggagctcagaagaggaggagccagtgaaaaaggcaggaccagtccaagtcctcattgtcaaagatgaccattcctttgagttagatgaaactgcattaaatcggatccttctctcggaggctgtcagagacaaggaggttgttgctgtatctgttgctggagcatttagaaaaggaaaatcattcctgatggacttcatgttgagatacatgtacaaccaggaatcagttgattgggt

SEQ ID NO: 109421 - DNA, 2868 bp, Homo sapiens
  Payload ID: 1487
  Gene Symbol: ATL2
  Gene Name: atlastin GTPase 2
  Uniprot ID: Q8NHH9
  ENST ID: ENST00000378954
  CDS Start-End: 3-1754
agatggcggagggggacgaggcagcgcgagggcagcaaccgcaccaggggctgtggcgccggcgacggaccagcgacccaagcgccgcggttaaccacgtctcgtccacgacctccctaggtgagaattatgaagatgatgacctagtaaattctgatgaggttatgaagaaaccatgtccagtacagattgttcttgctcatgaagatgaccataactttgaacttgatgaagaagctttggagcagatattgctacaggagcacatacgagatcttaacatagtagtggtatctgtggcaggagcttttcgtaaagggaagtcatttctactggacttcatgcttagatacatgtataacaaggattctcaaagttggattggtggaaacaatgaaccattgacaggctttacatggcgaggtggctgtgaaagagaaacaacaggcatacaagtttggaatgaagtatttgtgattgacagacctaatggaactaaagttgctgtgctgcttatggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctctttttttttcatgcttgctgtacaatgagaactcaaataaaaataaaccaaagtttacaatcaactgtagaagtagtttagtgtaactggcttcacagatggctgccacagagtgtgaagattgtttgttagttttaagcattcttttaatggctcctaagacatgcagatggactgaggagcattggttaatcatgcacctttgtgccatgtttaactcttttatttctttttacttaatctaatgttagtgaatttgtcttatgtaaaaggatatttcagggaaatattttcagaaatctatttagagtctctttaacacagtgtcccattgaaattttaatttttagagaatttatgaatcactgtttcaagaaccagattggaaagacaatgaagcctttattgagccactacattaaaagtatatattgctttactgccttcaataccagtattacatcaatgcatgtatcagaaacttcacagaaattacatggcaactcttgtagctaagaaagtaattctgaggtgtacatttgtcttgcctttttaaatttataaacttgccctaaaaggagatgcatatctgggaaactgaactgtctttttgcagtttagccttcatgtatataaaatatgccattaattttattggggaagaaattccatccaaaaatgttgcctacagctatgagttaagagtgtctgtacagtgtgtagcttttattttctaaaatcacagatagggcatgtatatgacttataaatatataaatacgattttgtattaaaagttttgtagtttatggcaaaatctggtcctgtggtaggctaaataagtactgtccctgtgaaaggaatgtttgtggctcatgtcagtgtgtgaatgcatagacaatttgaagtttttgatatatttgtgatatttatcttgagcactgcaatctcaccccccccccgcccaccaagggaattcaatgggaatgtttattgtgactttgtcctctgttgcattttaaagttatttcctgtaatttattttcagtacataattaaaaatttgttgtatatataaaatgaaa

SEQ ID NO: 109422 - DNA, 1905 bp, Homo sapiens
  Payload ID: 1487
  Gene Symbol: ATL2
  Gene Name: atlastin GTPase 2
  ENST ID: ENST00000405384
  CDS Start-End: 14-163
aaatcggtacaagatggcggagggggacgaggcagcgcgagggcagcaaccgcaccaggggctgtggcgccggcgacggaccagcgacccaagcgccgcggttaaccacgtctcgtccacgacctccctaggattctcaaagttggattggtggaaacaatgaaccattgacaggctttacatggcgaggtggctgtgaaagagaaacaacaggcatacaagtttggaatgaagtatttgtgattgacagacctaatggaactaaagttgctgtgctgcttatggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctctttttttttcatgcttgctgtacaatgagaactcaaataaaaataaaccaaagtttacaatcaactgtagaagtagtttagtgtaactggcttcacagatggctgccacagagtgtgaagattgtttgttagttttaagcattcttttaatggctcctaagacatgcagatggactgaggagcattggttaatcatgcacctttgtgccatgtttaactcttttatttctttttacttaatctaatgttagtgaatttgtcttatgtaaaaggatatttcagggaaatattttcagaaatctatttagagtctctttaacacagtgtcccattgaaattttaatttttagagaatt

SEQ ID NO: 109423 - DNA, 1883 bp, Homo sapiens
  Payload ID: 1487
  Gene Symbol: ATL2
  Gene Name: atlastin GTPase 2
  Uniprot ID: Q8NHH9
  ENST ID: ENST00000402054
  CDS Start-End: 260-1498
actgtggtgcgaattgatcgcatgaaatcctgattgaaaattttgatggtacttaagaaaggcataaagttttttcaaaggcttataaatagtaaaagcctacgatttggattctcaaagttggattggtggaaacaatgaaccattgacaggctttacatggcgaggtggctgtgaaagagaaacaacaggcatacaagtttggaatgaagtatttgtgattgacagacctaatggaactaaagttgctgtgctgcttatggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctctttttttttcatgcttgctgtacaatgagaactcaaataaaaataaaccaaagtttacaatcaactgtagaagtagtttagtgtaactggcttcacagatggctgccacagagtgtgaagattgtttgttagttttaagcattcttttaatggctcctaagacatgcagatggactgaggagcattggttaatcatgcacctttgtgccatgtttaactcttttatttctttttacttaatctaatgttagtgaatttgtcttatgtaaaaggatatttcagggaaatattttcagaaatctatttagagtctctttaacacagtgtcccattgaaattttaatttttagagaatt

SEQ ID NO: 109424 - DNA, 2864 bp, Homo sapiens
  Payload ID: 1487
  Gene Symbol: ATL2
  Gene Name: atlastin GTPase 2
  ENST ID: ENST00000406122
  CDS Start-End: 294-1535
ggagttaattttaaatcggtacaagatggcggagggggacgaggcagcgcgagggcagcaaccgcaccaggggctgtggcgccggcgacggaccagcgacccaagcgccgcggttaaccacgtctcgtccacgacctccctaggattctcaaagttggattggtggaaacaatgaaccattgacaggctttacatggcgaggtggctgtgaaagagaaacaacaggcatacaagtttggaatgaagtatttgtgattgacagacctaatggaactaaagttgctgtgctgcttatggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacagaggagtcccaggaaggtgttttccaaactgtttgaagttactagacgtcgaatggttcaccgtgctctttcatcagcacagcgacagagactgtcatccaacaataacaagaagaaaaattagacagtatttttaacctttttctctatctgaagtgttcacacttacacatgtaggacaataagcaggaccgtctgggccggtctgcataaatgctgtatacataccagatttgatgctgcatatagggtatggaattgcacatccatctcataggaattgtaaatggtttgaataagaggaaagtaatttttgttgcattataaaatgtctagtagcatcataagtttttttgagagaagcatctttttatttcccatattcctggttattttcatcattgctttgaattgaatttttatatctatttttatatgtaactctttttttacctcatgtttttgtttgttttgcacatttctcataccacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctctttttttttcatgcttgctgtacaatgagaactcaaataaaaataaaccaaagtttacaatcaactgtagaagtagtttagtgtaactggcttcacagatggctgccacagagtgtgaagattgtttgttagttttaagcattcttttaatggctcctaagacatgcagatggactgaggagcattggttaatcatgcacctttgtgccatgtttaactcttttatttctttttacttaatctaatgttagtgaatttgtcttatgtaaaaggatatttcagggaaatattttcagaaatctatttagagtctctttaacacagtgtcccattgaaattttaatttttagagaatttatgaatcactgtttcaagaaccagattggaaagacaatgaagcctttattgagccactacattaaaagtatatattgctttactgccttcaataccagtattacatcaatgcatgtatcagaaacttcacagaaattacatggcaactcttgtagctaagaaagtaattctgaggtgtacatttgtcttgcctttttaaatttataaacttgccctaaaaggagatgcatatctgggaaactgaactgtctttttgcagtttagccttcatgtatataaaatatgccattaattttattggggaagaaattccatccaaaaatgttgcctacagctatgagttaagagtgtctgtacagtgtgtagcttttattttctaaaatcacagatagggcatgtatatgacttataaatatataaatacgattttgtattaaaagttttgtagtttatg

SEQ ID NO: 109425 - DNA, 2199 bp, Homo sapiens
  Payload ID: 1487
  Gene Symbol: ATL2
  Gene Name: atlastin GTPase 2
  Uniprot ID: Q8NHH9
  ENST ID: ENST00000452935
  CDS Start-End: 416-2113
cttcctggagggaaccgcagtccgcaggccagggctctgtccccgggctcgcgtttcggggctcctcggctcccgaacccattcgcgcgggttgtgcgtggctagggtgcaagtctagattttcgtgtcaaactggggttatgagccgtttacgagtcacttggacgatagtaaggcctgatcactctgaaagtgtctgtagtgtgaagtcacctgatccttggctccctggttttgctgaatgtgagctcctactgtacgtgtaccaggagcgcccctgccccctcgaagacgcagttgcgttggcagcgcagtgtatccctctcactcataacacccctatttataggagtttagcgtttgatctctcactgtggtgcgaattgatcgcatgaaatcctgattgaaaattttgatggtacttaagaaaggcataaagttttttcaaaggcttataaatagtaaaagcctacgatttggtgagaattatgaagatgatgacctagtaaattctgatgaggttatgaagaaaccatgtccagtacagattgttcttgctcatgaagatgaccataactttgaacttgatgaagaagctttggagcagatattgctacaggagcacatacgagatcttaacatagtagtggtatctgtggcaggagcttttcgtaaagggaagtcatttctactggacttcatgcttagatacatgtataacaaggattctcaaagttggattggtggaaacaatgaaccattgacaggctttacatggcgaggtggctgtgaaagagaaacaacaggcatacaagtttggaatgaagtatttgtgattgacagacctaatggaactaaagttgctgtgctgcttatggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctctttttttttcatgcttgctgtacaatgagaactcaaataaaaataaaccaaagttta

SEQ ID NO: 109426 - DNA, 576 bp, Homo sapiens
  Payload ID: 1487
  Gene Symbol: ATL2
  Gene Name: atlastin GTPase 2
  ENST ID: ENST00000451483
  CDS Start-End: 20-576
aattttaaatcggtacaagatggcggagggggacgaggcagcgcgagggcagcaaccgcaccaggggctgtggcgccggcgacggaccagcgacccaagcgccgcggttaaccacgtctcgtccacgacctccctagagtcttgctctgtcgccaggttggagtgcagtggcacgatcttcgcttactgcaacctcccgggttcaagtgattcctctgcctcagcctcccaagtagctgggattacaggtgagaattatgaagatgatgacctagtaaattctgatgaggttatgaagaaaccatgtccagtacagattgttcttgctcatgaagatgaccataactttgaacttgatgaagaagctttggagcagatattgctacaggagcacatacgagatcttaacatagtagtggtatctgtggcaggagcttttcgtaaagggaagtcatttctactggacttcatgcttagatacatgtataacaaggattctcaaagttggattggtggaaacaatgaaccattgacaggctttacatggcgaggtggctgtgaaagagaaacaacagg

SEQ ID NO: 109427 - DNA, 593 bp, Homo sapiens
  Payload ID: 1487
  Gene Symbol: ATL2
  Gene Name: atlastin GTPase 2
  ENST ID: ENST00000416222
  CDS Start-End: 14-295
aaatcggtacaagatggcggagggggacgaggcagcgcgagggcagcaaccgcaccaggggctgtggcgccggcgacggaccagcgacccaagcgccgcggttaaccacgtctcgtccacgacctccctagacggagtctcgctctgtcgcccaggctggggtgcagtggcacggtctcggctcactgcaagctccgcctcttgggtccacgccattctccggcctcagcctcctgagtatctgggactacaggcgcctgccaccgtgtccggcttactttttttgtatttttaatagagacggggtttccctgtggtctcgatctcctgacctcgtgatccgcccgccttggcctcccaaagtgctgggattacaggtgagaattatgaagatgatgacctagtaaattctgatgaggttatgaagaaaccatgtccagtacagattgttcttgctcatgaagatgaccataactttgaacttgatgaagaagctttggagcagatattgctacaggagcacatacgagatcttaacatagtagtggtatctgtggcaggagcttttcgtaaagggaagtcatttctactgg

SEQ ID NO: 109428 - DNA, 526 bp, Homo sapiens
  Payload ID: 1487
  Gene Symbol: ATL2
  Gene Name: atlastin GTPase 2
  ENST ID: ENST00000449130
  CDS Start-End: 2-526
gatggcggagggggacgaggcagcgcgagggcagcaaccgcaccaggggctgtggcgccggcgacggaccagcgacccaagcgccgcggttaaccacgtctcgtccacgacctccctagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaag

SEQ ID NO: 109429 - DNA, 775 bp, Homo sapiens
  Payload ID: 1487
  Gene Symbol: ATL2
  Gene Name: atlastin GTPase 2
  ENST ID: ENST00000443098
  CDS Start-End: 1-775
cggagggggacgaggcagcgcgagggcagcaaccgcaccaggggctgtggcgccggcgacggaccagcgacccaagcgccgcggttaaccacgtctcgtccacgacctccctaggtgagaattatgaagatgatgacctagtaaattctgatgaggttatgaagaaaccatgtccagtacagattgttcttgctcatgaagatgaccataactttgaacttgatgaagaagctttggagcagatattgctacaggagcacatacgagatcttaacatagtagtggtatctgtggcaggagcttttcgtaaagggaagtcatttctactggacttcatgcttagatacatgtataacaaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaa

SEQ ID NO: 109430 - DNA, 578 bp, Homo sapiens
  Payload ID: 1487
  Gene Symbol: ATL2
  Gene Name: atlastin GTPase 2
  ENST ID: ENST00000456736
  CDS Start-End: 3-263
agatggcggagggggacgaggcagcgcgagggcagcaaccgcaccaggggctgtggcgccggcgacggaccagcgacccaagcgccgcggttaaccacgtctcgtccacgacctccctagagtcttgctctgtcgccaggttggagtgcagtggcacgatcttcgcttactgcaacctcccgggttcaagtgattcctctgcctcagcctcccaagtagctgggattacaggattctcaaagttggattggtggaaacaatgaaccattgacaggctttacatggcgaggtggctgtgaaagagaaacaacaggcatacaagtttggaatgaagtatttgtgattgacagacctaatggaactaaagttgctgtgctgcttatggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttca

SEQ ID NO: 109431 - DNA, 2335 bp, Homo sapiens
  Payload ID: 1487
  Gene Symbol: ATL2
  Gene Name: atlastin GTPase 2
  Uniprot ID: Q8NHH9
  ENST ID: ENST00000419554
  CDS Start-End: 14-1753
aaatcggtacaagatggcggagggggacgaggcagcgcgagggcagcaaccgcaccaggggctgtggcgccggcgacggaccagcgacccaagcgccgcggttaaccacgtctcgtccacgacctccctaggtgagaattatgaagatgatgacctagtaaattctgatgaggttatgaagaaaccatgtccagtacagattgttcttgctcatgaagatgaccataactttgaacttgatgaagaagctttggagcagatattgctacaggagcacatacgagatcttaacatagtagtggtatctgtggcaggagcttttcgtaaagggaagtcatttctactggacttcatgcttagatacatgtataacaaggattctcaaagttggattggtggaaacaatgaaccattgacaggctttacatggcgaggtggctgtgaaagagaaacaacaggcatacaagtttggaatgaagtatttgtgattgacagacctaatggaactaaagttgctgtgctgcttatggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacaggtgttttccaaactgtttgaagttactagacgtcgaatggttcaccgtgctctttcatcagcacagcgacagagactgtcatccaacaataacaagaagaaaaattagacagtatttttaacctttttctctatctgaagtgttcacacttacacatgtaggacaataagcaggaccgtctgggccggtctgcataaatgctgtatacataccagatttgatgctgcatatagggtatggaattgcacatccatctcataggaattgtaaatggtttgaataagaggaaagtaatttttgttgcattataaaatgtctagtagcatcataagtttttttgagagaagcatctttttatttcccatattcctggttattttcatcattgctttgaattgaatttttatatctatttttatatgtaactctttttttacctcatgtttttgtttgttttgcacatttctcataccacaggtattgaagcccctgggtgataatttgatggaggaaaacataaggcagtctgtaacaaactctatcaaagcaggcctgactgaccaggtgtctcatcatgccagattaaagacagactgacagttcatctcctcacggactccactctctttttttttcatgcttgctgtacaatgagaactcaaataaaaataaaccaaagtttacaatcaa

SEQ ID NO: 109432 - DNA, 1242 bp, Homo sapiens
  Payload ID: 1487
  Gene Symbol: ATL2
  Gene Name: atlastin GTPase 2
  ENST ID: ENST00000629272
  CDS Start-End: 1-1242
atggatacccagggtgcctttgatagccagtcaactatcaaagactgtgcaacggtgtttgctctgagcactatgactagctctgtccaggtatataatctgtctcagaatattcaagaagatgatcttcaacatttgcaattatttacagagtatggaagacttgcgatggaagaaatctaccagaaaccatttcagacattaatgtttttgattcgagattggagctatccttatgaacattcatatggtttggaaggtggaaagcaatttcttgaaaagagattacaggtaaaacaaaatcaacatgaagagcttcagaatgtaaggaagcacatacacaattgtttctcaaatcttggttgcttccttttgccacatcctggtcttaaagttgcaactaatcctagttttgatgggagattgaaagatattgatgaagactttaaacgagagcttcgaaatctggttccattgctgcttgcccctgaaaatttggtagaaaaagagataagtggatctaaagtcacttgtagagatcttgtagaatattttaaggcttacatcaaaatctatcaaggagaagaacttccacatccaaagtccatgcttcaggcaacagctgaagctaataatcttgctgcagtagcaggagcaagagatacctattgtaaaagtatggaacaggtatgtggaggggacaagccttacattgcaccttcagatctggagcgaaaacacttggatctcaaggaagtggcgataaaacaatttcgttcagtaaaaaagatgggtggagatgagttctgccgtcgttatcaggaccagcttgaagctgaaattgaagaaacctatgcaaattttataaagcacaatgatggcaaaaatatcttctatgctgctcgtaccccagccacactgtttgcggtcatgtttgctatgtatataatctcaggactgactggcttcattggcctaaactctatagctgtcttgtgtaaccttgtcatggggttagcactgatatttctttgtacttgggcatatgttaaatactctggggagttcagagaaattggaacagtgattgatcagattgctgaaacactatgggaacagaggagtcccaggaaggtgttttccaaactgtttgaagttactagacgtcgaatggttcaccgtgctctttcatcagcacagcgacagagactgtcatccaacaataacaagaagaaaaattag

SEQ ID NO: 109433 - DNA, 7135 bp, Homo sapiens
  Payload ID: 1488
  Gene Symbol: ATL3
  Gene Name: atlastin GTPase 3
  Uniprot ID: Q6DD88
  ENST ID: ENST00000398868
  CDS Start-End: 278-1903
acacgcggcaggcggtggcgggattctgccgcgtgcgctttcccgccccgcctcgcctagcctcgtcctgcgctcgccacgcctcgggctgtccgttgggccacgcagaccgcgctgcgctcgctccgtcgcggctccgcgtgccccaccttctggctagttttttctagagcccaggctccgcccgtttcccgcttccagggcccggttcgttcccgcccgcacccgtccctctcctctgcacccctgctgcttctgctttgaaggcggaggctccatgttgtcccctcagcgagtggcagcagctgcctcaagaggagcagatgatgccatggagagcagcaagcctggtccagtgcaggttgttttggttcagaaagatcaacattcctttgagctagatgagaaagccttggccagcatcctcttgcaggaccacatccgagatcttgatgtggtggtggtttcagtggctggtgccttccgaaagggcaagtccttcattctggattttatgctacgatacttatattctcagaaggaaagtggccattcaaattggttgggtgacccagaagaaccgttaacaggattttcctggagagggggatctgatccagaaaccactgggattcaaatctggagtgaagttttcactgtggagaagccaggtgggaagaaggttgcagttgttctgatggatacccagggggcatttgacagccagtcaactgtgaaagactgtgctaccatctttgctctaagcactatgactagttctgttcagatttataatttatctcagaacattcaagaagatgatcttcaacagctgcagctcttcacagaatacggtcgtctggcaatggatgaaattttccaaaagcctttccagacactgatgtttttggttagagattggagtttcccttatgaatatagctatggactccaaggaggaatggcatttttggataagcgtttacaggtgaaggaacatcaacatgaagaaattcagaatgttcgaaatcacattcactcatgtttctccgatgtcacctgctttctcttaccacatccaggactccaggtggccacaagccctgactttgatgggaaattaaaagatattgctggtgaattcaaagagcagttacaggcactgataccgtatgtattaaacccatctaagttaatggaaaaggagatcaatggctcaaaggtcacctgtcggggactactggagtattttaaggcatatattaaaatttatcaaggagaagatctgcctcaccccaagtccatgcttcaggccactgctgaagccaacaacttagcagctgcagcctctgccaaggacatttattataacaacatggaagaggtttgtgggggagagaaaccttatttgtctccagacattctagaggagaagcactgtgaattcaaacaacttgctctggaccattttaagaagaccaagaagatgggtgggaaggatttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgcatatgtgttggagcaggcttcttctcatatcggtaattccactcaggccactgtgagggatgcagttgttggaagaccatccatggataaaaaagctcaatagcatcttaacgtgaagatcaaacaagaacacaacaagcccctactgatttctgggtttctgccacggccacaggttcatatccagaggaatggcagatctgagacgatccaggaagagctaaaacatggccctgtaataaatgagcagacctctcctgtggtttcaaattattaaacacacttccatttctcttggaagcatttcttttccttgctgttatagatgcaagcctgtgtctattttcatattactctgctttgtgcactttatggaggaggaagctagaggaaaaatggaaatgcagcttttaagttctttatgtgccacttagtgccttttaagattgattccatggttttgcacacacgatggggaggggatggaggataacctcatgaaaggtgccgttttcgggtgaaacttgacatttcttttatactttactcttttgagaaggattctttttttttttttttttttttttgagttggagtctcgctctgtcaccaggcttgagtgcagtggtgtgatcttggctcactgcaacctctgcctgccgggttcaagcagttctcctgcctcagcctcccaagtagctgggactacaggtgtacgccaccatacccagctaatttttttgtatttttagtagagatggggtttcaccatgttggccaggatggtcttggtctcttgaccttgtgatccgcctgcccgccttggcctcccaaagtgctgggattacaggcgtgagccaccgtgcccggccaagaaggattccttttttaaaagtttacagaacttggagaaacttcagaactaaagactaactgaaaatgatgtcattacactcaaaaaaaatttacaatagggaatcctgttgccacatagtgtggaaaaatcatgtcatatttaaatataccatactctgaaatgtgaggtttttacccagtaggctgacagttttgttgcaacttgctctattttttttttttttttggtccctatagcttctttctagaaaaagaggcaaacgtgccttgaaaagccagagtggctcataataaaaggaatgcgctagatacttcaagaaaaaagctaagtttaaatgaaccatgtgacctctgataagtcacttgaacttgtgccttggtcaggttcactgtaggtttacatatgtatgtatgttttacacaactcttgtaattgtcatttgaggggttttgtttttgagagttctgcataagaacagaactttattaaggattagagggaagatacaaatattactgcgtttaattgatgtctaatttcatgtggcttagcagcaattaataacctgatttaaggtctttattcagaatgttaatttgcattctctgccgtgtctaatgttcttaataatgaagctaaaattaacccattttatttagtgaattatctatttaattttactttggctagtctggtagctttaagatagctttgccttagcaaggatcaaagtcctacccaaatataaaaaatatctagaagtatctaagagttctttttttctatttaccttgattaggagataaaagttttatctgttagttgcttttccttttggaattattgtggattttaaaacttaaaacttgcctgcaagtatttatataaacattcaggtatataagccttaatttctaagataatttaacttttgttatgggagggaggtaagagtgtaaattttatatacatgaaggtaagatctgagtgtaaactttacatacatgaagtatgaatggaaggtagaaaaaaagtcccttttcgcatgtaatctctttatcaaagaattttcttttgacactttaccactgaagtatttttgtaagtcctaaattcgcagcatattgtttcatatttatatgccatcttgcaaatagttcttgctattttattcactgctgttacactttagaaaaattccagcttgtttacttgcatttatcagtgatgccaaccaagctttgactgttaacttgaaagcttgcttctgaaatgttggtgcattttcaggtgacctcttatctctctgaaagttcatacctattagcaggctctgtaaatattgacatacttagcttttaatacattctataagtaaatttatagatttcagaataacttaaaaaatttaatggtaagaaggggtgatgtgtcgaaaactcatactaaagtattaggtcactttaaaaaaagtgataatgtatgatttaatgaaatcttaagattcagttactatttaaattcaccatttctgttttggtcttataaagagaccttggtttaattatccagaggaagtcctcttcaccattttttttttttcttagttctgcttctggaaagtgttttataaagttttctcagtgagggttcttaagagttttctttggcctcttttctctcaacagtaaattgatgattttatatcagctttttcaataaaagatgcattatcattactggctataaatcatcctggggagatttataaccaggttaaaaataatatcttttacttctctcaccttttacttgtggttcagatgctcagactgtgcctgtttgcgtcgtgtctgttgctctgccgctttccatgcaggcatttttaattttacacaatcctaacaatatatggaactcattcctatgaatatataaaaggaggcttccaaaattttctattaaaatatttcaggataaattaagtgttgataatttgaaaaaataatttcaatgagctgcttatagtaaaaatggtagaatcagagttttcattctttgagaaatctttctgtaagattggctcatagataaaatgagacaaactactatgtatgataaaacaccttcagagtcatgccttgttttattttattttattttttgagacagaggtctcgctctgtcgcccaggttggagtgcagtggtgcaatctcgctcactgcaacctccacctcccaggttcaagcgattctcctgtctcagcttcctgagtagctgggactacaggtgtacaccaccacgcctggctaatttttgtttttttactagaggtggggttttgccatgttggccaggctggtctcaaactcctgacctcaggtgatccactccccccagcctcccaaagtgctgggattacaggcatgagccaccccgcccagctgagtcatgccttattttcgtagtataccaagaaatgttctatggaagtttacgttttaacacctcttttatacttggtaaaattgcctgtgtttcgctttattcctttttttttttgagacggactcttgtactgtcacccaggctgaagtgcagtggcgcaatcttggctcactacaacctccgcctcctgggttcaagtgattcttttgcctcagcctcccaagtagcagggattacaggcatgtgccaccacacccggcttatttttgtatttttagtagagacagggcttcgccatgttgaccaggctggtctcaactcctctgggaatccgcctgtcttggccttccagggtgctgggattacaggcgtgagccactggaacctggccttgttttgctttattttttctcttacatgaagtaaagcgctttggtcaaacacacaaaaatactgccttgtactggtggttggtttcattagtggatcacacacagtgttctacttggcttgtaaaatggtgccttggatagggtgagtttggataagtatgtatgtatgtatgagttatagcaaaattaagtagattgaatcaagtccatgcaaaagcaataaaacagttttaattttttaattttttaaaaattaaaactttaataaaacagtttttaattttttgctaggttcttttaaaaaatgatgtaacttacatggaagtcttcacaggacttttttctttcctggaactattgaaatgtaatttaggatgatttgatcttccatctcaagttgtcaacatggctgtgtcattctggcttacatatgttttatttaacaaaattctagtcaagggataagggcataatgaagacaagcttcagttatgaaagtacaaactatttgtgtgattaatttttaaaaatgacattaagaagcccattgtaaaataatatttgcagtcaaatggtttttcttgctgtaagtcctgttgtagctatgtttagggtagtggttctcatctaccttggagtgcataagacttacctagcaggcttgtttaaaaagttcagattcctagctttgtacccagggattgcctcaggtggtatgggctgtggtcctggagtcatcacttttataaatagtggttcagagaccacagagagagactgcttcatcgaatgggaagtaccaaggagaaagtacaattcagtattgtctggaggcaagtggacactttgtacctgaggtttagaataggtggtctcttgccagtacaatccccaggcgttttctgtgttcagaagtagtaagaatgcctttaattcagaggattatctaagctctttaaagctgtttttctccattgtcatagtgccttctctgaaaaatgaatgtacaggtatcctattttctaatgtaattaggattttttaaaagcaatttttgatagtttttcttttaaaaagtaaaattcagcactgtgacttgaacccccaaatctttcacatacaggtgaaacattaagccacaaataaaaataatgaacaagaaagaagacaagatcctaattcctgtcattagtgacctaagtaccccatatcagaaactttgcaaaacagatctagggacagaagggctttgaaagacatttttctttggggcaaatttcgtgtgccagaactacagtttaaatgtttttatgagcaagggaaggtagcattgattcccatagctttctaattagatacatgctgtcatggatgtaagccttaaaggagttaatactaatcttgtacatacacaaattttcctcaggtttttttattttaaaaaatgatttgttaaaagtactgtctgctagacccttgcctttgagtggctttgaaacttaatatagtttttaaaaagtgcaatgggatgagattatgctattagtatattaaaagcatgtttctgttttactccaatttgtaagatcatttaatggaataaagatcacaacacca

SEQ ID NO: 109434 - DNA, 1920 bp, Homo sapiens
  Payload ID: 1488
  Gene Symbol: ATL3
  Gene Name: atlastin GTPase 3
  ENST ID: ENST00000538786
  CDS Start-End: 283-1854
aaacaccaaagctgtctctcacactggtggttccaggataaagcctcggcctggggcctggtctgcacgttaggcgccggccgcagctcgcaggaggacccgagccagcccgccccttcccgcacagcctgctgggagttgtagttcagtcgtcggagaaccacgccaagccccgccccagatgagtgcgcagtatgaggaccgctggccgggacccagtgagcgcgggactacaattcccaaaggacggtagcactcagcgccccgccaacagatgatgccatggagagcagcaagcctggtccagtgcaggttgttttggttcagaaagatcaacattcctttgagctagatgagaaagccttggccagcatcctcttgcaggaccacatccgagatcttgatgtggtggtggtttcagtggctggtgccttccgaaagggcaagtccttcattctggattttatgctacgatacttatattctcagaaggaaagtggccattcaaattggttgggtgacccagaagaaccgttaacaggattttcctggagagggggatctgatccagaaaccactgggattcaaatctggagtgaagttttcactgtggagaagccaggtgggaagaaggttgcagttgttctgatggatacccagggggcatttgacagccagtcaactgtgaaagactgtgctaccatctttgctctaagcactatgactagttctgttcagatttataatttatctcagaacattcaagaagatgatcttcaacagctgcagctcttcacagaatacggtcgtctggcaatggatgaaattttccaaaagcctttccagacactgatgtttttggttagagattggagtttcccttatgaatatagctatggactccaaggaggaatggcatttttggataagcgtttacaggtgaaggaacatcaacatgaagaaattcagaatgttcgaaatcacattcactcatgtttctccgatgtcacctgctttctcttaccacatccaggactccaggtggccacaagccctgactttgatgggaaattaaaagatattgctggtgaattcaaagagcagttacaggcactgataccgtatgtattaaacccatctaagttaatggaaaaggagatcaatggctcaaaggtcacctgtcggggactactggagtattttaaggcatatattaaaatttatcaaggagaagatctgcctcaccccaagtccatgcttcaggccactgctgaagccaacaacttagcagctgcagcctctgccaaggacatttattataacaacatggaagaggtttgtgggggagagaaaccttatttgtctccagacattctagaggagaagcactgtgaattcaaacaacttgctctggaccattttaagaagaccaagaagatgggtgggaaggatttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgcatatgtgttggagcaggcttcttctcatatcggtaattccactcaggccactgtgagggatgcagttgttggaagaccatccatggataaaaaagctcaatagcatcttaacgtgaagatcaaacaagaacacaacaagcccctactgatttctgggtttctgccacgg

SEQ ID NO: 109435 - DNA, 714 bp, Homo sapiens
  Payload ID: 1488
  Gene Symbol: ATL3
  Gene Name: atlastin GTPase 3
  ENST ID: ENST00000540699
  CDS Start-End: 207-714
ccaggcctagttaaacaccaaagctgtctctcacactggtggttccaggataaagcctcggcctggggcctggtctgcacgttaggcgccggccgcagctcgcaggaggacccgagccagcccgccccttcccgcacagcctgctgggagttgtagttcagtcgtcggagaaccacgccaagccccgccccagatgagtgcgcagtatgaggaccgctggccgggacccagtgagcgcgggactacaattcccaaaggacggtagcactcagcgccccgccaacagggcccggttcgttcccgcccgcacccgtccctctcctctgcacccctgctgcttctgctttgaaggcggaggctccatgttgtcccctcagcgagtggcagcagctgcctcaagaggagcagatgatgccatggagagcagcaagcctggtccagtgcaggttgttttggttcagaaagatcaacattcctttgagctagatgagaaagccttggccagcatcctcttgcaggaccacatccgagatcttgatgtggtggtggtttcagtggctggtgccttccgaaagggcaagtccttcattctggattttatgctacgatacttatattctcagaaggaaagtggccattcaaattggttgggtgacccagaagaaccgttaacaggattttcctggagagggggatctgatccagaaaccactg

SEQ ID NO: 109436 - DNA, 4884 bp, Homo sapiens
  Payload ID: 1489
  Gene Symbol: ATMIN
  Gene Name: ATM interactor
  Uniprot ID: O43313
  ENST ID: ENST00000299575
  CDS Start-End: 25-2496
gggccgggcggccgtgcgggagccatggcggcctcggaggcggcggcggcggcggggtccgcggctctggcggcgggtgcccgggccgtcccggcggccacgacaggagccgccgccgccgcctcgggcccgtgggtgcccccgggaccccgactgaggggcagccggccgcggcccgcgggggcgacgcagcagcccgctgtccccgcgccgccggcgggggagctgatccagccgtcggtgagcgagctgtcccgggccgtgcggaccaacatcctgtgcaccgtgcgcggctgcggcaagatcctgcccaacagccccgcgctcaacatgcacctagtcaagagccaccgcctgcaggatggcatagtcaatccaacaataagaaaagatttgaaaactggaccgaaattctactgctgtccaattgaaggctgccccagaggccctgagagaccgttttctcagttttctctcgtaaaacagcactttatgaaaatgcatgctgagaagaagcacaaatgtagtaagtgcagcaattcgtacggtacagaatgggacctgaaaagacatgcagaggactgtggcaagaccttccggtgcacatgcggctgtccctacgccagtagaacagcactgcagtctcacatctaccgaactgggcacgagatacctgcagaacacagggacccacctagtaagaaaaggaaaatggaaaactgtgcacaaaaccagaagttatccaacaagaccattgaatcattgaacaaccaaccaatccctagaccagacactcaagaactagaagcttcagaaataaagctagaaccatcttttgaagactcttgtggctctaacactgacaagcagactcttacaacaccaccgagatatcctcagaagttgcttttaccaaagcccaaagtggctttggttaaactacccgtgatgcagttttctgtcatgcctgtctttgtgcctacagccgactcctcagcccagcctgtggtgttaggtgttgatcagggctctgccacaggggctgtgcacttaatgcccttgtcagtaggaaccctgatcctcggcctagattcagaggcttgctctcttaaggagagcctacctcttttcaaaattgctaatcctattgctggtgagccaataagtactggtgttcaagtgaactttggtaaaagtccatctaatcctttacaagaactagggaacacgtgtcaaaagaatagcatttcttcaatcaacgtgcagacagatctgtcttatgcctcacaaaactttataccttctgcacagtgggccactgctgattcctctgtgtcgtcttgttctcaaactgatttgtcgtttgattctcaagtgtctcttcccattagtgttcacactcagacatttttgcccagctctaaggtaacttcatctatagctgctcagactgatgcatttatggacacctgtttccagtcaggtggggtctccagagaaactcaaaccagtgggatagaaagtccaacggatgaccatgtacagatggaccaagctggaatgtgcggagacatttttgagagtgttcattcatcatataatgttgctacaggtaacattataagcaacagtttagtagcagagacagtaactcatagtttgttacctcagaatgagcctaagactttaaatcaagatattgagaaatctgcaccaattataaatttcagtgcacagaatagtatgcttccttcacagaacatgacagataatcagacccaaaccatagatttattaagtgatttggaaaacatcttgtcaagtaatctgcctgctcagacattggatcatcgtagtcttttgtctgacacaaatcctggacctgacacccagctcccatctggcccagcccagaaccccggaatcgattttgatatcgaagagttcttttcggcctcaaatatccagactcaaactgaagagagtgaacttagcaccatgaccaccgagccagtcttggagtcactggacatagagactcaaacggacttcttactcgcagatacctctgctcagtcctatgggtgtaggggaaattctaacttcttaggccttgagatgtttgacacacagacacagacagacttaaactttttcttagacagtagccctcatctgcctctgggaagtattctgaaacactccagcttttccgtgagtactgattcatctgacacagagacccaaactgaaggagtctccactgctaaaaatatacctgctctagaaagcaaagttcagttgaacagtacagaaacacagaccatgagttctgggtttgaaaccctggggagcttgttcttcaccagcaacgaaactcagacagcaatggatgactttcttctggctgatctggcctggaacacgatggagtctcagttcagctctgtagaaacccagacttctgcggaaccacacacagtctccaacttctaaaactaacggtggagtccatgtgtgaaatggcatctaccatttcctctggattaaaactacggactggggacaacagtattaattcgattgaatgtggctgatgatgcagttgcttagcttctttgtgtttctttgccttttgtacttgtaaacagaaatttgcgtataaatgtgagtgtattataaagtttgagatgttgatctaaattgtttttgtgttgcctacatttgccttttcacagctagtcttttcatgttaaaaaaaaaaatgtatttcatatctataaaacctatatagccatttagctgaagcccagcttaccaggttcaagggtacaaacttctcaaatcttcaaaacattttagtcaaagtgtaatatacttaaactgcacctaaaatatctttggcactgcttgttagaaattcctgattcctgttactaatcactaaagaaaccggatgctgccaccgtaggatttaagcagtagtgcttccatgctcttaagactcctgctgcctggaccttcgtcagctttgacacctcttttctgatttaaagacaccaaggaaaactacaactgtctttagctttgaagcagttttcatgtaatcattgccacctcttcgctacatgaactactattgataccagcatacaagtgtacagcactttacacacaagaggtttattgatgtaaaattatcggctagggaagcagcagcgggccaggtgtggtggcttacccctgtaatcccagcactttgggaggccaaagcaggacgatcacttgagcccaggagttcaacaccagcttgggcaacgtaagaagaccgtgtctctggaatttttttttttttttaattagccaggcacagtggcatgcgcctgtgatcccagctacttggaaggctgaggtgagaggatcactcgaggagattggggctgccatgagccatggtcttggcactgtactccaacctgggtaacagggcaagaccctatctcaaaaaaaaaaaaagtcgccagcaacaagcacgtagtgtagtgttcctgctaaatgagcgtaggttatccaaaccttgggaacagggagttatggaaacatgcctatgacttcatcttggggtgtgtcctatgaagatcctttctggtctccacagtaggccagagttgggggctctggagctgtttccccaagtgcatccacaagctggatctgagttttgtcactctaaaattaaacaagaaaaaaagtgggaaaagggcatcccccattaggtttcaatactttgcacttctactaagcttgatagggcaggagtgcaatctacaattattttaaagtgaatttccttccattcaccattctttatcttttctttgaataagaaaaagtatctagcaaggatattacttgtgccttgaggctagcaattataggatagattcatctaaaatatggtattctgcattttggttttttttcttaagtgaataataccagtcttcaaagaaaacaaggtgaagacctattgcttcaataatcaagaatgctttgtgtgttttgaggtaggagcatgatcaagtatgctttggggattttctgtatttaggagatcctggattcttaattgttggctaagttccagtcaagtaggaatcagtgcagcctgtaagttctccacattgacacacacacacacacacacacacacacacgacatgctcctttctgtggcacatgcctgtattactgaaagctaaatcctcaaaacctagtaaggggactaatgattcattaaagtaaattgatggttttgctactaattcctatcccatacatttgacacaaaagaagtgttggtaatggataaataacatatcccgggcagatgagctcaacctagtaggtaagagtttggtttggtcacagttgcctatgagtgtgggtttcaaaagaaacataaagccttaacttagaatttcattatgttttagaatcatcactgccttaatattcaagcatctatttaagtcctaataaaggagaaatgcatgtttatggcttttttgtaaatataaatgcagtgatctatggcttaaaaaatttgtttctgtgacaatgtttgtaaatctagccaatagagtcatttacagaagaaaaatgagcatgtaataatacaagaactgtttccccctcaaaacctgaacctgaattatttgtaaaaactgaaatttaatgattaaagagaagccagaattgtacccttttttgtgaattcttgaacgtactcataaatatgacttattgtattgccttaagttttcactcattgtcttttgaaagccatatgataaaatgattttatttaataatacccagtta

SEQ ID NO: 109437 - DNA, 5343 bp, Homo sapiens
  Payload ID: 1489
  Gene Symbol: ATMIN
  Gene Name: ATM interactor
  Uniprot ID: O43313
  ENST ID: ENST00000566488
  CDS Start-End: 964-2967
tttattgaacatttattctgttcaaaacattcccaaaggcaacagaagatacaaataaatctctgcccatgtaaaggtgtggggggcattagaaggcgttctcttcggtgtaatgaagtaatgagagaagaaaaagtagtttgaagctatggagtaagggactttgagtatcccaggctcaaaaagttgggacttgaacagtacgggggtgctgctgaaaacgtttgagggaggtaatgacatgatcgaagctatacttgagaaaggtgaatctgataaagtatgagtgaaaaagagactgaaggtctagaaattagattgaggctaatgacaaaatccacataaataggaggacttgaacgaaggggcacttagaagaggacaggagatagtaaaaggcattcaatgatgagagcacacactacaggggagcatgagggaggttggaaaagataatgaaaggattaccgagcttcactgacgatgtgtttgaaatgagcaggaatcttgtagtgatcctaatccgtggttttctggagcatttcacagcctaggaacatacaaggggggcatctccctggaatgtaaattgactaagaggaattcagtaatggtcaaatgaatgcagaattttagagtcttgcttagtattctcaccacatttcgtttaatctactcatactctttttctcttactgctgacactagatggaaaaactcttaattaaaagtatttcacaaaatgtgctcgttttcagtcattccgtttccactccagcctgttgtgttgtttttttgaaataataatttaaagtaattttccttttgcaggatggcatagtcaatccaacaataagaaaagatttgaaaactggaccgaaattctactgctgtccaattgaaggctgccccagaggccctgagagaccgttttctcagttttctctcgtaaaacagcactttatgaaaatgcatgctgagaagaagcacaaatgtagtaagtgcagcaattcgtacggtacagaatgggacctgaaaagacatgcagaggactgtggcaagaccttccggtgcacatgcggctgtccctacgccagtagaacagcactgcagtctcacatctaccgaactgggcacgagatacctgcagaacacagggacccacctagtaagaaaaggaaaatggaaaactgtgcacaaaaccagaagttatccaacaagaccattgaatcattgaacaaccaaccaatccctagaccagacactcaagaactagaagcttcagaaataaagctagaaccatcttttgaagactcttgtggctctaacactgacaagcagactcttacaacaccaccgagatatcctcagaagttgcttttaccaaagcccaaagtggctttggttaaactacccgtgatgcagttttctgtcatgcctgtctttgtgcctacagccgactcctcagcccagcctgtggtgttaggtgttgatcagggctctgccacaggggctgtgcacttaatgcccttgtcagtaggaaccctgatcctcggcctagattcagaggcttgctctcttaaggagagcctacctcttttcaaaattgctaatcctattgctggtgagccaataagtactggtgttcaagtgaactttggtaaaagtccatctaatcctttacaagaactagggaacacgtgtcaaaagaatagcatttcttcaatcaacgtgcagacagatctgtcttatgcctcacaaaactttataccttctgcacagtgggccactgctgattcctctgtgtcgtcttgttctcaaactgatttgtcgtttgattctcaagtgtctcttcccattagtgttcacactcagacatttttgcccagctctaaggtaacttcatctatagctgctcagactgatgcatttatggacacctgtttccagtcaggtggggtctccagagaaactcaaaccagtgggatagaaagtccaacggatgaccatgtacagatggaccaagctggaatgtgcggagacatttttgagagtgttcattcatcatataatgttgctacaggtaacattataagcaacagtttagtagcagagacagtaactcatagtttgttacctcagaatgagcctaagactttaaatcaagatattgagaaatctgcaccaattataaatttcagtgcacagaatagtatgcttccttcacagaacatgacagataatcagacccaaaccatagatttattaagtgatttggaaaacatcttgtcaagtaatctgcctgctcagacattggatcatcgtagtcttttgtctgacacaaatcctggacctgacacccagctcccatctggcccagcccagaaccccggaatcgattttgatatcgaagagttcttttcggcctcaaatatccagactcaaactgaagagagtgaacttagcaccatgaccaccgagccagtcttggagtcactggacatagagactcaaacggacttcttactcgcagatacctctgctcagtcctatgggtgtaggggaaattctaacttcttaggccttgagatgtttgacacacagacacagacagacttaaactttttcttagacagtagccctcatctgcctctgggaagtattctgaaacactccagcttttccgtgagtactgattcatctgacacagagacccaaactgaaggagtctccactgctaaaaatatacctgctctagaaagcaaagttcagttgaacagtacagaaacacagaccatgagttctgggtttgaaaccctggggagcttgttcttcaccagcaacgaaactcagacagcaatggatgactttcttctggctgatctggcctggaacacgatggagtctcagttcagctctgtagaaacccagacttctgcggaaccacacacagtctccaacttctaaaactaacggtggagtccatgtgtgaaatggcatctaccatttcctctggattaaaactacggactggggacaacagtattaattcgattgaatgtggctgatgatgcagttgcttagcttctttgtgtttctttgccttttgtacttgtaaacagaaatttgcgtataaatgtgagtgtattataaagtttgagatgttgatctaaattgtttttgtgttgcctacatttgccttttcacagctagtcttttcatgttaaaaaaaaaaatgtatttcatatctataaaacctatatagccatttagctgaagcccagcttaccaggttcaagggtacaaacttctcaaatcttcaaaacattttagtcaaagtgtaatatacttaaactgcacctaaaatatctttggcactgcttgttagaaattcctgattcctgttactaatcactaaagaaaccggatgctgccaccgtaggatttaagcagtagtgcttccatgctcttaagactcctgctgcctggaccttcgtcagctttgacacctcttttctgatttaaagacaccaaggaaaactacaactgtctttagctttgaagcagttttcatgtaatcattgccacctcttcgctacatgaactactattgataccagcatacaagtgtacagcactttacacacaagaggtttattgatgtaaaattatcggctagggaagcagcagcgggccaggtgtggtggcttacccctgtaatcccagcactttgggaggccaaagcaggacgatcacttgagcccaggagttcaacaccagcttgggcaacgtaagaagaccgtgtctctggaatttttttttttttttaattagccaggcacagtggcatgcgcctgtgatcccagctacttggaaggctgaggtgagaggatcactcgaggagattggggctgccatgagccatggtcttggcactgtactccaacctgggtaacagggcaagaccctatctcaaaaaaaaaaaaagtcgccagcaacaagcacgtagtgtagtgttcctgctaaatgagcgtaggttatccaaaccttgggaacagggagttatggaaacatgcctatgacttcatcttggggtgtgtcctatgaagatcctttctggtctccacagtaggccagagttgggggctctggagctgtttccccaagtgcatccacaagctggatctgagttttgtcactctaaaattaaacaagaaaaaaagtgggaaaagggcatcccccattaggtttcaatactttgcacttctactaagcttgatagggcaggagtgcaatctacaattattttaaagtgaatttccttccattcaccattctttatcttttctttgaataagaaaaagtatctagcaaggatattacttgtgccttgaggctagcaattataggatagattcatctaaaatatggtattctgcattttggttttttttcttaagtgaataataccagtcttcaaagaaaacaaggtgaagacctattgcttcaataatcaagaatgctttgtgtgttttgaggtaggagcatgatcaagtatgctttggggattttctgtatttaggagatcctggattcttaattgttggctaagttccagtcaagtaggaatcagtgcagcctgtaagttctccacattgacacacacacacacacacacacacacacacgacatgctcctttctgtggcacatgcctgtattactgaaagctaaatcctcaaaacctagtaaggggactaatgattcattaaagtaaattgatggttttgctactaattcctatcccatacatttgacacaaaagaagtgttggtaatggataaataacatatcccgggcagatgagctcaacctagtaggtaagagtttggtttggtcacagttgcctatgagtgtgggtttcaaaagaaacataaagccttaacttagaatttcattatgttttagaatcatcactgccttaatattcaagcatctatttaagtcctaataaaggagaaatgcatgtttatggcttttttgtaaatataaatgcagtgatctatggcttaaaaaatttgtttctgtgacaatgtttgtaaatctagccaatagagtcatttacagaagaaaaatgagcatgtaataatacaagaactgtttccccctcaaaacctgaacctgaattatttgtaaaaactgaaatttaatgattaaagagaagccagaattgtacccttttttgtgaattcttgaacgtactcataaatatgacttattgtattgccttaagttttcactcattgtcttttgaaagccatatgataaaatgattttatttaat

SEQ ID NO: 109438 - DNA, 4803 bp, Homo sapiens
  Payload ID: 1489
  Gene Symbol: ATMIN
  Gene Name: ATM interactor
  Uniprot ID: O43313
  ENST ID: ENST00000564241
  CDS Start-End: 422-2425
aggccagcagtgacataattcaaaagcgcaagtcattgaaagcagttctgcgaatatgtagcttttgatgatcaggagtaaatttagagtacccagaatattgcatgttctgtctgcccatagtcaggcttctgataagaatttcacagcagaaaactctgaggttgtagtctctagtaggacagatgtgtcgccaatgaagagtgatctgctcttaccaccatctaaaccgggatgcaacaacgttctcaattgaagatcagggagccagtcaggaaatgtacctgaggatggcatagtcaatccaacaataagaaaagatttgaaaactggaccgaaattctactgctgtccaattgaaggctgccccagaggccctgagagaccgttttctcagttttctctcgtaaaacagcactttatgaaaatgcatgctgagaagaagcacaaatgtagtaagtgcagcaattcgtacggtacagaatgggacctgaaaagacatgcagaggactgtggcaagaccttccggtgcacatgcggctgtccctacgccagtagaacagcactgcagtctcacatctaccgaactgggcacgagatacctgcagaacacagggacccacctagtaagaaaaggaaaatggaaaactgtgcacaaaaccagaagttatccaacaagaccattgaatcattgaacaaccaaccaatccctagaccagacactcaagaactagaagcttcagaaataaagctagaaccatcttttgaagactcttgtggctctaacactgacaagcagactcttacaacaccaccgagatatcctcagaagttgcttttaccaaagcccaaagtggctttggttaaactacccgtgatgcagttttctgtcatgcctgtctttgtgcctacagccgactcctcagcccagcctgtggtgttaggtgttgatcagggctctgccacaggggctgtgcacttaatgcccttgtcagtaggaaccctgatcctcggcctagattcagaggcttgctctcttaaggagagcctacctcttttcaaaattgctaatcctattgctggtgagccaataagtactggtgttcaagtgaactttggtaaaagtccatctaatcctttacaagaactagggaacacgtgtcaaaagaatagcatttcttcaatcaacgtgcagacagatctgtcttatgcctcacaaaactttataccttctgcacagtgggccactgctgattcctctgtgtcgtcttgttctcaaactgatttgtcgtttgattctcaagtgtctcttcccattagtgttcacactcagacatttttgcccagctctaaggtaacttcatctatagctgctcagactgatgcatttatggacacctgtttccagtcaggtggggtctccagagaaactcaaaccagtgggatagaaagtccaacggatgaccatgtacagatggaccaagctggaatgtgcggagacatttttgagagtgttcattcatcatataatgttgctacaggtaacattataagcaacagtttagtagcagagacagtaactcatagtttgttacctcagaatgagcctaagactttaaatcaagatattgagaaatctgcaccaattataaatttcagtgcacagaatagtatgcttccttcacagaacatgacagataatcagacccaaaccatagatttattaagtgatttggaaaacatcttgtcaagtaatctgcctgctcagacattggatcatcgtagtcttttgtctgacacaaatcctggacctgacacccagctcccatctggcccagcccagaaccccggaatcgattttgatatcgaagagttcttttcggcctcaaatatccagactcaaactgaagagagtgaacttagcaccatgaccaccgagccagtcttggagtcactggacatagagactcaaacggacttcttactcgcagatacctctgctcagtcctatgggtgtaggggaaattctaacttcttaggccttgagatgtttgacacacagacacagacagacttaaactttttcttagacagtagccctcatctgcctctgggaagtattctgaaacactccagcttttccgtgagtactgattcatctgacacagagacccaaactgaaggagtctccactgctaaaaatatacctgctctagaaagcaaagttcagttgaacagtacagaaacacagaccatgagttctgggtttgaaaccctggggagcttgttcttcaccagcaacgaaactcagacagcaatggatgactttcttctggctgatctggcctggaacacgatggagtctcagttcagctctgtagaaacccagacttctgcggaaccacacacagtctccaacttctaaaactaacggtggagtccatgtgtgaaatggcatctaccatttcctctggattaaaactacggactggggacaacagtattaattcgattgaatgtggctgatgatgcagttgcttagcttctttgtgtttctttgccttttgtacttgtaaacagaaatttgcgtataaatgtgagtgtattataaagtttgagatgttgatctaaattgtttttgtgttgcctacatttgccttttcacagctagtcttttcatgttaaaaaaaaaaatgtatttcatatctataaaacctatatagccatttagctgaagcccagcttaccaggttcaagggtacaaacttctcaaatcttcaaaacattttagtcaaagtgtaatatacttaaactgcacctaaaatatctttggcactgcttgttagaaattcctgattcctgttactaatcactaaagaaaccggatgctgccaccgtaggatttaagcagtagtgcttccatgctcttaagactcctgctgcctggaccttcgtcagctttgacacctcttttctgatttaaagacaccaaggaaaactacaactgtctttagctttgaagcagttttcatgtaatcattgccacctcttcgctacatgaactactattgataccagcatacaagtgtacagcactttacacacaagaggtttattgatgtaaaattatcggctagggaagcagcagcgggccaggtgtggtggcttacccctgtaatcccagcactttgggaggccaaagcaggacgatcacttgagcccaggagttcaacaccagcttgggcaacgtaagaagaccgtgtctctggaatttttttttttttttaattagccaggcacagtggcatgcgcctgtgatcccagctacttggaaggctgaggtgagaggatcactcgaggagattggggctgccatgagccatggtcttggcactgtactccaacctgggtaacagggcaagaccctatctcaaaaaaaaaaaaagtcgccagcaacaagcacgtagtgtagtgttcctgctaaatgagcgtaggttatccaaaccttgggaacagggagttatggaaacatgcctatgacttcatcttggggtgtgtcctatgaagatcctttctggtctccacagtaggccagagttgggggctctggagctgtttccccaagtgcatccacaagctggatctgagttttgtcactctaaaattaaacaagaaaaaaagtgggaaaagggcatcccccattaggtttcaatactttgcacttctactaagcttgatagggcaggagtgcaatctacaattattttaaagtgaatttccttccattcaccattctttatcttttctttgaataagaaaaagtatctagcaaggatattacttgtgccttgaggctagcaattataggatagattcatctaaaatatggtattctgcattttggttttttttcttaagtgaataataccagtcttcaaagaaaacaaggtgaagacctattgcttcaataatcaagaatgctttgtgtgttttgaggtaggagcatgatcaagtatgctttggggattttctgtatttaggagatcctggattcttaattgttggctaagttccagtcaagtaggaatcagtgcagcctgtaagttctccacattgacacacacacacacacacacacacacacacgacatgctcctttctgtggcacatgcctgtattactgaaagctaaatcctcaaaacctagtaaggggactaatgattcattaaagtaaattgatggttttgctactaattcctatcccatacatttgacacaaaagaagtgttggtaatggataaataacatatcccgggcagatgagctcaacctagtaggtaagagtttggtttggtcacagttgcctatgagtgtgggtttcaaaagaaacataaagccttaacttagaatttcattatgttttagaatcatcactgccttaatattcaagcatctatttaagtcctaataaaggagaaatgcatgtttatggcttttttgtaaatataaatgcagtgatctatggcttaaaaaatttgtttctgtgacaatgtttgtaaatctagccaatagagtcatttacagaagaaaaatgagcatgtaataatacaagaactgtttccccctcaaaacctgaacctgaattatttgtaaaaactgaaatttaatgattaaagagaagccagaattgtacccttttttgtgaattcttgaacgtactcataaatatgacttattgtattgccttaagttttcactcattgtcttttgaaagccatatgataaaatgattttatttaataa

SEQ ID NO: 109439 - DNA, 587 bp, Homo sapiens
  Payload ID: 1489
  Gene Symbol: ATMIN
  Gene Name: ATM interactor
  ENST ID: ENST00000565237
  CDS Start-End: 424-587
aaaagcgcaagtcattgaaagcagttctgcgaatatgtagcttttgatgatcaggagtaaatttagagtacccagaatattgcatgttctgtctgcccatagtcaggcttctgataagaatttcacagcagaaaactctgaggttgtagtctctagtaggacagatgtgtcgccaatgaagagtgatctgctcttaccaccatctaaaccgggatgcaacaacgttctcaattgaagatcagggagccagtcaggaaatgtacctgaggtatgctgaggaagaccgtgcaggatggcatagtcaatccaacaataagaaaagatttgaaaactggaccgaaattctactgctgtccaattgaaggctgccccagaggccctgagagaccgttttctcagttttctctcgtaaaacagcactttatgaaaatgcatgctgagaagaagcacaaatgtagtaagtgcagcaattcgtacggtacagaatgggacctgaaaagacatgcagaggactgtggcaagaccttccggtgcacatgcggctgtccctacgccagtagaacagcactgcagtctcacatctaccg

SEQ ID NO: 109440 - DNA, 13147 bp, Homo sapiens
  Payload ID: 1490
  Gene Symbol: ATM
  Gene Name: ATM serine/threonine kinase
  Uniprot ID: Q13315
  ENST ID: ENST00000278616
  CDS Start-End: 386-9556
ccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccgcgggaggaggcgagaggagtcgggatctgcgctgcagccaccgccgcggttgatactactttgaccttccgagtgcagtgacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggaacggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaagtctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggaaattaaccattttctctcagtaagtgtttatgatgcacttccattgacaagacttgaaggactaaaggatcttcgaagacaactggaactacataaagatcagatggtggacattatgagagcttctcaggataatccgcaagatgggattatggtgaaactagttgtcaatttgttgcagttatccaagatggcaataaaccacactggtgaaaaagaagttctagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattgtgtcaaagttcgatcagcagctgttacctgtttgaaaaacattttagccacaaagactggacatagtttctgggagatttataagatgacaacagatccaatgctggcctatctacagccttttagaacatcaagaaaaaagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcagagtcagagcactttttccgatgctgtttggataaaaaatcacaaagaacaatgcttgctgttgtggactacatgagaagacaaaagagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagagtacaactatttctagcttgagtgaaaaaagtaaagaagaaactggaataagtttacaggatcttctcttagaaatctacagaagtataggggagccagatagtttgtatggctgtggtggagggaagatgttacaacccattactagactacgaacatatgaacacgaagcaatgtggggcaaagccctagtaacatatgacctcgaaacagcaatcccctcatcaacacgccaggcaggaatcattcaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcagcaaagaagtagaaggaaccagttaccatgaatcattgtacaatgctctacaatctctaagagacagagaattctctacattttatgaaagtctcaaatatgccagagtaaaagaagtggaagagatgtgtaagcgcagccttgagtctgtgtattcgctctatcccacacttagcaggttgcaggccattggagagctggaaagcattggggagcttttctcaagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcgaacaatcccagcctaaaacttacatacacagaatgtctgagggtttgtggcaactggttagcagaaacgtgcttagaaaatcctgcggtcatcatgcagacctatctagaaaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaagagagacggaatgaagattccaacatataaatttttgcctcttatgtaccaattggctgctagaatggggaccaagatgatgggaggcctaggatttcatgaagtcctcaataatctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggatcgaacagaggctgcaaatagaataatatgtactatcagaagtaggagacctcagatggtcagaagtgttgaggcactttgtgatgcttatattatattagcaaacttagatgccactcagtggaagactcagagaaaaggcataaatattccagcagaccagccaattactaaacttaagaatttagaagatgttgttgtccctactatggaaattaaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaagggccgtgatgacctgagacaagatgctgtcatgcaacaggtcttccagatgtgtaatacattactgcagagaaacacggaaactaggaagaggaaattaactatctgtacttataaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattgttggttacatacttggacttggtgatagacatgtacagaatatcttgataaatgagcagtcagcagaacttgtacatatagatctaggtgttgcttttgaacagggcaaaatccttcctactcctgagacagttccttttagactcaccagagatattgtggatggcatgggcattacgggtgttgaaggtgtcttcagaagatgctgtgagaaaaccatggaagtgatgagaaactctcaggaaactctgttaaccattgtagaggtccttctatatgatccactctttgactggaccatgaatcctttgaaagctttgtatttacagcagaggccggaagatgaaactgagcttcaccctactctgaatgcagatgaccaagaatgcaaacgaaatctcagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaaacagaaacgtatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctcccgagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacagcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagc

SEQ ID NO: 109441 - DNA, 12954 bp, Homo sapiens
  Payload ID: 1490
  Gene Symbol: ATM
  Gene Name: ATM serine/threonine kinase
  Uniprot ID: Q13315
  ENST ID: ENST00000452508
  CDS Start-End: 190-9360
gcgagaggagtcgggatctgcgctgcagccaccgccgcggttgatactactttgaccttccgagtgcagtgaggcatacatcacaatttggaattatgcattggtttatcaatttacttgtttattgtcaccctgctgcccagatatgacttcatgaggacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggaacggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaagtctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggaaattaaccattttctctcagtaagtgtttatgatgcacttccattgacaagacttgaaggactaaaggatcttcgaagacaactggaactacataaagatcagatggtggacattatgagagcttctcaggataatccgcaagatgggattatggtgaaactagttgtcaatttgttgcagttatccaagatggcaataaaccacactggtgaaaaagaagttctagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattgtgtcaaagttcgatcagcagctgttacctgtttgaaaaacattttagccacaaagactggacatagtttctgggagatttataagatgacaacagatccaatgctggcctatctacagccttttagaacatcaagaaaaaagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcagagtcagagcactttttccgatgctgtttggataaaaaatcacaaagaacaatgcttgctgttgtggactacatgagaagacaaaagagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagagtacaactatttctagcttgagtgaaaaaagtaaagaagaaactggaataagtttacaggatcttctcttagaaatctacagaagtataggggagccagatagtttgtatggctgtggtggagggaagatgttacaacccattactagactacgaacatatgaacacgaagcaatgtggggcaaagccctagtaacatatgacctcgaaacagcaatcccctcatcaacacgccaggcaggaatcattcaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcagcaaagaagtagaaggaaccagttaccatgaatcattgtacaatgctctacaatctctaagagacagagaattctctacattttatgaaagtctcaaatatgccagagtaaaagaagtggaagagatgtgtaagcgcagccttgagtctgtgtattcgctctatcccacacttagcaggttgcaggccattggagagctggaaagcattggggagcttttctcaagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcgaacaatcccagcctaaaacttacatacacagaatgtctgagggtttgtggcaactggttagcagaaacgtgcttagaaaatcctgcggtcatcatgcagacctatctagaaaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaagagagacggaatgaagattccaacatataaatttttgcctcttatgtaccaattggctgctagaatggggaccaagatgatgggaggcctaggatttcatgaagtcctcaataatctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggatcgaacagaggctgcaaatagaataatatgtactatcagaagtaggagacctcagatggtcagaagtgttgaggcactttgtgatgcttatattatattagcaaacttagatgccactcagtggaagactcagagaaaaggcataaatattccagcagaccagccaattactaaacttaagaatttagaagatgttgttgtccctactatggaaattaaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaagggccgtgatgacctgagacaagatgctgtcatgcaacaggtcttccagatgtgtaatacattactgcagagaaacacggaaactaggaagaggaaattaactatctgtacttataaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattgttggttacatacttggacttggtgatagacatgtacagaatatcttgataaatgagcagtcagcagaacttgtacatatagatctaggtgttgcttttgaacagggcaaaatccttcctactcctgagacagttccttttagactcaccagagatattgtggatggcatgggcattacgggtgttgaaggtgtcttcagaagatgctgtgagaaaaccatggaagtgatgagaaactctcaggaaactctgttaaccattgtagaggtccttctatatgatccactctttgactggaccatgaatcctttgaaagctttgtatttacagcagaggccggaagatgaaactgagcttcaccctactctgaatgcagatgaccaagaatgcaaacgaaatctcagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaaacagaaacgtatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctcccgagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacagcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagcata

SEQ ID NO: 109442 - DNA, 481 bp, Homo sapiens
  Payload ID: 1490
  Gene Symbol: ATM
  Gene Name: ATM serine/threonine kinase
  ENST ID: ENST00000532931
  CDS Start-End: 202-481
aaaagaagccgtggccgcgggaggaggcgagaggagtcgggatctgcgctgcagccaccgccgcggttgatactactttgaccttccgagtgcagtgtctcgctctgtcgcccatgctggagtgcaattgcgtgatctcagctaactgcactttccgcctcctgggttcaaacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaaga

SEQ ID NO: 109443 - DNA, 595 bp, Homo sapiens
  Payload ID: 1490
  Gene Symbol: ATM
  Gene Name: ATM serine/threonine kinase
  ENST ID: ENST00000527891
  CDS Start-End: 133-595
cggagaaaagaagccgtggccgcgggaggaggcgagaggagtcgggatctgcgctgcagccaccgccgcggttgatactactttgaccttccgagtgcagtgacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaaaattgttctctgtgtacttcaggctctatctgaaaccttcacaagatgttcatagagttttagtggctagaataattcatgctgttaccaaaggatgctgttctcagactgacggattaaattccaaatttt

SEQ ID NO: 109444 - DNA, 1513 bp, Homo sapiens
  Payload ID: 1490
  Gene Symbol: ATM
  Gene Name: ATM serine/threonine kinase
  ENST ID: ENST00000531525
  CDS Start-End: 1-468
attgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggaaattaaccattttctctcagtaagtgtttatgatgcacttccattgacaagacttgaaggactaaaggatcttcgaagacaactggaactacataaagatcagatggtggacattatgagagcttctcagggtgctaattttaaatgacatgggctatttctacctgtttctttttgaaagaatattttgcaaagtcttgctcttggtttcattgtcacagacttagttcagactctcatcatttagttcagaccctcatttctcatctaactgtaaaactggtcctaactggtcttctcaccctgaactcttcctgttttattcatcctctgccagatgatttctctaaacccaaatatgatcatgtttttctactgcctaaattttttttttaagagacagagtttttttttttttttaagagtctcactctgtcacctaggctggagtgtagtggcaccatcataacttactatgaccttgaattcctgggtacaaggaattctcctgtctcagccttctgaatagctggaacaacaggcacacaccactacacctagctactttatttattttttttattttttgtagggacaggggtcccactatgttgcctaggttggtctcgaattcttggcctcaagtgatcctcctgccttagcctcacaaagcattgggattagaggtgtgagccacggcatctagccatgcttaaacatttttcatttctttttctttttttttaagacggagtttcgctcttgttgcccaggctggaatgcagtggcactatcttagctcactgcaacctccacctcctgagctcagattctcgtgcctcagccttcctagtagctaggattacaggcacctgccaccatgcctggctaattttttgtattttttttagtagagacggggtttcaccatgttggccagggtggtctcaaactcctgagctcaggcaatccgcccacctcagcctcccaaagtgctgggattacaggcatgagccaccgcggctggcccatgcttaaacatttttaacaccttccaaccatgtaaaa

SEQ ID NO: 109445 - DNA, 502 bp, Homo sapiens
  Payload ID: 1490
  Gene Symbol: ATM
  Gene Name: ATM serine/threonine kinase
  ENST ID: ENST00000529588
  CDS Start-End: 1-233
tgtgtgaagtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagagtacaactatttctagcttgagtgaaaaaagtaaagaagaaactggaataagtttacaggatcttctcttagaaatctacagaagtataggggagccagatagtttgtatggctgtggtggagggaagatg

SEQ ID NO: 109446 - DNA, 4841 bp, Homo sapiens
  Payload ID: 1490
  Gene Symbol: ATM
  Gene Name: ATM serine/threonine kinase
  ENST ID: ENST00000527805
  CDS Start-End: 734-4841
ccgcgtccgcgcttacccaatacaagccgggctacgtccgagggtaacaacatgatcaaaaccacagcaggaaccacaataaggaacaagactcaggttaaagcaaacacagcgacagctcctgcgccgcatctcctggttccagtggcggcactgaactcgcggcaatttgtcccgcctctttcgcttcacggcagccaatcgcttccgccagagaaagaaaggcgccgaaatgaaacccgcctccgttcgccttcggaactgtcgtcacttccgtcctcagacttggaggggcggggatgaggagggcggggaggacgacgagggcgaagagggtgggtgagagccccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccgcgggaggaggcgagaggagtcgggatctgcgctgcagccaccgccgcggttgatactactttgaccttccgagtgcagtgacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggaacggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaagtctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcag

SEQ ID NO: 109447 - DNA, 582 bp, Homo sapiens
  Payload ID: 1490
  Gene Symbol: ATM
  Gene Name: ATM serine/threonine kinase
  ENST ID: ENST00000601453
  CDS Start-End: 178-582
atttgctgtgtttcaggcactgtaagcatgtatatgggtccttaaagggactcatagagaggcatacatcacaatttggaattatgcattggtttatcaatttacttgtttattgtcaccctgctgcccagatatgacttcatgaggacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgct

SEQ ID NO: 109448 - DNA, 560 bp, Homo sapiens
  Payload ID: 1490
  Gene Symbol: ATM
  Gene Name: ATM serine/threonine kinase
  ENST ID: ENST00000526567
  CDS Start-End: 189-527
acttcagcctcgcggttaagagcttgggctctggaatcatacggctggaattggaattctgtcagtcgtgtggccgctctctactgtcttgtgaagataagtgagataatcttgacctgtggtgagcactcgtgagcgttagctgctgtatttaccagacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagtaagtgatgttataaattataaataaatggcttaacagat

SEQ ID NO: 109449 - DNA, 5718 bp, Homo sapiens
  Payload ID: 1490
  Gene Symbol: ATM
  Gene Name: ATM serine/threonine kinase
  ENST ID: ENST00000530958
  CDS Start-End: 4523-5029
gccgcgggaggaggcgagaggagtcgggatctgcgctgcagccaccgccgcggttgatactactttgaccttccgagtgcagtggtaggggcgcggaggcaacgcagcggcttctgcgctgggaaattcagtcgtgtgcgacccagtctgtcctctccccagaccgccaatctcatgcacccctccagagtggcccttgactcctccctctcctcactccatctttcctggcctctctccgggtgcttagcggacttggccaataacctcctccttttaaacgccctgaattgaaccctgcctcctgcgcatcctctttttgtgtcaccttagggttcagatttaactacgcgacttgactagtcatcttttgatctctctctcgtatttagtacttttagtcagcgagcatttattgatatttcaacttcagcctcgcggttaagagcttgggctctggaatcatacggctggaattggaattctgtcagtcgtgtggccgctctctactgtcttgtgaagataagtgagataatcttgacctgtggtgagcactcgtgagcgttagctgctgtatttaccaggtacagataagacaactacagtggatgataatgtatgtggtgataggggagtactctgatggtagaggagtgactttggttctctgcaaactcagcctgagactatcaattcagtttgtggtgagacctcgcagtgttaccttggcagatggtagaagccttccagatggaaggaaaaatgcgtgtaaaggcacaaagtgtagaaggaccctgaagctccagcgtgaggcctggcattgaatgaaatatattttgtgggttttcagctgctgaagtcataggaatggatgagaccaagaaaacaaagctgtttttgaggtatgagcggaagaagagatatcaggagactttcgaaacagtcataacggaagttaatatgatcattgctaacatttgctgtgtttcaggcactgtaagcatgtatatgggtccttaaagggactcatagaggtaggtactagtattgtttttccttttatcattgagaaactgaggtttgaagagattagtgaacttgctctagattatacagtttgtaagtggctgaaccaggatttgaactaatacaatctgactacagaggccacactccttagcactagaaaagaatggcatgccaagggcagagttatttctaggaagatgggatataagcgtcattgtcaagttgtgcaaaggggtcaacttggttgagatctaaaaaggaacactgaattcgtcaattcagaggctcgtaggaagtaggaaatccttatcttttcgtttgaaccttgagtggaacctagatattctggattaatgtataaatgaagttcatctttatatggtgacactcatactctagttgactacctaatagttcctctgccttctttcagttccgccaacatactgtgttctttaacattgtagaaccctttggctatgctagtctccttccctgaagtgttggtcctctagccctttttttgattggcaccagttagttcagatcttggctttattataaactcctctgagatatatgttccctgacagtttatctaaaatgattctctctacagttattttctattactgtgtttttgtttcctcagaggcatacatcacaatttggaattatgcattggtttatcaatttacttgtttattgtcaccctgctgcccagatatgacttcatgagggtaggatttgtatctgtttagttcattatttgtctagctataagtagtaaatattgtttgcatctatcagtgaatgagcatcttctgtttatgtagataatactgaactgttttgttttcttcaaagtaatcattaagctgaaggtaagaaaaacaagttcaaggaagtcacaccatggggaaaaaaaagtcaagtttagggctgcctcttccgggaagtgtcaaatctttagtatatttaggaataaaggtgccaaaccttatggttctttggatattgctaaggtattttcattggttagattaccagtttcattttccttattgactcaagagggctttaaactgagattgaagaagtaagaagattcctagataaaaccataaggaatggaaaaacaaaaatgataatacttgtccacaggaagtatataatcaaatgaaaagaactcaaataacaatctgtaatctatagcagagtaaagcggaagttgtaatagtgttgggggatgggggaagtcagaagaaccaccagtgaatataaaaggagaagagaatcagagccatctgctaataaaatgggtagtcagctctttttgttttttttgtcttgttttgttttgagacagtctcgctctgtcgcccatgctggagtgcaattgcgtgatctcagctaactgcactttccgcctcctgggttcaagtgagtctcctacctcagtctccccagtagctaggattgcaggcacatgctaccacacctggttaatttttgtatttttagtagagacggggtttcacgatgttggccaggctggctggtctcgaactcctgacctcgtggaacgcccacctcggcctcccagagtgctgggattacaggcatgagccaccacgcctagccccggtagtcagctcttactgagaatattcaaagacagggcattcattttgtaagagacattccttccttcataggaagattggacctggtcttttagttcctcccaattttgagattctgtgagattgaatcggggcagagaaacatacttaatcttgaaagattaagtagaatttagatggatggataggagaaggactttccctacctttttacttcttgagatatagttatttgtaggtataatatacataaatatatgtattttttctctgtttacagacattcatagtttaataaaaaacttctttgtattatataaaggtttagatcagaactagtaaaacagaatgctgtttctttttttttcttttctattttactttaggttctgtgggtagatgtgcgggtttgttacatgggtaaattgcatgttgctgaggcttggtgtacgaatgatcctgtcactcaggtagtgagcatagtacctgataggtagcccttcaagccatacctccctttctttccaaccctcaaacagtccccagtctctgttcttcccatctttgtgtccatgttgaaatgctgttcttactacatttttttgaaggacatcaaaagagagtttgattatatcagaagcccccaaaagaagagagctactcagtggaatcaaggcatagtaaaatatagttgatccttgatatttgcaaaggataccaccatagcatagaatttgcttcatttccttttaaaacagaaatgtcattttactcctattgttatgtgttaaataagaaccttaataccagttgagatggaagtggtagacaaagcttactagctctgataacctcctacttatcagctccaaagcatgttttaagcctttggctcagcaaaatgacatgtctctccatataagcaagagtgcttttttttttttctttgagacggagtcttgctctgtcaccaggctggagtgcagtggcgcgatctccgctcactgcaacctctgcctcctgggttcaagcgattctcctacctcagcctcctgagtagctgggactacaagagcacactaccacgcctggccaagagtgcttttaaatagttcattgtcaatgttaaatccttgagtgctcatttccttatttacctggctgttttctattcatctttcatgtctcaatttaaatgtcatgtttctttggtctcagagtaataaaaagtaaatatacttcccccatctcccgccccgcagagccttcctctgttgcccaggctggagtacagtggctcgatcttggctcactgaaagctctgcctcccagattcaagcgattctcctgcctcagcctcctgagtagctgggattacaggcgcgcgccaccaagcccggctaatttttgtatttttagtagagacagggtttcaccatgttggtcaggctggtcgaactcctgaccttgtgatcctcccaccttggcctcccaaagtgctgggattacaggcgtgagccactgcgtccagtgtaaattatacttttattttaatcctgctactactgcaagcaaggcaaacatttttgtgttacagcattacttgtatagattttaagaaaatctcattttaaatacggaaatgttaagaaaaattattgtgcctttgaccagaatgtgcctctaattgtacagttaaatctaactataaatactgcagtataaaataattatatacacattttttcacacctctttctctctatatatgcatatatacatatacatatatatacctatatgtattttttttacagacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttaggtatgttttgaaggttgttgtttgtgaatttttcctcatgaaatgaaacttcaccaaagaaagcactctgtctgtatctgtctatatcccccaagtgacctgacagtttaacagtactttagtaaaattatatggttatcgaactgacccttaatttttatttattatgtagcttttgaataaagtcatgaataatatatcaggtgcctgatatcagagccggaattacagttgaaaaataccatctccatcgtcaaggagttgacagtggcagaagaaaacccaagtaaaccagagttcataatgtgctgtgatacagacatatttgggttcagtaggtatacaaaacaatgacacctaaactcaaccatgatttaagtagaaagggagaaaaccaagagagggaagtaccataaaagtgaaagcaggcagggtgcagtggctcacgcctgtaatcctagcactttgggaggccaaggccggtggattgcttgagctcaggagttcaagaccagcctgggcaacatggtgaaactctgtctttaaaaaaatagcggaggtaatggctcttgcttgtagtcccagttacttgggaggctgaggcaggaggatcacctgagccctggaggttaaggctgcagtgagctgtgatcacactgcactccggcctccatgacagagtgagaccctgtttccattt

SEQ ID NO: 109450 - DNA, 2212 bp, Homo sapiens
  Payload ID: 1491
  Gene Symbol: ATOH1
  Gene Name: atonal bHLH transcription factor 1
  Uniprot ID: Q92858
  ENST ID: ENST00000306011
  CDS Start-End: 175-1239
ggagaagcatagttgcacgcgacctggtgtgtgatctccgagtgggtgggggagggtcgaggagggaaaaaaaaataagacgttgcagaagagacccggaaagggccttttttttggttgagctggtgtcccagtgctgcctccgatcctgagcctccgagcctttgcagtgcaatgtcccgcctgctgcatgcagaagagtgggctgaagtgaaggagttgggagaccaccatcgccagccccagccgcatcatctcccgcaaccgccgccgccgccgcagccacctgcaactttgcaggcgagagagcatcccgtctacccgcctgagctgtccctcctggacagcaccgacccacgcgcctggctggctcccactttgcagggcatctgcacggcacgcgccgcccagtatttgctacattccccggagctgggtgcctcagaggccgctgcgccccgggacgaggtggacggccggggggagctggtaaggaggagcagcggcggtgccagcagcagcaagagccccgggccggtgaaagtgcgggaacagctgtgcaagctgaaaggcggggtggtggtagacgagctgggctgcagccgccaacgggccccttccagcaaacaggtgaatggggtgcagaagcagagacggctagcagccaacgccagggagcggcgcaggatgcatgggctgaaccacgccttcgaccagctgcgcaatgttatcccgtcgttcaacaacgacaagaagctgtccaaatatgagaccctgcagatggcccaaatctacatcaacgccttgtccgagctgctacaaacgcccagcggaggggaacagccaccgccgcctccagcctcctgcaaaagcgaccaccaccaccttcgcaccgcggcctcctatgaagggggcgcgggcaacgcgaccgcagctggggctcagcaggcttccggagggagccagcggccgaccccgcccgggagttgccggactcgcttctcagccccagcttctgcgggagggtactcggtgcagctggacgctctgcacttctcgactttcgaggacagcgccctgacagcgatgatggcgcaaaagaatttgtctccttctctccccgggagcatcttgcagccagtgcaggaggaaaacagcaaaacttcgcctcggtcccacagaagcgacggggaattttccccccattcccattacagtgactcggatgaggcaagttaggaaggtgacagaagcctgaaaactgagacagaaacaaaactgccctttcccagtgcgcgggaagccccgcggttaaagatccccgcaccctttaatttttgctctgcgatggtcgttgtttagcaacgacttggcttcagatggcagctacatttgatggtttgcaaatgccgccgctgttccaaacttcctacggtccatattgtttgatgaaaactttctgttaaaattgtgtcctttccgcccaccttctgctccccctttagatagatacggtataattgtaggtacccgtatatggcatcattattctagttccctgctgccaatacgctgctaaaacgtcgcatcttctctgtcactggtttgggtttaatttattttacgccctgggcatccatccttgtgtgttgcgcactcaagtgtgggagatttagtcttccgaagttgttttccaaaatgcacaatgaaacgcaaaattagtgcttccaaagtggataacttttgactatggaattgttagaaaacaagaaactttaaggtttatatattgtataaacatacccagtatgtgcatccgatcgcgagaacgttggcgtcttttaggaaactccgcgcacgcactttatcagccgctgctgcggtggtggctccaggagaaactcaactgccaattgcagaccagtttttttttttttaaacacagccacttataattcttaagctctttgcaaatgtttgtttaaaaaatgaaaaattaaaaaaaatctagtagtgtcaaacgcatttggtcaattttattttgctttgttaatattagaaaacttatttattattgtttgctaccatttctacttatcttgattcattttttacgttttctactcgagatcattttattttaatttagcaaagccaactgcccttgtttaatgtattttgttttgcaaatgattaaaataaatgtgaaaag

SEQ ID NO: 109451 - DNA, 1480 bp, Homo sapiens
  Payload ID: 1492
  Gene Symbol: ATOH7
  Gene Name: atonal bHLH transcription factor 7
  Uniprot ID: Q8N100
  ENST ID: ENST00000373673
  CDS Start-End: 427-885
cgacagctactgcgctaaaagcgctccttccctgagcttcgggaaagagttcatcttcctgcaaaggagtctcaggctttcccagaggacttgaaaggccttcctcgaaccagccacaccaaactctgctgcagaaggtttccttctctttttcaacttcatgttgagaaaatgactttctcttgagcatctcattttcccctaaatttgggcaagtgaagagatatcagcctggtcatccagtagaacagaaggccgagtcccgcactcccccactgtaaactatttgattgcacgtgagttgctttgtttatgacttatttgctcagaagaggcacgttgggaagcggctcgagagaccagcccacgcgcaggtcctgagcgggcgggcgtgcgaggtcggcgcctcgctgcttggggccggggatgaagtcctgcaagcccagcggcccgccggcgggagcgcgcgttgcacccccgtgcgcgggcggcaccgagtgcgcgggcacgtgcgccggggccgggcggctggagagcgcggcgcgcaggcgcctggcggccaacgcgcgcgagcgccgccgcatgcaggggctcaacactgccttcgaccgcttacgcagggtggttccccagtggggccaggataaaaagctgtccaagtacgagaccctgcagatggccctgagctacatcatggctctgacccggatcctggccgaggccgagcgattcggctcggagcgggactgggtgggtctccactgtgagcacttcggccgcgaccactacctcccgttcccgggcgcgaagctgccgggcgagagcgagctgtacagccagagactcttcggcttccagcccgagcccttccagatggccacctagggcgcgcgcctccgcgggggtgggtgtccggcagccgctccgagcctcggccctgccccaagtagcccagaagcctccggcggcccaggattctaaggatgcaatcctcgaggaaaattagtcgattctcagattacctttattcgcatcatcagacctatggacgcaatcatttaattgcctttcttttcccctcctcctttgtattttgtagatttcattaatggatcttgtgaatgggttgattgctgtgaaaataatgccccctttccccttttctgggctactttgagggaaaacaatcttaagaaaaataggattaagctattctgttccagtcctcagagaaataatcactttcttaaactttgtgagtttgtcctgttcgggtgaagttacagtatccattacttgtgtttgctcacaacagagctaccttcctgttgtgtaaatgcgtttttgctttagtgcattgtgtgtgcaagcatgaagtagaaacactttttttttctgggtacagtacatgggtatcggtgctctgtatttttttaaactgtgtacacattattaaaatatacattttataaaatataaa

SEQ ID NO: 109452 - DNA, 2438 bp, Homo sapiens
  Payload ID: 1493
  Gene Symbol: ATOH8
  Gene Name: atonal bHLH transcription factor 8
  Uniprot ID: Q96SQ7
  ENST ID: ENST00000306279
  CDS Start-End: 297-1262
ctcgcgaactgggcttctgtgtaaactgaggctaaacaaacacagatggagcgcagcgggcgttctccagaaatgctggcaaggaggcagcgacttcagatgacactctgagcgctccgggaacggacagcccggcggcttcccgaagccggcggcgcagctgcccggggcgagggggagaaagggagagagggagggggagggcgggcgaagcgggagagccagagactcctcggcgctgagcgcggcggcggcccgggcagccccacgcccctgcctcgcgcgccgcccgcgccatgaagcacatcccggtcctcgaggacgggccgtggaagaccgtgtgcgtgaaggagctgaacggccttaagaagctcaagcggaaaggcaaggagccggcgcggcgcgcgaacggctataaaactttccgactggacttggaagcgcccgagccccgcgccgtagccaccaacgggctgcgggacaggacccatcggctgcagccggtcccggtaccggtgccggtgccagtcccagtggcgccggccgttcccccaagagggggcacggacacagccggggagcgcgggggctctcgggcgcccgaggtctccgacgcgcggaaacgctgcttcgccctaggcgcagtggggccaggactccccacgccgccgccgccgccgcctcctgcgccccagagccaggcacctgggggcccagaggcacagcctttccgggagccgggtctgcgtcctcgcatcttgctgtgcgcaccgcccgcgcgccccgcgccgtcagcacccccagcaccgccagcgcccccggagtccactgtgcgccctgcgcccccgacgcgccccggggaaagttcctactcgtcaatttcacacgtaatttacaataaccaccaggattcctccgcgtcgcctaggaaacgaccgggcgaagcgactgccgcctcctccgagatcaaagccctgcagcagacccggaggctcctggcgaacgccagggagcggacgcgggtgcacaccatcagcgcagccttcgaggcgctcaggaagcaggtgccgtgctactcatatgggcagaagctgtccaaactggccatcctgaggatcgcctgtaactacatcctgtccctggcgcggctggctgaccttgactacagtgccgaccacagcaacctcagcttctccgagtgtgtgcagcgctgcacccgcaccctgcaggccgagggacgtgccaagaagcgcaaggagtgactggctgcaggcaagaccaaggccaccactgtgggccctccttccagtcaggcctgaggacaaggtgagctcgctgagtccagcctcgtggtcttctccaagatgccgccagatgcccagcctacagcctctcagggtcggatcggagcacgcctgcctccctctcccctccgccctcacccagccaatccgaggctgcttcgcactttgccctctgcctggtggggaggggagagctcagcccccgactcactcagaccccaaggcccactgtccagctgcagaaattcgttgccaaagattggacagagacaccgaaggaaatggggtggtgaaaccccacagcgaaaagccacaccgttgctctgtgacttttgctcctcctgttgcctgagccccatctcaagccaaagatgagtcagtggttctgctaggaactcatggaatggatgggcatttgatgacccctgggggtcatcttggccctctgacctggtgctctctctccactgggccttgtgctggctgagtgcaagacaagccttaggggctgtgagagggaggctggggtgcctgggcggggctgggagtgggacctgagatccctgcccactctctccccttcattggctgcccaggccactggccccagttctcagtgtcccttgggtccaggctccttgggccctaagcatcaccagaagggagtaagcagggagagaagcaatattactccctcccctacaccagggacttgccccagggcagctacctatgggtctttgcttccccagccagcctctcctcactgtgacccacccccatgggcccccgtcccaggcagccagcaccatgggcaggccctgccatggacagaaaaagagtttttctcttgttcagcctgcacgtggcctgaggaaggagtagaggctgggttggctggagccgtcctactgggcaagatggcgccccacttggagggcggtggtctgttacagggtgtgcaggggcagagaaggaagggaccaggggactgggccagtatgtggaggatggggcctgcgtgttcaaagccaaggcccgccccttccttgtgctcaaatggccaaagctgttcacgtctgtgctcaaccatctgcttcaaattgaagtaaaagccccaaaatgtcaagaaaa

SEQ ID NO: 109453 - DNA, 4339 bp, Homo sapiens
  Payload ID: 1494
  Gene Symbol: ACLY
  Gene Name: ATP citrate lyase
  Uniprot ID: P53396
  ENST ID: ENST00000352035
  CDS Start-End: 132-3437
ccgggacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaagattcagtcccaagtccaagatccctgcaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcatccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagatctcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggcatactgctggc

SEQ ID NO: 109454 - DNA, 4318 bp, Homo sapiens
  Payload ID: 1494
  Gene Symbol: ACLY
  Gene Name: ATP citrate lyase
  Uniprot ID: P53396
  ENST ID: ENST00000353196
  CDS Start-End: 164-3439
agccgatgggggcggggaaaagtccggctgggccgggacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcatccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagatctcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagt

SEQ ID NO: 109455 - DNA, 3682 bp, Homo sapiens
  Payload ID: 1494
  Gene Symbol: ACLY
  Gene Name: ATP citrate lyase
  Uniprot ID: P53396
  ENST ID: ENST00000393896
  CDS Start-End: 171-3446
gcgagccgatgggggcggggaaaagtccggctgggccgggacaaaagccggatcccgggaagctaccggctgctggggtgctccggattttgcggggttcgtcgggcctgtggaagaagcgccgcgcacggacttcggcagagacaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcatccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagatctcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtg

SEQ ID NO: 109456 - DNA, 2974 bp, Homo sapiens
  Payload ID: 1494
  Gene Symbol: ACLY
  Gene Name: ATP citrate lyase
  Uniprot ID: P53396
  ENST ID: ENST00000537919
  CDS Start-End: 128-2620
gacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacaggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcatccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagatctcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatt

SEQ ID NO: 109457 - DNA, 583 bp, Homo sapiens
  Payload ID: 1494
  Gene Symbol: ACLY
  Gene Name: ATP citrate lyase
  ENST ID: ENST00000590770
  CDS Start-End: 185-583
gctggggtgctccggattttgcggggttcgtcgggcctgtggaagaagcgccgcgcacggacttcggcagagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtcc

SEQ ID NO: 109458 - DNA, 4309 bp, Homo sapiens
  Payload ID: 1494
  Gene Symbol: ACLY
  Gene Name: ATP citrate lyase
  Uniprot ID: P53396
  ENST ID: ENST00000590151
  CDS Start-End: 111-3416
agctaccggctgctggggtgctccggattttgcggggttcgtcgggcctgtggaagaagcgccgcgcacggacttcggcagagacaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaagattcagtcccaagtccaagatccctgcaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcatccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagatctcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggcat

SEQ ID NO: 109459 - DNA, 540 bp, Homo sapiens
  Payload ID: 1494
  Gene Symbol: ACLY
  Gene Name: ATP citrate lyase
  ENST ID: ENST00000592970
  CDS Start-End: 213-540
tctgccgcgcactgggccagggagtgatgattgcgtggctgacggctgggctggttagtgtttgctgttgcacgctctggcggttctctctggagttgctgcctgaaaaggctcccttgtaagacagccaagaaaacaggaagagggttggaggcaaagttccgaatagggatgaggcatacgtgacaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagccct

SEQ ID NO: 109460 - DNA, 1241 bp, Homo sapiens
  Payload ID: 1495
  Gene Symbol: ATPAF1
  Gene Name: ATP synthase mitochondrial F1 complex assembly factor 1
  ENST ID: ENST00000329231
  CDS Start-End: 37-888
ggtgccggagcgcgggcgcggcgcactcggagcgggatggagcgggcgcgcgggccgcgggccgaggccgacgcgcctgaggaggaggaggaggcgggggcggccatggctgctgtggtggtggcggctgcgggtggcgcgggaccggcggtcctgcaggtggccggtctctaccggggcctgtgcgcggtgcgcagccgcgccctgggcctggggctcgtgtcacccgcgcagctgcgcgtcttcccagtgcgccccggctcgggccggcccgaggggggcgccgacagcagcggggtcggggccgaggccgagctccaggccaaccctttctacgaccgctaccgcgacaagatccagctgctgcgcaggtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacaaatgttgctgaggcacagtgcatcgccaaccaagttcagctcttctacgctactgatcggaaagagacctacgggttagtggagacctttaacctcagaccaaatgagttcaaatatatgtctgtcatcgctgaattggagcaaagcggacttggagcagaactgaaatgtgcccagaaccaaaataagacttagaactgtacaggttggcccttcacctagttgactcagccctcgatagtctagagcccaccccctcctcaggaactcaagagctcagcatttataatgagcagttggtaatgagttgccctatgtgcttgtcgcaagcagtcacagagatgagccctattacttgatattcaggaacaaaggtacctgaacattctgataattatctcagcatacttgaggtttccttttttaagtgttcgaggttataacaagagacagccaaggacctacaagacagttgacttgattttgcacagtgtaacagcgcagttgcattctggccactttgaccttatagctcccaaatgatgagt

SEQ ID NO: 109461 - DNA, 1827 bp, Homo sapiens
  Payload ID: 1495
  Gene Symbol: ATPAF1
  Gene Name: ATP synthase mitochondrial F1 complex assembly factor 1
  ENST ID: ENST00000371937
  CDS Start-End: 37-1092
ggtgccggagcgcgggcgcggcgcactcggagcgggatggagcgggcgcgcgggccgcgggccgaggccgacgcgcctgaggaggaggaggaggcgggggcggccatggctgctgtggtggtggcggctgcgggtggcgcgggaccggcggtcctgcaggtggccggtctctaccggggcctgtgcgcggtgcgcagccgcgccctgggcctggggctcgtgtcacccgcgcagctgcgcgtcttcccagtgcgccccggctcgggccggcccgaggggggcgccgacagcagcggggtcggggccgaggccgagctccaggccaaccctttctacgaccgctaccgcgacaagatccagctgctgcgcaggtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacgggttagtggagacctttaacctcagaccaaatgagttcaaatatatgtctgtcatcgctgaattggagcaaagcggacttggagcagaactgaaatgtgcccagaaccaaaataagacttagaactgtacaggttggcccttcacctagttgactcagccctcgatagtctagagcccaccccctcctcaggaactcaagagctcagcatttataatgagcagttggtaatgagttgccctatgtgcttgtcgcaagcagtcacagagatgagccctattacttgatattcaggaacaaaggtacctgaacattctgataattatctcagcatacttgaggtttccttttttaagtgttcgaggttataacaagagacagccaaggacctacaagacagttgacttgattttgcacagtgtaacagcgcagttgcattctggccactttgaccttatagctcccaaatgatgagtttgtcatctttatgaactcatgacaggataataagcttgaagacctgctgtagttagatatgggctttaatccttcccaggcaccagtcagctgaacaaaagcataagccaaacatcctgtttaaactgtagaataaccagatattcccatcaggttaaagacttcatctagatgatgccccccagagatgcctttagtgtaagtagctggcttggggtatcagcaaatttcaggtatagttagataaacaggtacagggcctgcatactattaaaccatagtttgtggcacccgcttttctaactccacctgttagaagctatgtgtttgaaggaatgaatcagtgcagtataaataaaattcttttgtaaggagaagatt

SEQ ID NO: 109462 - DNA, 429 bp, Homo sapiens
  Payload ID: 1495
  Gene Symbol: ATPAF1
  Gene Name: ATP synthase mitochondrial F1 complex assembly factor 1
  ENST ID: ENST00000492233
  CDS Start-End: 1-342
tttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacggatgggcccagttattagccatacatagtacattgatacacctccaccagcgggtgaggaaatgatggaaaaaggagtaagaagtggccattcgttttaatcattcctcctggatttgtcctcagtccccaactgccaagtaggatgtgtcc

SEQ ID NO: 109463 - DNA, 693 bp, Homo sapiens
  Payload ID: 1495
  Gene Symbol: ATPAF1
  Gene Name: ATP synthase mitochondrial F1 complex assembly factor 1
  ENST ID: ENST00000534216
  CDS Start-End: 1-551
tggggaaacagtctgtgaacagaggattcactaaggacaagactctcagttcaatctttaacattgagatggtaaaagaaaaaactgcagaagaaataaaacaggcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacgggttagtggagacctttaacctcagaccaaatgagttcaaatatatgtctgtcatcgctgaattggagcaaagcggacttggagcagaactgaaatgtgcccagaaccaaaataagacttagaactgtacaggttggcccttcacctagttgactcagccctcgatagtctagagcccaccccctcctcaggaactcaagagctcagcatttataatgagcagttggtaatgagttgccctatgtgcttgtcgcaagcagtcac

SEQ ID NO: 109464 - DNA, 513 bp, Homo sapiens
  Payload ID: 1495
  Gene Symbol: ATPAF1
  Gene Name: ATP synthase mitochondrial F1 complex assembly factor 1
  ENST ID: ENST00000487193
  CDS Start-End: 1-259
agtgcgccccggctcgggccggcccgaggggggcgccgacagcagcggggtcggggccgaggccgagctccaggccaaccctttctacgaccgctaccgcgacaagatccagctgctgcgcaggtcagacccagctgcttttgagtcccgcctggagaaacgcagtgaatttcggaagcagccagtggggcattccaggcaaggtgattttatcaaatgtgtggaacagaaggatggtgcacagaacaaactggtgtaggagaggccagcgccagggagaatatggagtaatccaggtgtgggctgcagaagcctgaattaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctgga

SEQ ID NO: 109465 - DNA, 998 bp, Homo sapiens
  Payload ID: 1495
  Gene Symbol: ATPAF1
  Gene Name: ATP synthase mitochondrial F1 complex assembly factor 1
  Uniprot ID: Q5TC12
  ENST ID: ENST00000532925
  CDS Start-End: 208-930
agatgctaaatcttctgcaaaataggctacctaaagcctctgaatcaccaggatctgaataaagcagatgtttaacctggttggggggacatattttcaagaactggatgtattcaagtaaaagcttgacacctagtaaggaggctataggattcttgtctgaagaggtgatccagcaagatgacctcaaaattctaagtaccctgaatgtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacgggttagtggagacctttaacctcagaccaaatgagttcaaatatatgtctgtcatcgctgaattggagcaaagcggacttggagcagaactgaaatgtgcccagaaccaaaataagacttagaactgtacaggttggcccttcacctagttgactcagccctcgatagtctagagcccaccccctcctca

SEQ ID NO: 109466 - DNA, 1471 bp, Homo sapiens
  Payload ID: 1495
  Gene Symbol: ATPAF1
  Gene Name: ATP synthase mitochondrial F1 complex assembly factor 1
  ENST ID: ENST00000529214
  CDS Start-End: 208-345
agatgctaaatcttctgcaaaataggctacctaaagcctctgaatcaccaggatctgaataaagcagatgtttaacctggttggggggacatattttcaagaactggatgtattcaagtaaaagcttgacacctagtaaggaggctataggattcttgtctgaagaggtgatccagcaagatgacctcaaaattctaagtaccctgaatgtcagacccagctgcttttgagtcccgcctggagaaacgcagtgaatttcggaagcagccagtggggcattccaggcaaggtgattttatcaaatgtgtggaacagaaggatggtgcacagaacaaactggtgtaggagaggccagcgccagggagaatatggagtaatccaggtgtgggctgcagaagcctgaattaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacgggttagtggagacctttaacctcagaccaaatgagttcaaatatatgtctgtcatcgctgaattggagcaaagcggacttggagcagaactgaaatgtgcccagaaccaaaataagacttagaactgtacaggttggcccttcacctagttgactcagccctcgatagtctagagcccaccccctcctcaggaactcaagagctcagcatttataatgagcagttggtaatgagttgccctatgtgcttgtcgcaagcagtcacagagatgagccctattacttgatattcaggaacaaaggtacctgaacattctgataattatctcagcatacttgaggtttccttttttaagtgttcgaggttataacaagagacagccaaggacctacaagacagttgacttgattttgcacagtgtaacagcgcagttgcattctggccactttgaccttatagctcccaaatgatgagtttgtcatctttatgaactcatgacaggataataagcttgaagacctgctgtagttagatatgggctttaatccttcccaggcaccagtcagctgaac

SEQ ID NO: 109467 - DNA, 1222 bp, Homo sapiens
  Payload ID: 1495
  Gene Symbol: ATPAF1
  Gene Name: ATP synthase mitochondrial F1 complex assembly factor 1
  ENST ID: ENST00000526821
  CDS Start-End: 1-525
ctgatcaggtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacaaatgttgctgaggcacagtgcatcgccaaccaagttcagctcttctacgctactgatcggaaagagacctacgggttagtggagacctttaacctcagaccaaatgagttcaaatatatgtctgtcatcgctgaattggagcaaagcggacttggagcagaactgaaatgtgcccagaaccaaaataagacttagaactgtacaggttggcccttcacctagttgactcagccctcgatagtctagagcccaccccctcctcaggaactcaagagctcagcatttataatgagcagttggtaatgagttgccctatgtgcttgtcgcaagcagtcacagagatgagccctattacttgatattcaggaacaaaggtacctgaacattctgataattatctcagcatacttgaggtttccttttttaagtgttcgaggttataacaagagacagccaaggacctacaagacagttgacttgattttgcacagtgtaacagcgcagttgcattctggccactttgaccttatagctcccaaatgatgagtttgtcatctttatgaactcatgacaggataataagcttgaagacctgctgtagttagatatgggctttaatccttcccaggcaccagtcagctgaacaaaagcataagccaaacatcctgtttaaactgtagaataaccagatattcccatcaggttaaagacttcatctagatgatgccccccagagatgcctttagtgtaagtagctggcttggggtatcagcaaatttcaggtatagttagataaacaggtacagggcctgcatactattaaaccatagtttgtggcacccgcttttctaactccacctgttagaagctatgtgtttgaaggaatgaatca

SEQ ID NO: 109468 - DNA, 1779 bp, Homo sapiens
  Payload ID: 1495
  Gene Symbol: ATPAF1
  Gene Name: ATP synthase mitochondrial F1 complex assembly factor 1
  Uniprot ID: Q5TC12
  ENST ID: ENST00000542495
  CDS Start-End: 511-1044
gagggtaggttagggagatactcagatgctaaatcttctgcaaaataggctacctaaagcctctgaatcaccaggatctgaataaagcagatgtttaacctggttggggggacatattttcaagaactggatgtattcaagtaaaagcttgacacctagtaaggaggctataggattcttgtctgaagaggtgatccagcaagatgacctcaaaattctaagtaccctgaatgtcagacccagctgcttttgagtcccgcctggagaaacgcagtgaatttcggaagcagccagtggggcattccaggcaaggtgattttatcaaatgtgtggaacagaaggatggtgcacagaacaaactggtgtaggagaggccagcgccagggagaatatggagtaatccaggtgtgggctgcagaagcctgaattaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacgggttagtggagacctttaacctcagaccaaatgagttcaaatatatgtctgtcatcgctgaattggagcaaagcggacttggagcagaactgaaatgtgcccagaaccaaaataagacttagaactgtacaggttggcccttcacctagttgactcagccctcgatagtctagagcccaccccctcctcaggaactcaagagctcagcatttataatgagcagttggtaatgagttgccctatgtgcttgtcgcaagcagtcacagagatgagccctattacttgatattcaggaacaaaggtacctgaacattctgataattatctcagcatacttgaggtttccttttttaagtgttcgaggttataacaagagacagccaaggacctacaagacagttgacttgattttgcacagtgtaacagcgcagttgcattctggccactttgaccttatagctcccaaatgatgagtttgtcatctttatgaactcatgacaggataataagcttgaagacctgctgtagttagatatgggctttaatccttcccaggcaccagtcagctgaacaaaagcataagccaaacatcctgtttaaactgtagaataaccagatattcccatcaggttaaagacttcatctagatgatgccccccagagatgcctttagtgtaagtagctggcttggggtatcagcaaatttcaggtatagttagataaacaggtacagggcctgcatactattaaaccatagtttgtggcacccgcttttctaactccacctgttagaagctatgtgtttgaaggaatgaatcagtgcagtataaataaaattcttttgtaaggagaagatt

SEQ ID NO: 109469 - DNA, 1760 bp, Homo sapiens
  Payload ID: 1495
  Gene Symbol: ATPAF1
  Gene Name: ATP synthase mitochondrial F1 complex assembly factor 1
  Uniprot ID: Q5TC12
  ENST ID: ENST00000574428
  CDS Start-End: 43-1029
gaggccgacgcgcctgaggaggaggaggaggcgggggcggccatggctgctgtggtggtggcggctgcgggtggcgcgggaccggcggtcctgcaggtggccggtctctaccggggcctgtgcgcggtgcgcagccgcgccctgggcctggggctcgtgtcacccgcgcagctgcgcgtcttcccagtgcgccccggctcgggccggcccgaggggggcgccgacagcagcggggtcggggccgaggccgagctccaggccaaccctttctacgaccgctaccgcgacaagatccagctgctgcgcaggtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacgggttagtggagacctttaacctcagaccaaatgagttcaaatatatgtctgtcatcgctgaattggagcaaagcggacttggagcagaactgaaatgtgcccagaaccaaaataagacttagaactgtacaggttggcccttcacctagttgactcagccctcgatagtctagagcccaccccctcctcaggaactcaagagctcagcatttataatgagcagttggtaatgagttgccctatgtgcttgtcgcaagcagtcacagagatgagccctattacttgatattcaggaacaaaggtacctgaacattctgataattatctcagcatacttgaggtttccttttttaagtgttcgaggttataacaagagacagccaaggacctacaagacagttgacttgattttgcacagtgtaacagcgcagttgcattctggccactttgaccttatagctcccaaatgatgagtttgtcatctttatgaactcatgacaggataataagcttgaagacctgctgtagttagatatgggctttaatccttcccaggcaccagtcagctgaacaaaagcataagccaaacatcctgtttaaactgtagaataaccagatattcccatcaggttaaagacttcatctagatgatgccccccagagatgcctttagtgtaagtagctggcttggggtatcagcaaatttcaggtatagttagataaacaggtacagggcctgcatactattaaaccatagtttgtggcacccgcttttctaactccacctgttagaagctatgtgtttgaaggaatgaatcagtgcagtataaataaaattcttttgtaaggagaa

SEQ ID NO: 109470 - DNA, 4158 bp, Homo sapiens
  Payload ID: 1495
  Gene Symbol: ATPAF1
  Gene Name: ATP synthase mitochondrial F1 complex assembly factor 1
  ENST ID: ENST00000576409
  CDS Start-End: 64-1119
cccggaaccttgggcgcgcggaacctcggtgccggagcgcgggcgcggcgcactcggagcgggatggagcgggcgcgcgggccgcgggccgaggccgacgcgcctgaggaggaggaggaggcgggggcggccatggctgctgtggtggtggcggctgcgggtggcgcgggaccggcggtcctgcaggtggccggtctctaccggggcctgtgcgcggtgcgcagccgcgccctgggcctggggctcgtgtcacccgcgcagctgcgcgtcttcccagtgcgccccggctcgggccggcccgaggggggcgccgacagcagcggggtcggggccgaggccgagctccaggccaaccctttctacgaccgctaccgcgacaagatccagctgctgcgcaggtcagacccagctgcttttgagtcccgcctggagaaacgcagtgaatttcggaagcagccagtggggcattccaggcaaggtgattttatcaaatgtgtggaacagaagacagatgccttggggaaacagtctgtgaacagaggattcactaaggacaagactctcagttcaatctttaacattgagatggtaaaagaaaaaactgcagaagaaataaaacagatttggcagcaatattttgcagcaaaagatacagtctacgcagttattcctgcagaaaagtttgatttgatctggaaccgggctcagtcctgtccaacatttctatgtgctctgccaagaagggaaggttatgagttttttgtaggacaatggacaggtactgaactccacttcactgcacttataaatattcagacccgaggggaagctgcagccagccagctgattttatatcactatcctgaacttaaggaagaaaagggcatagtgctgatgactgcagaaatggattccacatttctgaatgttgctgaggcacagtgcatcgccaaccaagttcagctcttctacgctactgatcggaaagagacctacgggttagtggagacctttaacctcagaccaaatgagttcaaatatatgtctgtcatcgctgaattggagcaaagcggacttggagcagaactgaaatgtgcccagaaccaaaataagacttagaactgtacaggttggcccttcacctagttgactcagccctcgatagtctagagcccaccccctcctcaggaactcaagagctcagcatttataatgagcagttggtaatgagttgccctatgtgcttgtcgcaagcagtcacagagatgagccctattacttgatattcaggaacaaaggtacctgaacattctgataattatctcagcatacttgaggtttccttttttaagtgttcgaggttataacaagagacagccaaggacctacaagacagttgacttgattttgcacagtgtaacagcgcagttgcattctggccactttgaccttatagctcccaaatgatgagtttgtcatctttatgaactcatgacaggataataagcttgaagacctgctgtagttagatatgggctttaatccttcccaggcaccagtcagctgaacaaaagcataagccaaacatcctgtttaaactgtagaataaccagatattcccatcaggttaaagacttcatctagatgatgccccccagagatgcctttagtgtaagtagctggcttggggtatcagcaaatttcaggtatagttagataaacaggtacagggcctgcatactattaaaccatagtttgtggcacccgcttttctaactccacctgttagaagctatgtgtttgaaggaatgaatcagtgcagtataaataaaattcttttgtaaggagaagattaatcctggtttgcatgatttttttaaaaacaactctaaacatgatacgaaaaagtggatgaaagcaaatgttcccagattggatgtggggaaaatatagcaataattttttttttaagtctggcttacaatgtttgttatacaaaataatgaaatctgagttatgtactgtccattgtgtcagggctatgggctgattttatcaaaactcatcttgggactgaaaaattgtttggaatgccagaaataagaaagttgttctccagagctggaaacccatctttcgtttgtagtgtcactgttgtggctccaagctcagtgataggaaaggacggtggttacacaccagccttctgaacccaaggcccccagtattgttgtcagctgcctttaccatggcatttctttctctttctttttttcctgagatgaagtcttgctctgtcttgcccaggctggagtacagtagcgtgatctcagctcgctgcaacctctacctccctggttcaagtgattctgctgcgtcagcctcctgaggagctaggattacaggcgcatgccaccatacctggcttatttttgtattgttgtagagacagggtttcactttgttggccaggctggctggtctcgaactcctggcctcaagtgatccaccaccttggcctcccaaagtgctgggattacaggtgtgagccaccgtgcctggcctgacatttctttattgatctaacatgctccactctgctgctcctgcctaagatctggttatatgacactgaatgtggtgagtgggaatttaagcagtattcgcagtttgtgtgtgtgtgttttcttccttccagaagaatttttataggttgggcctgtccctaagctctttaaatagggtggacatcccactattctctgagccgtgtctattttgttgcacctttgagtctatgtattgagagagacagatagtatttttttaaactggggaagctgctatcctttcactatttctctaaaggttgagctgttaactaatgtaaattctggacctgcttctggtcctggcagtttatcttttgagaaacttgagtcttatctgccctgccattttcattaaatgccttctgaccttctgaatgttttgggtcccaagaatttttgacatcagatggggttgtttttattggtatccagttatgtttgcttgtctttccagatgggcccagttattagccatacatagtacattgatacacctccaccagcgggtgaggaaatgatggaaaaaggagtaagaagtggccattcgttttaatcattcctcctggatttgtcctcagtccccaactgccaagtaggatgtgtccatggataaatgtgtggggcatgactaaagtaccacgtagctgttctttatatttatttacctagaaagatctggcaaagaactcaaagaaaattgtaccatttaatcagtaaatttgtcccctggtgctagcatggtgttatagaaagtggacaggctttagagttaagtgaatctgggttcatatgttagtgttgctattcattagctctatactgttgaacaaattgcttaaactatctaattttggggttttttttccatctaaaatagggataataatatctacctcataggattattgtgagaattaaattaacttcactatagtagaaaatatcaactaccatccttttctctacttcccttgcccctcattaaagactaatacaagttagcatttcagatgtgtagatcattctttattccagttaaaagaacaaactttatctcatcagttctgaaactttaagatgcagtagcatcacctaaagtgcttttaaaatgcagattctcaggcctcaaccgtacaccacccccccacacacgtactaaatcaagaatatgtgcagaaggtactgggaatctacttgttaatatgtgctccaaatgattctgatgtaggtaattagccagccacactttgagaaccactgccttatctattctttacaaaaatgtacattgccaggtctttctttcctgtggatgctaactataggatatttaggttcctctgttctttgtctcccatagtggccccctttgcaaactccaaatacattatatttatttattcttgtgtcttttttcccccactagactgtgagctccttgagggccaggacttatctctgttcgcagtgccaaggacatggcctggaccatagaagatactcagttttttgttgaataaataggtaatatggatttcaaccaaaa

SEQ ID NO: 109471 - DNA, 685 bp, Homo sapiens
  Payload ID: 1496
  Gene Symbol: ATPAF2
  Gene Name: ATP synthase mitochondrial F1 complex assembly factor 2
  ENST ID: ENST00000444058
  CDS Start-End: 70-685
gcgcaggaggcgcgcggcggcgacggcgcgccgtttcgcgtctcgcatcttcccagaccctcgggcgcgatgtggaggagctgcctccggctgcgggacgggggacgccgtctcctgaatcggccggcgggtggccccagcgcttctatgagtccggggccaaccatcccgtctccagcccgggcttacgccccgccgacagaaaggaagaggttttatcagaatgtcagcatcacacagggtgaaggtggctttgagataaacctggaccacaggaagctgaaaactccccaagccaagctctttaccgtccccagcgaggccctggccattgcagtggctactgagtgggattcccagcaggataccatcaagtactacaccatgcacctgaccacattgtgcaacacatcattggacaacccaacccagagaaacaaggatcagctgatccgggcagccgtgaagtttctggacaccgacaccatctgctacagggtggaggagcccgagacattagtggaacttcaaaggaatgagtgggatccaatcatcgaatgggctgagaaaagatacggcgtggagatcagctcctccaccagcataatgggacccagcatccctgccaaaactcgggaggtgctcgtcagccacctggcatcttacaacacatgggctttacaag

SEQ ID NO: 109472 - DNA, 1564 bp, Homo sapiens
  Payload ID: 1496
  Gene Symbol: ATPAF2
  Gene Name: ATP synthase mitochondrial F1 complex assembly factor 2
  Uniprot ID: Q8N5M1
  ENST ID: ENST00000474627
  CDS Start-End: 156-1025
atgcggaagatggcggcgtccaagggaggttgagggctctgaggaggcgttgagaggtttccgtacagcccgaccgtgcggctttggggatcccatcgctctgtgtttcctgctccaggtttcgcgtctcgcatcttcccagaccctcgggcgcgatgtggaggagctgcctccggctgcgggacgggggacgccgtctcctgaatcggccggcgggtggccccagcgcttctatgagtccggggccaaccatcccgtctccagcccgggcttacgccccgccgacagaaaggaagaggttttatcagaatgtcagcatcacacagggtgaaggtggctttgagataaacctggaccacaggaagctgaaaactccccaagccaagctctttaccgtccccagcgaggccctggccattgcagtggctactgagtgggattcccagcaggataccatcaagtactacaccatgcacctgaccacattgtgcaacacatcattggacaacccaacccagagaaacaaggatcagctgatccgggcagccgtgaagtttctggacaccgacaccatctgctacagggtggaggagcccgagacattagtggaacttcaaaggaatgagtgggatccaatcatcgaatgggctgagaaaagatacggcgtggagatcagctcctccaccagcataatgggacccagcatccctgccaaaactcgggaggtgctcgtcagccacctggcatcttacaacacatgggctttacaagggattgagtttgtagctgcccagctcaagtccatggtgctaaccttgggcctgattgacctgcgcctgacagtggagcaggccgtgctgctgtcacgcctggaggaggagtaccagatccagaagtggggcaacattgagtgggcccatgactatgagctgcaggagctgcgggcccgcaccgccgccggcaccctcttcatccatctctgctccgagagcaccacagtcaagcacaagctcctgaaggagtgaggcctgggcagagcacactcagcaggatagaggcagtgcagccacagctcccccggccttcagggctccccagcctgtggggctggcttccttggcttttggggactcggcctcagcgtcaccctgagattccccccgagacacagtgcgctagtacggctgtccggaggtcagcctgatttcaacccaggtgcccctggcctggccagcagtgaatgtaggagatgaattgtgcaagtgactttctctcgactctgattttattaaatatttctccaccctggaaatgtgctgagccctgttttcacgtatgcctctgcacttctccattcttcctgttttgtctaggttccagagggttaaacagcttatctcccatggcgtgtttggatatctgctgcctgtggtcaggaaccttgcactggggaaacaatcatgtaatccacagacaactctatttgtgttcttcagcctcagcctgaaggcttttttttggctggcttttaatcaaacaatcttttgaaacaattgtggtctaa

SEQ ID NO: 109473 - DNA, 1298 bp, Homo sapiens
  Payload ID: 1496
  Gene Symbol: ATPAF2
  Gene Name: ATP synthase mitochondrial F1 complex assembly factor 2
  ENST ID: ENST00000584205
  CDS Start-End: 156-479
atgcggaagatggcggcgtccaagggaggttgagggctctgaggaggcgttgagaggtttccgtacagcccgaccgtgcggctttggggatcccatcgctctgtgtttcctgctccaggtttcgcgtctcgcatcttcccagaccctcgggcgcgatgtggaggagctgcctccggctgcgggacgggggacgccgtctcctgaatcggccggcgggtggccccagcgcttctatgagtccggggccaaccatcccgtctccagcccgggcttacgccccgccgacagaaaggaagaggttttatcagaatgtcagcatcacacagggtgaagaccacattgtgcaacacatcattggacaacccaacccagagaaacaaggatcagctgatccgggcagccgtgaagtttctggacaccgacaccatctgctacagggtggaggagcccgagacattagtggaacttcaaaggaatgagtgggatccaatcatcgaatgggctgagaaaagcttcctgaagccacctctcaaaccagccacctgcgtgcaagtccctgccttacctctgcttccagccagtttggggccagcttctcttacctgcaggacaccggcttcttgtctccttgtgccttgactatgggggtgtgtgctggtcactccaaagggaccacatctcgtctgtctctgttcccagtgagcacaggacatacgcccaacactaacagaatccggagcgtcgtggatattcaaatgatgaagacactaagtatgacgctttacaaacatctgtgctgctcctatgccttgtaacccaggtaggccctaatgctgatgtgggaacctcgaccgtggactttgcatggaatcctggggcttgaagatggagcagagaaagccagggagggcccaccctggccaccacccctgaaccttggatacatactccgaaagtccagctgcagggacaggacatccttgaagaggatgccctcctgcttggccagctgcccggcctcctcctgggggccctggtccccgacggccagcttgagcatgtcatcgtccatcaccctcggctccatcgagttgcacggctggttcatcttcccccacgttttccctaaaaaacaccgcattcttccttcacggcctgcttctttctctgtttgagggcagggtctggctgaggtttccccctgtagtgtcttgtggccactggcactctgaggaatgccccacgcccagccctgggtctgctgcatctcggggtttgtatacttacgccaaggctgc

SEQ ID NO: 109474 - DNA, 566 bp, Homo sapiens
  Payload ID: 1496
  Gene Symbol: ATPAF2
  Gene Name: ATP synthase mitochondrial F1 complex assembly factor 2
  ENST ID: ENST00000585101
  CDS Start-End: 156-479
atgcggaagatggcggcgtccaagggaggttgagggctctgaggaggcgttgagaggtttccgtacagcccgaccgtgcggctttggggatcccatcgctctgtgtttcctgctccaggtttcgcgtctcgcatcttcccagaccctcgggcgcgatgtggaggagctgcctccggctgcgggacgggggacgccgtctcctgaatcggccggcgggtggccccagcgcttctatgagtccggggccaaccatcccgtctccagcccgggcttacgccccgccgacagaaaggaagaggttttatcagaatgtcagcatcacacagggtgaagaccacattgtgcaacacatcattggacaacccaacccagagaaacaaggatcagctgatccgggcagccgtgaagtttctggacaccgacaccatctgctacagggtggaggagcccgagacattagtggaacttcaaaggaatgagtgggatccaatcatcgaatgggctgagaaaagggaggatttccatgtcagctagaaaagttcatccagcctgctaggatggcttgg

SEQ ID NO: 109475 - DNA, 1737 bp, Homo sapiens
  Payload ID: 1496
  Gene Symbol: ATPAF2
  Gene Name: ATP synthase mitochondrial F1 complex assembly factor 2
  ENST ID: ENST00000462733
  CDS Start-End: 63-386
catcgctctgtgtttcctgctccaggtttcgcgtctcgcatcttcccagaccctcgggcgcgatgtggaggagctgcctccggctgcgggacgggggacgccgtctcctgaatcggccggcgggtggccccagcgcttctatgagtccggggccaaccatcccgtctccagcccgggcttacgccccgccgacagaaaggaagaggttttatcagaatgtcagcatcacacagggtgaagaccacattgtgcaacacatcattggacaacccaacccagagaaacaaggatcagctgatccgggcagccgtgaagtttctggacaccgacaccatctgctacagggtggaggagcccgagacattagtggaacttcaaaggaatgagtgggatccaatcatcgaatgggctgagaaaagggattgagtttgtagctgcccagctcaagtccatggtgctaaccttgggcctgattgacctgcgcctgacagtggagcaggccgtgctgctgtcacgcctggaggaggagtaccagggaggatttccatgtcagctagaaaagttcatccagcctgctaggatggcttgggattgactcaccctgtctattaaacgtgtacaccaagagttgattctggtcaccagctcatcttctcgattgtcaatcttcaggaggtggatgtcgtgcgatgccccgacagcattaacaatcgtatctttatcgacaaaaagctggtgagtgaaaagaatccaatgagaaagtgtgtgtcattataccgtgaacacaaagggagctgaacagagaaggagcatttggaagtcccctggctgtgcaggccacactcagagcagagcccacctttgtatcagcgcactctgccgattcatctgtgaattcatctgtgacagccgcttccccaactgcacagggcaggtgttgtggggaaagggccaaccagggtgttactttgcagtccccgctggaagcatgtttcctccagggtgaaggcagatggctgcccagggggcacctcacccaggacatctgttctcacaatgcttctctctcaattactctcaagtctaacttgcccaaaacctctgcctgctgggtggaagcatgaggctggctgagggtctcgaggctgctctgaagacagcaggccctacaaactcatgggtgttcaccccacagttgtctctccactgccactcatgtcaacaaaaccaaactttggattccatttggagtatccttctgccttctcttgttcctgactttgctgtcttgtaaaaagttgttagaaacaaccaccttctaataggcctcactggttctaggtgttgacactgtggctattgttgcctgggatggttgaaatggagtcatttcccagagcagggcaaggccactgaagcactcagtaagcagttgcttccaccttgaagcagaggcgcttggtaaggcagagcacctgaatgctctgtattgcagggaggatttgcaagtggagtgtgcattttttgttctttcctgtagtggcagttaacttaatggtctctaaaacgttctgtgcaatcttaagatgttaatatttctgccaaaaaaagtattctttggtcaaatacatttgggaaagccagcacatcctaggcccctcctaaagatttgctgggcacaaagtattctgaaggctctacaaagtcctgtggaaaataaaccctttaagctttgtc

SEQ ID NO: 109476 - DNA, 471 bp, Homo sapiens
  Payload ID: 1496
  Gene Symbol: ATPAF2
  Gene Name: ATP synthase mitochondrial F1 complex assembly factor 2
  ENST ID: ENST00000581698
  CDS Start-End: 1-178
acttcaaaggaatgagtgggatccaatcatcgaatgggctgagaaaagatccagaagtggggcaacattgagtgggcccatgactatgagctgcaggagctgcgggcccgcaccgccgccggcaccctcttcatccatctctgctccgagagcaccacagtcaagcacaagctcctgaaggagtgaggcctgggcagagcacactcagcaggatagaggcagtgcagccacagctcccccggccttcagggctccccagcctgtggggctggcttccttggcttttggggactcggcctcagcgtcaccctgagattccccccgagacacagtgcgctagtacggctgtccggaggtcagcctgatttcaacccaggtgcccctggcctggccagcagtgaatgtaggagatgaattgtgcaagtgactttctctcgactctgattttattaaatatttctccaccctgga

SEQ ID NO: 109477 - DNA, 1945 bp, Homo sapiens
  Payload ID: 1497
  Gene Symbol: ATP5A1
  Gene Name: ATP synthase, H+ transporting, mitochondrial F1 complex, alpha subunit 1, cardiac muscle
  Uniprot ID: P25705
  ENST ID: ENST00000282050
  CDS Start-End: 146-1807
tctggcattgcaagcctcgcttcgttgccacttcccagctcttcccgccttccgcggtataatcaacactacgagagatagagccgcctagaaccagtccggaggctgcggctgcagaagtaccgcctgcggagtaactgcaaagatgctgtccgtgcgcgttgctgcggccgtggtccgcgcccttcctcggcgggccggactggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgcatagtt

SEQ ID NO: 109478 - DNA, 5818 bp, Homo sapiens
  Payload ID: 1497
  Gene Symbol: ATP5A1
  Gene Name: ATP synthase, H+ transporting, mitochondrial F1 complex, alpha subunit 1, cardiac muscle
  Uniprot ID: P25705
  ENST ID: ENST00000398752
  CDS Start-End: 123-1784
ggggcagtacttccgggtcaggtgggccggctgtcttgaccttctttgcggctcggccattttgtcccagtcagtccggaggctgcggctgcagaagtaccgcctgcggagtaactgcaaagatgctgtccgtgcgcgttgctgcggccgtggtccgcgcccttcctcggcgggccggactggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgcatagttgttttctgtcatttgtgttattctttaaaaccaagatcaaattgagaaattggtaagcaaatgcttcttgatctattttacttgaatattggtacagtcaactgggctagataattcaaggctgagctctttgtaagttttttttttgtttttttttttgagactgattctcactctgtcactgaggctggagtgcagtggcaccctgtcggcccactgcaacctccgtctccgggttcaagcaattctcttgcctcagcctcccacgtagctgggattacaggtgcccaccaccacgcctggctagttttttagtatttttagtagagacggggtttcaccatgttggccaggccggtcacgaactcctgacctcaggtgatccacctgccttggcctacctaccacagtgctgggattacaggtgtgagccaccgcacccggctgctctttgtaagtttctagagtactttgtgtttaagagaaattcctaaactggatatatgtggcaggctgacaatactgaagagcatagctggcttctctgcccagaggatgtacctgcataaagaggtactgtaggcaggaaaataataggacagttaaaattctcagggaaatgaaaaaattgctggaacaaaagctgagaagatagaatgcataggattatgaaaacttgtcaatatctcttttgtttgttttgtgacagggtctccatctctctcacccaggctggagtacagtggtgtgatctcagctcactgcagcttctgccacctgggttcaattgattcttccacctcagcctcctgagtagctggggttacaggcacataccaccacgcccagccaatttttctactttttgtagagggagggtcttgccatgttgtccaggctgatgatgaactccttggctcaagtgatcctcctgccttggtctcccaaagtgctgggattacaggtgtgaactaccatgcccggccatcttttaatattttcacagctactttatttcctctgttactagcttttcatagcctttgctcattcttactgcattaaattttttttactgatttatttatttttttgagacagagtcttgctctgtcacctaggctggagagcagtggcgtaatctcagctcactgcacctttcacctcctgggttcaagcgattctcctgccttagcctcccaattagctgggaccacaggcccatgccaccacacccggctaacattttgtatttttagtagagacaaggtttcaccatgttggccatgctgctcttgagctcctgacctcgtggtctgcccgcctcagcttcccaaagtgctgggattacaggtgtgagccaccacgcccagcctactgatttatttatttacttttaatttttcatagcctttgctcattcttaatgtgttacctttttttttacttagttatttatttatttgagatggagtctccgtcgtccaggctggagtgcagtgacctgatcttggctcactgcaacctctgcctccaggttcaagcaattctcctgcctcagcctcccgagaagctggaactacaggcacccaccaccatgccctgctaatttttgtatttttagtagaggcggggtttcaccatattggccaggctggtctcgaactcctgaccttgtgatctgcctgccttggcctcccacagtgctgggattacaggtgtgagccaccacacctggccttttttttttttttttgagacggagtctcactgtctcccaggctggagtgcagtggtgcgatgtcggctcactgcaagctctgccccctgggtttgcgccgttctcctgcctcagcctcccgattagctggtactacaggcgcctgccatcacgcccagctaatttttttttttttgtatttttagtagagacggggtttcaccatgttcgccaggatggtctcgatctcctgacctcatgatccacttacctcggcctcccaaagtgctgggattacaggcttgagccaccgcgcccggcctcttttttttttttttttttttactgatatataaaggcttttgtctgtaagggtcatacatggtcatgttctaaaatatttttcctagggttcccccttccttgccattttattttgttgatggggatttgctgtaccgaaacttcattcttatccatctctctgtctccagtaagtcaaaatatatttacatatgtgggctccaatatctttggtaggaaaaggagagttcttaaagtactcataagtccttttcagtacttagaggaacactaaacttgatagcagttggtcatttctgatcaactcttgctttctagctacttgagaaataacttctagatctgattttccttttctgaaataaggaagttacttttagttagaaggttctgcacatttcgttttttttttttttttttttttttgttttttttttttgagagttttgctcttgttgcccaggctggagtgcaatggcacgatctcggctcaccacaaccaccgcctcctggggtcaagcaattctcctgcctcaggctcctgagtagctgggattacaggcatgcaccaccacgcctggctaattttgtatttttagtagagatggggtttctccatgttggtcaggctggtctcaaactcctgaccttaggtggtccaccggcctcccaaagtactgggattacaggggtgagccactgcgcccggcttgttggagcattttatacctagtgtcagtggtgattactactttggagaaaaatactttggctaatggattggaattaatttattactgggagtatgtattgtttgtttgttgactggatctcgtagcccactcctggcacgtaaatgctcaataaacttctcaaatgaagacaaccatgtttgtccattataaatcaaattccaaatgttaactactggtctggtctgatgagatttttttttttttttttttttttgagacggagttttgtttttgttgcccaggctggagtgcaatggcgcgatctcggctcactgcaacctccacctcctgggttcaagtgattctcctacctcagcctcctgagtagctgtgattataggtgtgcaccaccatgcctggctaatttttgtatttttagtagagacggggtttcaccatgttggccaggctggtttcgaactcctgaccttagatgatccacgtgcctcgacctcctaaagtgctgggattacaggcgtgagccactgtgcctggcccacgccaggcacagtgatatttaaaaatgtgatttttaaatatcacatttaaaaatatgtgatatttttaaagaatatgatagcccaggcgcagtggcttacgcctgtaatctcagcactttgggacgatcacttgagcccaggagtttgaaacaggctgcagtcagctatgatcacgccactgcactccagcctaggtgacagagaccctgactcttaaaaaaagttgtgctagaagacttcaagatctcccctaaaactgtatagtcctttccctggtgtttttgctgagctatagagtccagccctttctgttacagcaatgaaccatgagattcaaatactgctttttactaagtacttacagactaatgacataggagacctcataggcacctggctgtttttaaccaggcaggcctaaatacactgcccaagtggcccttctgtgtggcaacaaaatggctgtcataaaattgtgtctgtgtgcatttatcttatcactgggggtggtgaacatttgagaaggcacttgacctttgaaatgtgaagttttatggatttcagacttgtattttaaaaactatttgttaactgtaa

SEQ ID NO: 109479 - DNA, 807 bp, Homo sapiens
  Payload ID: 1497
  Gene Symbol: ATP5A1
  Gene Name: ATP synthase, H+ transporting, mitochondrial F1 complex, alpha subunit 1, cardiac muscle
  ENST ID: ENST00000590324
  CDS Start-End: 374-807
tctggcattgcaagcctcgcttcgttgccacttcccagctcttcccgccttccgcggtataatcaacactacgagagatagagccgcctagaaccaggtctccagaaatgctttgggttcatctttcattgctgcaaggaacttccatgcctctaacactcatcttcaaaagactgtagagatgggattttgctgtgttggccaggctggtccaaactcttggcctcaagtggtccgcccgcctcccaaagtgctggtattactggcgtgagccactgcacccaacccctgtatgctaagatgaagaataccacctatactaccctgtgtgccttgaaagagaaagacacactttgttaacaggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagggtccaattggttccaagacgcgtaggcgagttggtctgaaagcccccggtatcattcctcgaatttcagtgcgggaaccaatgcagactggcattaaggc

SEQ ID NO: 109480 - DNA, 2258 bp, Homo sapiens
  Payload ID: 1497
  Gene Symbol: ATP5A1
  Gene Name: ATP synthase, H+ transporting, mitochondrial F1 complex, alpha subunit 1, cardiac muscle
  Uniprot ID: P25705
  ENST ID: ENST00000593152
  CDS Start-End: 609-2120
ggggcagtacttccgggtcaggtgggccggctgtcttgaccttctttgcggctcggccattttgtcccagtcagtccggaggctgcggctgcagaagtaccgcctgcggagtaactgcaaagatgctgtccgtgcgcgttgctgcggccgtggtccgcgcccttcctcggcgggccggactggtgagcaccgaaggccggcatgatgcaggcggccgggtggggctgcagggtggtggtgcgccggctcgggcgctctctgcaggagggcgaggggctgtggcgaatgccgccatcttgcacccgtggcttctccggctggacagagcaggcgacacaggtgcccttttgctcgtcacctgcgcagaggcagaatggtacagggcagacagttaactcgatggtgtccagagacagggcctcaagattcctgtcttcggctgacagcggccctagaagggggatcttgggtgaaggtcagggcttgggcgctagctctccgaggcctgttctgaatcggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgcatagtt

SEQ ID NO: 109481 - DNA, 910 bp, Homo sapiens
  Payload ID: 1497
  Gene Symbol: ATP5A1
  Gene Name: ATP synthase, H+ transporting, mitochondrial F1 complex, alpha subunit 1, cardiac muscle
  ENST ID: ENST00000589869
  CDS Start-End: 289-910
gccgttggcacccgcccctcgccgggcccgggatttctgggagttgtggttttacctgagactcctggccgttgagcccctgtgcaaggctggtcgaaggctctggcattgcaagcctcgcttcgttgccacttcccagctcttcccgccttccgcggtataatcaacactacgagagatagagccgcctagaaccaggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggaaaacctcaattgctattgacacaatcattaaccagaaacgtttcaatgatggatctgatgaaaagaagaagctgtactgtatttatgttgctattggtcaaaagagatccactgttgccc

SEQ ID NO: 109482 - DNA, 565 bp, Homo sapiens
  Payload ID: 1497
  Gene Symbol: ATP5A1
  Gene Name: ATP synthase, H+ transporting, mitochondrial F1 complex, alpha subunit 1, cardiac muscle
  ENST ID: ENST00000591981
  CDS Start-End: 66-200
cattttgtcccagtcagtccggaggctgcggctgcagaagtaccgcctgcggagtaactgcaaagatgctgtccgtgcgcgttgctgcggccgtggtccgcgcccttcctcggcgggccggactgaatacttttgcactaggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagg

SEQ ID NO: 109483 - DNA, 2214 bp, Homo sapiens
  Payload ID: 1497
  Gene Symbol: ATP5A1
  Gene Name: ATP synthase, H+ transporting, mitochondrial F1 complex, alpha subunit 1, cardiac muscle
  ENST ID: ENST00000586592
  CDS Start-End: 85-357
accttctttgcggctcggccattttgtcccagtcagtccggaggctgcggctgcagaagtaccgcctgcggagtaactgcaaagatgctgtccgtgcgcgttgctgcggccgtggtccgcgcccttcctcggcgggccggactggtgagcaccgaaggccggcatgatgcaggcggccgggtggggctgcagggtggtggtgcgccggctcgggcgctctctgcaggagggcgaggggctgtggcgaatgccgccatcttgcacccgtggcttctccggctggacagagcaggcgacacaggtgcccttttgctcgtcacctgcgcagaggcagaatggtacagggcagacagttaactcgatggtgtccagagacagggcctcaagattcctgtcttcggctgacagcggccctagaagggggatcttgggtgaaggtcagggcttgggcgctagctctccgaggcctgttctgaatcggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgc

SEQ ID NO: 109484 - DNA, 1931 bp, Homo sapiens
  Payload ID: 1497
  Gene Symbol: ATP5A1
  Gene Name: ATP synthase, H+ transporting, mitochondrial F1 complex, alpha subunit 1, cardiac muscle
  ENST ID: ENST00000590156
  CDS Start-End: 65-241
attttgtcccagtcagtccggaggctgcggctgcagaagtaccgcctgcggagtaactgcaaagatgctgtccgtgcgcgttgctgcggccgtggtccgcgcccttcctcggcgggccggactggtctccagaaatgctttgggttcatctttcattgctgcaaggaacttccatgcctctaacactcatcttcaaaagactggtaagttattatttctcagtctacgccgcacttactagatgaagatataaattacatacatcgtataactgtgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgc

SEQ ID NO: 109485 - DNA, 662 bp, Homo sapiens
  Payload ID: 1497
  Gene Symbol: ATP5A1
  Gene Name: ATP synthase, H+ transporting, mitochondrial F1 complex, alpha subunit 1, cardiac muscle
  ENST ID: ENST00000589252
  CDS Start-End: 65-662
attttgtcccagtcagtccggaggctgcggctgcagaagtaccgcctgcggagtaactgcaaagatgctgtccgtgcgcgttgctgcggccgtggtccgcgcccttcctcggcgggccggactggtctccagaaatgctttgggttcatctttcattgctgcaaggaacttccatgcctctaacactcatcttcaaaagactgccattgtggacgttccagttggtgaggagctgttgggtcgtgtagttgatgcccttggtaatgctattgatggaaagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcagatgccatgaagtacaccattgtggtgtcggctacggcctcggatgctgccccacttcagtacctgg

SEQ ID NO: 109486 - DNA, 1793 bp, Homo sapiens
  Payload ID: 1497
  Gene Symbol: ATP5A1
  Gene Name: ATP synthase, H+ transporting, mitochondrial F1 complex, alpha subunit 1, cardiac muscle
  Uniprot ID: P25705
  ENST ID: ENST00000590665
  CDS Start-End: 66-1661
cattttgtcccagtcagtccggaggctgcggctgcagaagtaccgcctgcggagtaactgcaaagatgctgtccgtgcgcgttgctgcggccgtggtccgcgcccttcctcggcgggccggactggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgc

SEQ ID NO: 109487 - DNA, 553 bp, Homo sapiens
  Payload ID: 1497
  Gene Symbol: ATP5A1
  Gene Name: ATP synthase, H+ transporting, mitochondrial F1 complex, alpha subunit 1, cardiac muscle
  ENST ID: ENST00000592989
  CDS Start-End: 220-553
ctcctggccgttgagcccctgtgcaaggctggtcgaaggctctggcattgcaagcctcgcttcgttgccacttcccagctcttcccgccttccgcggtataatcaacactacgagagatagagccgcctagaaccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagg

SEQ ID NO: 109488 - DNA, 520 bp, Homo sapiens
  Payload ID: 1497
  Gene Symbol: ATP5A1
  Gene Name: ATP synthase, H+ transporting, mitochondrial F1 complex, alpha subunit 1, cardiac muscle
  ENST ID: ENST00000585650
  CDS Start-End: 13-249
aaaaatctcagtatggtaattctgtggagaaaaaaaaaaagcccatccaggtctccagaaatgctttgggttcatctttcattgctgcaaggaacttccatgcctctaacactcatcttcaaaagactgagatgggattttgctgtgttggccaggctggtccaaactcttggcctcaagtggtccgcccgcctcccaaagtgctggtattactggcgtgagccactgcacccaacccctgtatgctaagatgaagaataccacctatactaccctgtgtgccttgaaagagaaagacacactttgttaacaggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgt

SEQ ID NO: 109489 - DNA, 756 bp, Homo sapiens
  Payload ID: 1497
  Gene Symbol: ATP5A1
  Gene Name: ATP synthase, H+ transporting, mitochondrial F1 complex, alpha subunit 1, cardiac muscle
  ENST ID: ENST00000590406
  CDS Start-End: 140-756
attgcaagcctcgcttcgttgccacttcccagctcttcccgccttccgcggtataatcaacactacgagagatagagccgcctagaaccagtccggaggctgcggctgcagaagtaccgcctgcggagtaactgcaaagatgctgtccgtgcgcgttgctgcggccgtggtccgcgcccttcctcggcgggccggactggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagggtccaattggttccaagacgcgtaggcgagttggtctgaaagcccccggtatcattcctcgaatttcagtgcgggaaccaatgcagactggcattaaggctgtggatagcttggtgccaattggtcgtggtca

SEQ ID NO: 109490 - DNA, 576 bp, Homo sapiens
  Payload ID: 1497
  Gene Symbol: ATP5A1
  Gene Name: ATP synthase, H+ transporting, mitochondrial F1 complex, alpha subunit 1, cardiac muscle
  ENST ID: ENST00000592364
  CDS Start-End: 55-288
agtcagtccggaggctgcggctgcagaagtaccgcctgcggagtaactgcaaagatgctgtccgtgcgcgttgctgcggccgtggtccgcgcccttcctcggcgggccggactggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaa

SEQ ID NO: 109491 - DNA, 1839 bp, Homo sapiens
  Payload ID: 1498
  Gene Symbol: ATP5B
  Gene Name: ATP synthase, H+ transporting, mitochondrial F1 complex, beta polypeptide
  Uniprot ID: P06576
  ENST ID: ENST00000262030
  CDS Start-End: 106-1695
agttcacccaatggacctgcctactgcagcgtaggcctcgcctcaacggcaggagagcaggcggctgcggttgctgcagccttcagtctccacccggactacgccatgttggggtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctc

SEQ ID NO: 109492 - DNA, 1085 bp, Homo sapiens
  Payload ID: 1498
  Gene Symbol: ATP5B
  Gene Name: ATP synthase, H+ transporting, mitochondrial F1 complex, beta polypeptide
  ENST ID: ENST00000552959
  CDS Start-End: 1-1085
gtttgtgggtcgggtggccgctgctccggcctccggggccttgcggagactcaccccttcagcgtcgctgcccccagctcagctcttactgcgggccgctccgacggcggtccatcctggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaa

SEQ ID NO: 109493 - DNA, 856 bp, Homo sapiens
  Payload ID: 1498
  Gene Symbol: ATP5B
  Gene Name: ATP synthase, H+ transporting, mitochondrial F1 complex, beta polypeptide
  ENST ID: ENST00000551020
  CDS Start-End: 5-856
cgccatgttggggtttgtgggtcgggtggccgctgctccggcctccggggccttgcggagactcaccccttcagcgtcgctgcccccagctcagctcttactgcgggccgctccgacggcggtccatcctggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtgtctgcattattgggccgaatcccttctgctgtgggctatcagcctaccctggccactgacatgggtactatgcaggaaagaattaccactaccaagaagggatctatcacctctgtacaggactacaaatccctccaggatatcattgccatcctgggtatggatgaactttctgaggaagacaagttgaccgtgtcccgtgcacggaaaatacagcgtttcttgtctcagccattccag

SEQ ID NO: 109494 - DNA, 814 bp, Homo sapiens
  Payload ID: 1498
  Gene Symbol: ATP5B
  Gene Name: ATP synthase, H+ transporting, mitochondrial F1 complex, beta polypeptide
  ENST ID: ENST00000553007
  CDS Start-End: 5-814
cgccatgttggggtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttggggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgac

SEQ ID NO: 109495 - DNA, 399 bp, Homo sapiens
  Payload ID: 1498
  Gene Symbol: ATP5B
  Gene Name: ATP synthase, H+ transporting, mitochondrial F1 complex, beta polypeptide
  ENST ID: ENST00000551570
  CDS Start-End: 1-399
gctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccatt

SEQ ID NO: 109496 - DNA, 997 bp, Homo sapiens
  Payload ID: 1499
  Gene Symbol: ATP5D
  Gene Name: ATP synthase, H+ transporting, mitochondrial F1 complex, delta subunit
  Uniprot ID: P30049
  ENST ID: ENST00000215375
  CDS Start-End: 102-608
cagacgtccctgcgcgtcgtcctcctcgccctccaggccgcccgcgccgcgccggagtccgctgtccgccagctacccgcttcctgccgcccgccgctgccatgctgcccgccgcgctgctccgccgcccgggacttggccgcctcgtccgccacgcccgtgcctatgccgaggccgccgccgccccggctgccgcctctggccccaaccagatgtccttcaccttcgcctctcccacgcaggtgttcttcaacggtgccaacgtccggcaggtggacgtgcccacgctgaccggagccttcggcatcctggcggcccacgtgcccacgctgcaggtcctgcggccggggctggtcgtggtgcatgcagaggacggcaccacctccaaatactttgtgagcagcggttccatcgcagtgaacgccgactcttcggtgcagttgttggccgaagaggccgtgacgctggacatgttggacctgggggcagccaaggcaaacttggagaaggcccaggcggagctggtggggacagctgacgaggccacgcgggcagagatccagatccgaatcgaggccaacgaggccctggtgaaggccctggagtaggcggtgcgtacccggtgtcccgaggcccggccaggggctgggcagggatgccaggtgggcccagccagctcctggggtcccggccacctggggaagccgcgcctgccaaggaggccaccagagggcagtgcaggcttctgcctgggccccaggccctgcctgtgttgaaagctctggggactgggccagggaagctcctcctcagctttgagctgtggctgccacccatggggctctccttccgcctctcaagatccccccagcctgacgggccgcttaccatcccctctgccctgcagagccagccgccaaggttgacctcagcttcggagccacctctggatgaactgcccccagcccccgccccattaaagacccggaagcctgac

SEQ ID NO: 109497 - DNA, 704 bp, Homo sapiens
  Payload ID: 1499
  Gene Symbol: ATP5D
  Gene Name: ATP synthase, H+ transporting, mitochondrial F1 complex, delta subunit
  Uniprot ID: P30049
  ENST ID: ENST00000395633
  CDS Start-End: 106-612
ctcccagacgtccctgcgcgtcgtcctcctcgccctccaggccgcccgcgccgcgccggagtccgctgtccgccagctacccgcttcctgccgcccgccgctgccatgctgcccgccgcgctgctccgccgcccgggacttggccgcctcgtccgccacgcccgtgcctatgccgaggccgccgccgccccggctgccgcctctggccccaaccagatgtccttcaccttcgcctctcccacgcaggtgttcttcaacggtgccaacgtccggcaggtggacgtgcccacgctgaccggagccttcggcatcctggcggcccacgtgcccacgctgcaggtcctgcggccggggctggtcgtggtgcatgcagaggacggcaccacctccaaatactttgtgagcagcggttccatcgcagtgaacgccgactcttcggtgcagttgttggccgaagaggccgtgacgctggacatgttggacctgggggcagccaaggcaaacttggagaaggcccaggcggagctggtggggacagctgacgaggccacgcgggcagagatccagatccgaatcgaggccaacgaggccctggtgaaggccctggagtaggcgagccagccgccaaggttgacctcagcttcggagccacctctggatgaactgcccccagcccccgccccattaaagacccggaagcctga

SEQ ID NO: 109498 - DNA, 637 bp, Homo sapiens
  Payload ID: 1499
  Gene Symbol: ATP5D
  Gene Name: ATP synthase, H+ transporting, mitochondrial F1 complex, delta subunit
  Uniprot ID: P30049
  ENST ID: ENST00000591660
  CDS Start-End: 32-538
agctacccgcttcctgccgcccgccgctgccatgctgcccgccgcgctgctccgccgcccgggacttggccgcctcgtccgccacgcccgtgcctatgccgaggccgccgccgccccggctgccgcctctggccccaaccagatgtccttcaccttcgcctctcccacgcaggtgttcttcaacggtgccaacgtccggcaggtggacgtgcccacgctgaccggagccttcggcatcctggcggcccacgtgcccacgctgcaggtcctgcggccggggctggtcgtggtgcatgcagaggacggcaccacctccaaatactttgtgagcagcggttccatcgcagtgaacgccgactcttcggtgcagttgttggccgaagaggccgtgacgctggacatgttggacctgggggcagccaaggcaaacttggagaaggcccaggcggagctggtggggacagctgacgaggccacgcgggcagagatccagatccgaatcgaggccaacgaggccctggtgaaggccctggagtaggcgatccccccagcctgacgggccgcttaccatcccctctgccctgcagagccagccgccaaggttgacctcagcttcggagccacctctggatgaact

SEQ ID NO: 109499 - DNA, 405 bp, Homo sapiens
  Payload ID: 1499
  Gene Symbol: ATP5D
  Gene Name: ATP synthase, H+ transporting, mitochondrial F1 complex, delta subunit
  ENST ID: ENST00000591249
  CDS Start-End: 1-299
ccggagccttcggcatcctggcggcccacgtgcccacgctgcaggtcctgcggccggggctggtcgtggtgcatgcagaggacggcaccacctccaaatactttgtgagcagcggttccatcgcagtgaacgccgactcttcggtgcagttgttggccgaagaggccgtgacgctggacatgttggacctggggccaaggcaaacttggagaaggcccaggcggagctggtggggacagctgacgaggccacgcgggcagagatccagatccgaatcgaggccaacgaggccctggtgaaggccctggagtaggcgagccagccgccaaggttgacctcagcttcggagccacctctggatgaactgcccccagcccccgccccattaaagacccggaagcctga

SEQ ID NO: 109500 - DNA, 3665 bp, Homo sapiens
  Payload ID: 1500
  Gene Symbol: ATP5E
  Gene Name: ATP synthase, H+ transporting, mitochondrial F1 complex, epsilon subunit
  Uniprot ID: P56381
  ENST ID: ENST00000243997
  CDS Start-End: 132-287
gattggcaggtccgcacgccccgcctcttccgcttctgtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgttactcttgattttagtttgtgagactttttcattttctttaaaggaactgtctgcacagctgcatgattatggccatgtgaaccagggtttcttaaaagcaggggaagccagatttaatatttagtgaccaaagggatacagaaagcattttgaaaatgtctcaaaatagttgtttcatgacattaattggtgatcaaaattatctgctgtcattgaggcttcgtagtcccttatttttgaattgttgtcatgtcagaataatgacatggttatcagtaacaaatggaaataattattaaatactaaaagtgtagattagaagaagaaatactaaattgtacttgttttgtattgtgcacttaaagcctatagataagaacggttacagaatttaagcacaaagtgtttttcacattgttttgtaaatgaatctttatactctggtagcatttctcataggaaatgaggcaaagctattgaataacttgctcattgagttgatggccaaactgaaattaaaacctaggagttttgactgcaagtctgggacacggtgaccacaacagcagtttcgtggtatttccatagtgattcattcattcattatttagggatgaaaaattgttgcaagttatgtttttatctttctttgaaacttgaaagggcttgggcaagtaaaacaccattgcaaagttaactgcctgattttaactgtttttggagactggagaaataaatttgaactggaaattttgaaacaccattctaggatcagttctcacatggtacttaagctcacaatgatttatcagggccactgtcagcaatgccgaggataagccgaaaagaacatctttgttctcggcttctgggaatgacttattgtcccgacacttgacctgtaggttttactgaattctcagcacagagcgagcagggaggcagagccaattgagtggaagagggtgcctctggaaaacagcaggttaggagcccttggagtcctccgcctcggagctgtcatcctgctgttggcaagttagggcacctcagttcagtgctgtggcccccaagattaaggtactaggaagtatcctccattacagggaacaggaataaatgaatcaaaaagctatcgggcctttttgacatgggacgaataaagtaactaataggcaaaggggctaaatgatttccagtcaagtaattagagataagtcatttattaaggaggcagatggggtattattggtatatagatggcatagtagattgctagtatattggtagattattggtatatagatggtatgttaaggaggcagatggggtattactggtatatagatggtatggtagattggtagtatattggcagattattggtatatggtatgttgaggcagatggggtattactggtatatagatggcatagtagattggtagtatattggtagattattggtatagagatggtatattattaaggaggcagatggggtaattagaggtgagacttagggacagggcttgtgatatggaaaggagtgaagtcactgagtaaaagacaagtttactgtcagcagagattcttagaggctcttttctccgtgattaaaaaaaaatcctaaaccagtagtataataaacttcctgcctccagcagtgctgggtagctggcaggatgactgtgcccagtgatgaggtgaccccagtcagaccaacttaatgagtatcccactaattagttggatgatgtttgaagctgtcagttaatctcttagttcacatcgttcttgtgagcaaagtgaaggaatcggataagctctaaatttcggtgatgctgctgctctgagagaccaaggtcgctggagcaaccgtactgctaaaggataagctcttcaaaatcaaaagggacagatttcttaagtttctagtttgttttgtgtttttacatctatttctaccatacgaaagagtaggatggtgagatgcatttctaaatatttttaactactcagtctggatggttaggcttcaagaaaaggaatttatttagtctgaaataaagcaattttgccatttaaaattgaattactttgtagtttaatgattactattgagcaaacaaatctttacagtaatataagtcagcaaaagttttttaaaaggtttaaatccctccttccttacatctatttcattgcttttttaggtttgggaagtaaagcaccagaggaagcatgtgtaaatccttgtataatcgcaggctgtaagtctttagcatctcaggaagttactaacttcaaactaagtatataggtagagtttcttactaaatctagtgcttcttgaaccacaagtagaaagcatttaaaacatgaatgttgttttgtgttttttgaagtttgtaaatagaagacttgttgatgatccgatggcaaggtatttttctcttggtatgtattttagttatttcctcgtgatgcataagtgaaaagagtgaagtttctcagaatgagcaactgtcatccatctacctgctattttattattgctgattacaaaagcaaatcaagagatgagaacccagttgcctgcaagtaaatatttactgcattgagggtcggagcattttcccattaccggttatccatggatcaaatagtgtatctcagtggtaattctagagggccattaaaaccctgatggtgctggaagagatggcagtgctgcatgtcagaaataggtaaactgtaattaagaagttacagatgatttgattacgctcttgtgtatttggtcctgttataatgtgagcagattaaaatcatgtagtgcttaaagctatgtcattatgcaaacatttatggcaacttctgcaaattaatttgaactgtaaaagttccctaatgagacgatgtcctccataactgagaaggacactgcagccattgctgcttaattcctgcatttgaatggttgccgagcgcatggtgtgccctttctcaaagagcagagaggctgcagagcattttggggggtgatgactgaatgaaagtgaaaagaccatttcaaaatagcctttaaaaggaaagccaaggatgattattaatgaattcctgggatctaacagtagtaagaaatttaaactatataaacatatatgttaaaggctagctcttcagaaataaagatcagaagactgcagttcttta

SEQ ID NO: 109501 - DNA, 1878 bp, Homo sapiens
  Payload ID: 1500
  Gene Symbol: ATP5E
  Gene Name: ATP synthase, H+ transporting, mitochondrial F1 complex, epsilon subunit
  Uniprot ID: P56381
  ENST ID: ENST00000395659
  CDS Start-End: 95-250
gtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctgtaagttatggatttatttagaagaacagttgcatcttaagtttttggagcaccataaagatcaaaataattttagttttgggttctattcattttttagtcagtgtatttggaagttagttattgggatggtataatttaaagcatgcaggttatagaagtcccctggcctaataaaaagaaagtcttcttgggccctgacaagcagaagtaattggcacattgattttcagttcatttagcaatgcttaggtagagagccatcgtatttgaattaaacctgtttcatttgtctgcacaaatcaaataatttggaggatgaactccccacttgtataattgcaattggagttacataacagtccaagagcatgaaaaactacagttctttacatttttatttcccccacaaccactaatgttctcacaaatcactacttcccgaacataataactacaggcacaggcaagggtcctgctgttgtatcaagcaataaaatctgcaagaccccgcagcgaatactgttttgctaatttattatgctttcagagggtttggttcattttacttttccaaagatgttggtgatgtaaagttaaattctcgtgaaataaaaaggtctgtacagttgataagtgtagacttttgtgttccacattataaaagtggtttgatctctaaagtactttcttgacattgttatttcaaaagtaggcaaggcaaattatcagagagatgtttttcagatttaatttttcttgttttgcttttaaaaagcttcagacccataatagcacagaaatgtgataaatattaatcctttggcagcttatggttatgagcaattttacttattggaactgtctcccctaagcacttttcattttcattttgaattagtaaatattttattacaagtctggagatgcagtgttttgaatttagccctttttctaggggctctctgtctaatctcataattctgagtaatgagacctggttttatgttgggttgttttgttttaacagtaagctaacagaaaatcatttagcctcactcggctcagagctgccagactgcatctaatgctgagattttgcaaagtcctgggggtcaggaagtagtgtccgatccccttaaacaaagcattagcccctctctgttatgcccttcagggttacagaccccacctcattagcacaaggagatgttagtgtcttttaaaggcaaagtagtttctttattctgggagagtgtttacttttactcagcaggaaaatgcctgcttgactaagcctgtgtacttgaaccagcactttttacatctgagccacggcaatgtgaatgatagccacagttatacagttcactataaggaagttatttcttatattcatgttgagtttttaagaaaacacagagaactagccagcaacttgcattttctttttcctcctagaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgttactcttga

SEQ ID NO: 109502 - DNA, 697 bp, Homo sapiens
  Payload ID: 1500
  Gene Symbol: ATP5E
  Gene Name: ATP synthase, H+ transporting, mitochondrial F1 complex, epsilon subunit
  Uniprot ID: P56381
  ENST ID: ENST00000395663
  CDS Start-End: 42-197
tcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctgtttgggaagtaaagcaccagaggaagcatgtgtaaatccttgtataatcgcaggctgtaagtctttagcatctcaggaagttactaacttcaaactaagtatataggtagagtttcttactaaatctagtgcttcttgaaccacaagtagaaagcatttaaaacatgaatgttgttttgtgttttttgaagtttgtaaatagaagacttgttgatgatccgatggcaaggtatttttctcttggtatgtattttagttatttcctcgtgatgcataagtgaaaagagtgaagtttctcagaatgagcaactgtcatccatctacctgctattttattattgctgattacaaaagcaaatcaagagatgagaacccagttgcctgcaagtaaatatttactgcattgagggtcggagcattttcccattaccggttatccatggatcaaatagtgtatctcagtggtaattctagagggccattaaaaccctgatgg

SEQ ID NO: 109503 - DNA, 385 bp, Homo sapiens
  Payload ID: 1501
  Gene Symbol: ATP5EP2
  Gene Name: ATP synthase, H+ transporting, mitochondrial F1 complex, epsilon subunit pseudogene 2
  Uniprot ID: Q5VTU8
  ENST ID: ENST00000381026
  CDS Start-End: 55-210
gacattgccagagtcttggcgatttggcccgacgcgctccgctttcgctacagcatggtggcctactggagacaggctggactcagctacatccgatactcccagatctgtgcaaaagtagtgagagatgcactgaagacagaattcaaagcaaatgccaaaaagacttctggcaacagcgtaaaaattgtgaaagtaaagaaggaataatctaccctgactaaagcttgaaatgctgcatttccaaggtgaagatgtatgggcacatgttatggcagattgaaaaggatctcatttcatgggaaaaaaaaatcctgtcttgttcataaattgacaatgtcaataaattgaaatatggttcactgttaaaaaaaaaaaaaaaaaa

SEQ ID NO: 109504 - DNA, 1078 bp, Homo sapiens
  Payload ID: 1502
  Gene Symbol: ATP5C1
  Gene Name: ATP synthase, H+ transporting, mitochondrial F1 complex, gamma polypeptide 1
  Uniprot ID: P36542
  ENST ID: ENST00000335698
  CDS Start-End: 32-925
ctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctgtaaagaaggaaaattcagccagttgattttgtttttagcttactgctgcctttgtccgaagaaactgttcctccattatttgaattactgaagacagcaagatatttgtaaattatcttaaaataaacaacttaaaataaaatcattgtttttctt

SEQ ID NO: 109505 - DNA, 1163 bp, Homo sapiens
  Payload ID: 1502
  Gene Symbol: ATP5C1
  Gene Name: ATP synthase, H+ transporting, mitochondrial F1 complex, gamma polypeptide 1
  Uniprot ID: P36542
  ENST ID: ENST00000356708
  CDS Start-End: 80-976
tgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggtctgtcatctcctataagacagaagaaaagcccatcttttcccttaataccgttgcaagtgctgacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttctgagatgattgacaaattgacattgacattcaaccgtacccgccaagctgtcatcacaaaagagttgattgaaattatctctggtgctgcagctctggattaatgaaaatcaagttccatcctcagacaagaggtaaagaaggaaaattcagccagttgattttgtttttagcttactgctgcctttgtccgaagaaactgttcctccattatttgaattactgaagacagcaagatatttgtaaattatcttaaaataaacaacttaaaataaaatcattgtttttctt

SEQ ID NO: 109506 - DNA, 932 bp, Homo sapiens
  Payload ID: 1503
  Gene Symbol: ATP5O
  Gene Name: ATP synthase, H+ transporting, mitochondrial F1 complex, O subunit
  Uniprot ID: P48047
  ENST ID: ENST00000290299
  CDS Start-End: 218-859
cagatgcagtcgaagccctgtggctccaccccgagggtccagcccttaccactgctaagaactacaactcccagcccgagggaggtctctgcgcctgcggcctgacgccctacgcctacacttcccagagaacctagcggttacgccaacgcgcgcgtgcgcccttgcgcgtttctctcttcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaatctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacagatca

SEQ ID NO: 109507 - DNA, 415 bp, Homo sapiens
  Payload ID: 1503
  Gene Symbol: ATP5O
  Gene Name: ATP synthase, H+ transporting, mitochondrial F1 complex, O subunit
  ENST ID: ENST00000418933
  CDS Start-End: 1-259
taccaatctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagtcttacttcttttgtagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacaga

SEQ ID NO: 109508 - DNA, 583 bp, Homo sapiens
  Payload ID: 1503
  Gene Symbol: ATP5O
  Gene Name: ATP synthase, H+ transporting, mitochondrial F1 complex, O subunit
  ENST ID: ENST00000431254
  CDS Start-End: 1-223
ggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacagatca

SEQ ID NO: 109509 - DNA, 442 bp, Homo sapiens
  Payload ID: 1503
  Gene Symbol: ATP5O
  Gene Name: ATP synthase, H+ transporting, mitochondrial F1 complex, O subunit
  ENST ID: ENST00000429064
  CDS Start-End: 1-79
aggagtcgtttctgccttttctaccatgatgagtgtccatcgcggagaggtaccttgcacagtgacctctgcatcttgatggaggttttactgtgttctccaggcttgtctcgaacttctgggctcaagtgacccacctgccttggcctcctaaagtgctgggaataaaggtcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacag

SEQ ID NO: 109510 - DNA, 462 bp, Homo sapiens
  Payload ID: 1503
  Gene Symbol: ATP5O
  Gene Name: ATP synthase, H+ transporting, mitochondrial F1 complex, O subunit
  ENST ID: ENST00000417181
  CDS Start-End: 1-123
gtcgtttctgccttttctaccatgatgagtgtccatcgcggagaggtaccttgcacagtgacctctgcatctgcttgtctcgaacttctgggctcaagtgacccacctgccttggcctcctaaagtgctgggaataaagatgaggaaaccgaatgcagggagatgaagtcgcttgcccaaagtcatacgagcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacaga

SEQ ID NO: 109511 - DNA, 3156 bp, Homo sapiens
  Payload ID: 1504
  Gene Symbol: ATP5F1
  Gene Name: ATP synthase, H+ transporting, mitochondrial Fo complex, subunit B1
  Uniprot ID: P24539
  ENST ID: ENST00000369722
  CDS Start-End: 607-1377
tgacgcgacccagggtcaggataacatgcagggcggggatgggctgggagggtcagtctccggggaggggcgccctgggccggggtaagggagctcccaggcccgggatctcggctcaccggaccggtaccgcgcagcctccaactgccgttccatgcaggcgggcgcatttgggggaagattccactcccgggccgccgggggcactagggggggtggggtttccttccgcatctccacggttccaactccaacctagactcaaactggacgccggccggagactccgctccggcagcaaaccccacgtggtgcacctctgagcctccgcccctctcccgagggaaccgcaactctacttctcgcgagaattgcttctatggctccatcctgctttccggctgtcgccctcatgcgataggctctcagcgttacttgactcttctcgcgataattttttttaaaaatctcccaaggaaagttgaaggaagagtacaaaattttcatctcgcgagacttgtgagcggccatcttggtcctgccctgacagattctcctatcggggtcacagggacgctaagattgctacctggactttcgttgaccatgctgtcccgggtggtactttccgccgccgccacagcggccccctctctgaagaatgcagccttcctaggtccaggggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtctttctgtgttggtgtctactgaagttatagtttacccttcctaaaaatgaaaagtttgtttcatatagtgagagaacgaaatctctatcggccagtcagatgtttctcatccttcttgctctgcctttgagttgttccgtgatcacttctgaataagcagtttgcctttataaaaacttgctgcctgactaaagattaacaggttatagtttaaatttgtaattaattctaccatcttgcaataaagtgacaattgaatgaaacagggtttttcaagttgtataattctctgaaatactcagcttttgtcatatgggtaaaaattaaagatgtcattgaactactgtcttgtttatgagaccattcagtggtgaactgtttctggctgataggttatgagatatgtaaagctttctagtactcttaaaataactaaatggagtattatatatcaattcatatcattgactttattattttagtagtatgcctatagaaaatattatggactcagagtgtcataaaatcactcttaagaatccatgcagcaggccaggcacagtggctcacacctgtaatgcctgcactttggaaggccgagacaggcggatcacttgaggtcaggagtttgaaaccagccaggccaacacagtgaaaccctgtctctactaaaaatacaaaaggttagccgggcatggtggcaggcgcctgtaatcccagctactcaggaggctgaggcaggagaattgcttgaacgcaggaggcaaaggttgcagtgagctgagatcacgccactgcactccagcctgggcaacagacctcgactccatctagaaaaaaaaaaaaaaaaatccagcagacacctatcaggaacatagaaaataacaagtgttggcaaggaagtggagaagttggaacacttgtgcactgttcgtagaaatatgaaatggtacagccattatggaaaagtgtggtgattcctcataaaattaaaatggaaataccatgatccagcaatcccagtcgacatatatactcaaaaaaattaaaagcagggtcttgaagagatacttgtgttccatggtgatagcagccattgttcacaatagctaaaacatagaagcagcccaatcggccatcagtagatgaatggataagcaaaatgtagtatatccatgcaatggaatattattccacttcaaggaagaaaattctgacactggctacagcatgaatgaaccttgaggacgttatgcagttttacaggatgagttatggagctggatagtggtgatggtggcacattaaggatgtatttaatactgttcttaaatggtacacttaaaaatggtaaattttatgtgtattttacaatctttttttaaattgaagaaaaatcctgtagataaattagaaaattcttcccttcataggtttatctgcatttgattctcccatacttgtacaaggatttatttgtattcaaatggacaaattacgcaataggaaatatttgaaaatatttatcatgggtaattgctattttcattgacttcctaagattttatgtaataatcatttgagtcaatattggtagctaatgtactaatctaatattgaaatcagattgatatctttgttacttaaagataatttgattggatcagcagttatttcaaattgattaaacaaaaaattataaaaca

SEQ ID NO: 109512 - DNA, 678 bp, Homo sapiens
  Payload ID: 1504
  Gene Symbol: ATP5F1
  Gene Name: ATP synthase, H+ transporting, mitochondrial Fo complex, subunit B1
  ENST ID: ENST00000483994
  CDS Start-End: 59-646
agattctcctatcggggtcacagggacgctaagattgctacctggactttcgttgaccatgctgtcccgggtggtactttccgccgccgccacagcgggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaggctcaagcacagccagttatgtaaatgtatctatcccaattgagacagctagaaac

SEQ ID NO: 109513 - DNA, 598 bp, Homo sapiens
  Payload ID: 1505
  Gene Symbol: ATP5G1
  Gene Name: ATP synthase, H+ transporting, mitochondrial Fo complex, subunit C1 (subunit 9)
  Uniprot ID: P05496
  ENST ID: ENST00000355938
  CDS Start-End: 86-496
ccaatgagaatggagaaggtccaggacacgtgggtgggggaagctgagcgctgagaccaagggctaaagctgggagactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatgggggggtcaccggcctgttgctactgcaactccacaccattcttggtgctggggtgtgttaagctttaccattaaacacaacgtttctctaaa

SEQ ID NO: 109514 - DNA, 614 bp, Homo sapiens
  Payload ID: 1505
  Gene Symbol: ATP5G1
  Gene Name: ATP synthase, H+ transporting, mitochondrial Fo complex, subunit C1 (subunit 9)
  Uniprot ID: P05496
  ENST ID: ENST00000393366
  CDS Start-End: 104-514
gagaccaagggctaaagctgggaggtgagtctgtcaccttgagccgggcgagcgctgtgggccaagcaggggttgcagggtagtaggagtgcagactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatgggggggtcaccggcctgttgctactgcaactccacaccattcttggtgctggggtgtgttaagctttaccattaaacacaacgtttctcta

SEQ ID NO: 109515 - DNA, 359 bp, Homo sapiens
  Payload ID: 1505
  Gene Symbol: ATP5G1
  Gene Name: ATP synthase, H+ transporting, mitochondrial Fo complex, subunit C1 (subunit 9)
  ENST ID: ENST00000514808
  CDS Start-End: 49-348
gggaagctgagcgctgagaccaagggctaaagctgggagactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggtaagtttgggtggt

SEQ ID NO: 109516 - DNA, 468 bp, Homo sapiens
  Payload ID: 1505
  Gene Symbol: ATP5G1
  Gene Name: ATP synthase, H+ transporting, mitochondrial Fo complex, subunit C1 (subunit 9)
  ENST ID: ENST00000506855
  CDS Start-End: 34-366
gagaccaagggctaaagctgggagactgaaaaaatgcagaccgccggggcattattcatttctccagctctgccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatgggggggtcaccggcctgttgctactgcaactccacaccattcttggtgctggggtgtgttaagctttaccattaaacacaacgtttctctaaa

SEQ ID NO: 109517 - DNA, 539 bp, Homo sapiens
  Payload ID: 1505
  Gene Symbol: ATP5G1
  Gene Name: ATP synthase, H+ transporting, mitochondrial Fo complex, subunit C1 (subunit 9)
  ENST ID: ENST00000503641
  CDS Start-End: 54-437
ggtgggggaagctgagcgctgagaccaagggctaaagctgggagactgaaaaaatgcagaccgccggggcattattcatttctccagctctgatccgctgttgtaccaggggtctaatcaggcctgtgtctgcctccttcttgaatagcccagtgaattcatctaaacaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatgggggggtcaccggcctgttgctactgcaactccacaccattcttggtgctggggtgtgttaagctttaccattaaacacaacgtttctctaaa

SEQ ID NO: 109518 - DNA, 401 bp, Homo sapiens
  Payload ID: 1505
  Gene Symbol: ATP5G1
  Gene Name: ATP synthase, H+ transporting, mitochondrial Fo complex, subunit C1 (subunit 9)
  ENST ID: ENST00000504591
  CDS Start-End: 106-401
cggacgggggtgaaggggacgaccaaaggtcgtcattataagcaaacaaccagggtctcagtgggattattattactattttttccccctctgcagactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccag

SEQ ID NO: 109519 - DNA, 1792 bp, Homo sapiens
  Payload ID: 1506
  Gene Symbol: ATP5G2
  Gene Name: ATP synthase, H+ transporting, mitochondrial Fo complex, subunit C2 (subunit 9)
  Uniprot ID: Q06055
  ENST ID: ENST00000338662
  CDS Start-End: 1207-1680
attcctgtaatggcgtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgctgatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcagtcggcgctccctgtagtttctcctctcgaacgccaggtggagcaaccggccggataccgccacagccctggcaggcggcgctgtgatgcctgagctgatcctctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacag

SEQ ID NO: 109520 - DNA, 878 bp, Homo sapiens
  Payload ID: 1506
  Gene Symbol: ATP5G2
  Gene Name: ATP synthase, H+ transporting, mitochondrial Fo complex, subunit C2 (subunit 9)
  Uniprot ID: Q06055
  ENST ID: ENST00000394349
  CDS Start-End: 134-730
ccacgttacggatcggcttactccgcggagttggcctcatttctgcagtcggcgctccctgtagtttctcctctcgaacgccaggtggagcaaccggccggataccgccacagccctggcaggcggcgctgtgatgcctgagctgatcctgtatgttgcaatcactctatccgtggctgagcgactcgttggcccgggtcacgcatgcgctgagccttcctttcgctcttcccgctgctccgcccctctctgtcttctctgcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagatgtt

SEQ ID NO: 109521 - DNA, 745 bp, Homo sapiens
  Payload ID: 1506
  Gene Symbol: ATP5G2
  Gene Name: ATP synthase, H+ transporting, mitochondrial Fo complex, subunit C2 (subunit 9)
  Uniprot ID: Q06055
  ENST ID: ENST00000549164
  CDS Start-End: 189-614
tgtgacgactgcgcatgctcggaaaggggacgcaagtccgagatcccaaacgcggtacagaccaaaccgcagtccacgttacggatcggcttactccgcggagttggcctcatttctgcagtcggcgctccctgtagtttctcctctcgaacgccagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatac

SEQ ID NO: 109522 - DNA, 728 bp, Homo sapiens
  Payload ID: 1506
  Gene Symbol: ATP5G2
  Gene Name: ATP synthase, H+ transporting, mitochondrial Fo complex, subunit C2 (subunit 9)
  ENST ID: ENST00000549748
  CDS Start-End: 603-653
ccctctctgtcttctctgcagtgggagcagctctcctgccacagctcctcaccccctgaaaatgttcgcctgctccaagtttgtctccactccctccttgactttgctaaaaggaagaatgatccaaaactctaacgtacatgtgaagatggaaaggccatgagaggaaagaaaatcttgtctgatgatgtaacaacgtggcatagttctgaaactcctctccagtcttccttgaccttcctgcccctgtatgtcattcctgctaggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccag

SEQ ID NO: 109523 - DNA, 1950 bp, Homo sapiens
  Payload ID: 1506
  Gene Symbol: ATP5G2
  Gene Name: ATP synthase, H+ transporting, mitochondrial Fo complex, subunit C2 (subunit 9)
  Uniprot ID: Q06055
  ENST ID: ENST00000552242
  CDS Start-End: 1382-1807
gcaaaattacattcctgtaatggcgtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgctgatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcagtcggcgctccctgtagtttctcctctcgaacgccaggtggagcaaccggccggataccgccacagccctggcaggcggcgctgtgatgcctgagctgatccttttccctcttgttgcccaggctggagtacaatggcgcaatcttggctcaccgtagcctctgcctcctggattcaagcaattctcctgcctcagcctcctgagtagctgggattacagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataag

SEQ ID NO: 109524 - DNA, 668 bp, Homo sapiens
  Payload ID: 1506
  Gene Symbol: ATP5G2
  Gene Name: ATP synthase, H+ transporting, mitochondrial Fo complex, subunit C2 (subunit 9)
  Uniprot ID: Q06055
  ENST ID: ENST00000602871
  CDS Start-End: 95-520
tgagccttcctttcgctcttcccgctgctccgcccctctctgtcttctctgcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagatgtt

SEQ ID NO: 109525 - DNA, 5484 bp, Homo sapiens
  Payload ID: 1507
  Gene Symbol: ATP5G3
  Gene Name: ATP synthase, H+ transporting, mitochondrial Fo complex, subunit C3 (subunit 9)
  Uniprot ID: P48201
  ENST ID: ENST00000284727
  CDS Start-End: 3026-3454
ctaaaaaaagaatcccaggattttacctcctgtgtgttttcttcttgcttcttcatggtccatgataccagctgaggttgttagtacaataaaaccaaaccggccggatagaagcagattattctgccatttttccagatgtttgagttgcacatcaaatctggggctgattactcaacgcttgtttagcctacctgtgaggttcacaacaatttttcccagctctgtaatcatcagtgattcaaatttgccaatgtaaccatacttcaccattacagtgagaaaccagatgatgattttggagcacagcctaataagaacctggggtttgcctcttctttcggcattgttgatgctcttgagagcatcaggcaggacattcatgtgcaccattgtggcggcacgaaaagatggcggaaagagccaaacgacaaccctttcattgctcttgacaccgtgggtcaggaatttgggtaaagctcatttggatggctcatttttgttcctcgtggtgttgggaaggcttgacgagagctagagatccaagaaggcctcactcatgtgttggacacctcagttctctttggacttttttctatccaagtggtttctggagagggctatatttgggagtgatctgtcatacttctctttgctatcggatttctatcttcatcatgccatcatcactcaggctatcatcatcacccggtcttatcagatattgccaaattatgatgtcataacttactatgactgtccccactgtccatgaaaaaacacagaaaagattagatacttctcagggaggtccctgttcatctttatggcctcactttagtcctctcagaaggtactctttttcttcaatcttcctcagtgcaaatatccaccctcaatcaacatcaacatgggttggtgttactccaattcactcctctttttcttttctttttttttttgtttttgtttttttgagatggagtctcgctctgtcacccaggctggagtgcagtggcgtgatcttggctcacggcaacctctgactcccaggttcacgccattctcctgacttagcctcctgagtagctgggactacaggcacctgccacaacgcttggctaattttttgtatttttagtaaaaagacggggtttcaccgtgttagccaggatggtctccatctcctggccttgtgatccgcccgccttggcctcccaagtgccgggattacaggcgtgaaccaccgtgcctggccttcattctcctctttctataacgcaatcttaggatgcaaaaccaagcaaagtctgaattaatctatctagaatagcaccgtggagtcacagccatggtcaggcccctccaaagaacagactggatttcggaacccatgtctctccctgccacaagcaactagtccatatgcaacttggaagcagccactgtggatcttggcttctttcttgcttcctcctcaatagttactgccactgatttagtgctaaagagataggaacatcacttaaaaccatctctacacataaatccacttagaataattttttcccctggaggatctattattgaagtacaaggctttactgtttattctactgtagacaccacaggacaccatgttcttggttagaattgagtacttgagaaactatatgaataattgcttgttgaacagtacacgtgaattatctctattttccagctaaagattgagcctaaaatgattagtatttttgtaattttgaatcatttgatccatttgaagttggattagtgacaaagtcttattcatttttcaagtgttagttctgagggcttctcccagaactagcagcaaccagcgttgctgctagataatattgcacctttaagctaacaagtaaaaagctgatcctctgggttgatgttgtctcatgctagggctctaggcagagtgggctggagttcagtccccagccatcttcttagcagggcattctagatgtttaatcttttatgttgacgtgttgatatcacttccattagccatttgttagaattactaaattaaatttacataattcaaggatctaaaaagaccagaagttcagtcagagccatttttctgagatatttctgcatccctctgaagaagataatttgtccaaacttaacaaaaacaggtgttaaaattgagtacgttctgagaatactcagactttttttaagactttttttagtctcaaaccctacatgaaatacaatcccttaaatcttccaatcttagagctagaagaaaagtcgagcaccctcactttacccagaggcaattttgtgccccagatgacaaagctcttagatctactcatttgcttatggctccaccagtacttctaggtcaggccctctttcacctgaaggattagccatacttctggaaccattttccaggttccttgaaataaatatcttcgctttgctggggaccctagtttcctgttaagtagtgaatgacccttctttcctcccgccagccacagtcctatttcacagaggaagagaatgaccagcaagtcaacttctactacagagaagcagcaactgataaaaggccaaatcttacaaggtgccaacgtgaagaaaaaggcccactatcctgcagccaactcatatcaaaagttaatctgtttagtcctctctgccggggtgaatctacagtttttctttttgtctccctcttgccccatcaccaggtggttgtcgttgtccttcccggctagttgccaataaagttgttacaaagtgaccttgagtgtcttccttggtgcacccgaaaccccgccttcttcatccgggtgctgcggcgcgaataagagccggaccgcgcttgcgcattgagtcccactccttcgacctctgccgcagcccgtgccgccgccgcctcctgggaagagaggaagcgggagaggagcccacgtcgcctgtcacccaatatctccagccgcgcagtcccgaagagtgtaagatgttcgcctgcgccaagctcgcctgcaccccctctctgatccgagctggatccagagttgcatacagaccaatttctgcatcagtgttatctcgaccagaggctagtaggactggagagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccagaaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacggatgtaattctgtgtatcttactgtgactccgaaaactgtagtattggtgtcatgggaatgtacgttatttccaaagtcatttcattaaagatgaaaactttaatttcttctgtgatttgtacttacactaagtttagattatcacaaagaagaacgtgcattcaggcagatgctgtcccattcagaggaagctacagcagttgctccactgatgaaaaatattccaatgtaatttttatgggaattcttttatatagtgttctgcatattgtaattcatagggcttttgtttattcatataaaggataaatatttgggtgttttgagcttctataaaatatgattaattaaaggtagttaatactcaagatggtcttgagtttttaaggtctaacatcagttagaatacttcaaatcagaatcaccttccaagactgacttgacaggtggttctaaaaataaatcacgtcagctttttaggaaatgaagccttaagctagggggtaatgtgacttttgtttttcagtaagtctcacattaagcaattgtgtgcctctaatgaatcttccatgtcttttcagaacaggctcagtccaactagcagctagtttcttacttgaacaagactattaaaaaccaaatatcaaaaaactgaattggctagatttttacagccaaaaattgctgtaaggcagtgtgtatcactgttgctaacatgtttatagtgggagtcttggggatgatagctggttcaacagtattttgctgctaatactttatgttgcttcttggtcaaacttttcccattcaaaggaagaagatggtgctactatagacagtttttcccctagcaaatatattgtaccataatatctatcatccaagtttcagggttttttgaaagttgataattaggaaagtgacattttacttttcttagtgccctttgcctgtttgatttccattgagaaagagcagtcaccaaagttcctcaagtgtcggaagaccacctccatcagaatcagtgcttgtttaaaaaataaaaatccctaggttccagacctactgaattggactctttggacatgagactcagcaatctacatctttaaaaaggcttcccaggtggtttttgtgcatactgtttgagagtcactaagttatatatatatcctaccttctgtaaagtgaaatgaggccccaaaaagctaaagaggtagagctgctacctcgtttttagttgattcatcatctagtctatatcacccaaaagaattggaaataggtattcaaacaaaaacctgtatacaagtattcatagaagcactacttacaatagccgaaaggtagaaacaaccaaatgtctatcagctgatgaatggataagtaaaatacatccatataatggaatattcagccatgaaaaggaatgaggcactgatacataatgaatagatgtgagtgaaccctaagaaagcatgctaagtggaagaagccagccacatgattccatttatatgaaatatccaaaataggcaaatccacggtgacaaagccaattagtagttatcaggaactagggagggggtgaaaagggagtgactgcgtaatgcgtatggggattccttttaggatgatgaaaattggatgaattacagctggtctgatggtagtgggttatcagaacttattaacattagtgtcattaaagttggtatatagcccctcactgctaaatctggctcaaaaattaaaagattattaaaatttgatgaattagtggtgatggttgcacaacattgtaaatataataaatgtcactgaattgtacactttaaggtggttaaaatggcaaattttacatgtcttactgaaactactatttaatacaaagtacatagtataaaattttaaaagtgataggaaaatgcttagattaatattcacctattccaagtatattttaaataaaaacagtcttggtaaaga

SEQ ID NO: 109526 - DNA, 842 bp, Homo sapiens
  Payload ID: 1507
  Gene Symbol: ATP5G3
  Gene Name: ATP synthase, H+ transporting, mitochondrial Fo complex, subunit C3 (subunit 9)
  Uniprot ID: P48201
  ENST ID: ENST00000392541
  CDS Start-End: 271-699
ctgggaaggtaagtggagggcacagggagcccggcctggccagggcggagcggcgcccagtagggacccattcattgtgccggcgcctcactgggcacggggcccaagctgacggcgtgcacgggagcctgcggggcctgggtgggaagaacaggcccctggagggcacttgaccttaagcctcttttcctccgcagagaggaagcgggagaggagcccacgtcgcctgtcacccaatatctccagccgcgcagtcccgaagagtgtaagatgttcgcctgcgccaagctcgcctgcaccccctctctgatccgagctggatccagagttgcatacagaccaatttctgcatcagtgttatctcgaccagaggctagtaggactggagagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccagaaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacggatgtaattctgtgtatcttactgtgactccgaaaactgtagtattggtgtcatgggaatgtacgttatttccaaagtcatttcattaaagatgaaaacttta

SEQ ID NO: 109527 - DNA, 795 bp, Homo sapiens
  Payload ID: 1507
  Gene Symbol: ATP5G3
  Gene Name: ATP synthase, H+ transporting, mitochondrial Fo complex, subunit C3 (subunit 9)
  Uniprot ID: P48201
  ENST ID: ENST00000409194
  CDS Start-End: 146-574
agtcccactccttcgacctctgccgcagcccgtgccgccgccgcctcctgggaagcctcttttcctccgcagagaggaagcgggagaggagcccacgtcgcctgtcacccaatatctccagccgcgcagtcccgaagagtgtaagatgttcgcctgcgccaagctcgcctgcaccccctctctgatccgagctggatccagagttgcatacagaccaatttctgcatcagtgttatctcgaccagaggctagtaggactggagagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccagaaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacggatgtaattctgtgtatcttactgtgactccgaaaactgtagtattggtgtcatgggaatgtacgttatttccaaagtcatttcattaaagatgaaaactttaatttcttctgtgatttgtacttacactaagtttagattatcacaaagaagaacgtgcattcaggcagatgctgtccca

SEQ ID NO: 109528 - DNA, 603 bp, Homo sapiens
  Payload ID: 1508
  Gene Symbol: ATP5H
  Gene Name: ATP synthase, H+ transporting, mitochondrial Fo complex, subunit d
  Uniprot ID: O75947
  ENST ID: ENST00000301587
  CDS Start-End: 49-534
cttgctgcggaggaccgtgggcagccagggtcggtgaaggatcccaaaatggctgggcgaaaacttgctctaaaaaccattgactgggtagcttttgcagagatcataccccagaaccaaaaggccattgctagttccctgaaatcctggaatgagaccctcacctccaggttggctgctttacctgagaatccaccagctatcgactgggcttactacaaggccaatgtggccaaggctggcttggtggatgactttgagaagaagtttaatgcgctgaaggttcccgtgccagaggataaatatactgcccaggtggatgccgaagaaaaagaagatgtgaaatcttgtgctgagtgggtgtctctctcaaaggccaggattgtagaatatgagaaagagatggagaagatgaagaacttaattccatttgatcagatgaccattgaggacttgaatgaagctttcccagaaaccaaattagacaagaaaaagtatccctattggcctcaccaaccaattgagaatttataaaattgagtccaggaggaagctctggcccttgtattacacattctggacattaaaaataataattataca

SEQ ID NO: 109529 - DNA, 553 bp, Homo sapiens
  Payload ID: 1508
  Gene Symbol: ATP5H
  Gene Name: ATP synthase, H+ transporting, mitochondrial Fo complex, subunit d
  Uniprot ID: O75947
  ENST ID: ENST00000344546
  CDS Start-End: 71-484
ttcccgtgacccacttccgttacttgctgcggaggaccgtgggcagccagggtcggtgaaggatcccaaaatggctgggcgaaaacttgctctaaaaaccattgactgggtagcttttgcagagatcataccccagaaccaaaaggccattgctagttccctgaaatcctggaatgagaccctcacctccaggttggctgctttacctgagaatccaccagctatcgactgggcttactacaaggccaatgtggccaaggctggcttggtggatgactttgagaagaaggtgaaatcttgtgctgagtgggtgtctctctcaaaggccaggattgtagaatatgagaaagagatggagaagatgaagaacttaattccatttgatcagatgaccattgaggacttgaatgaagctttcccagaaaccaaattagacaagaaaaagtatccctattggcctcaccaaccaattgagaatttataaaattgagtccaggaggaagctctggcccttgtattacacattctggacattaaaaataataattataca

SEQ ID NO: 109530 - DNA, 533 bp, Homo sapiens
  Payload ID: 1508
  Gene Symbol: ATP5H
  Gene Name: ATP synthase, H+ transporting, mitochondrial Fo complex, subunit d
  ENST ID: ENST00000538432
  CDS Start-End: 36-281
accgtgggcagccagggtcggtgaaggatcccaaaatggctgggcgaaaacttgctctaaaaaccattgactgggtagcttttgcagagatcataccccagaaccaaaaggccattgctagttccctgaaatcctggaatgagaccctcacctccaggttggctgctttacctgagaatccaccagctatcgactgggcttactacaaggccaatgtggccaaggctggcttggtggatgactttgagaagaagctctctattatagctaagttaagttagagtgaattaaatggaagagttaacagccatataaaggaatgacttgtcaataaatgcaacaacatggacgaatttcaaaataattatgcggagtgaaagaagccaacaagaaaaagaagagtatagcatatgattccatctttgtgaaatcttgtgctgagtgggtgtctctctcaaaggccaggattgtagaatatgagaaagagatggagaagatgaagaacttaattccatttgatcagatgaccattg

SEQ ID NO: 109531 - DNA, 365 bp, Homo sapiens
  Payload ID: 1509
  Gene Symbol: ATP5I
  Gene Name: ATP synthase, H+ transporting, mitochondrial Fo complex, subunit E
  Uniprot ID: P56385
  ENST ID: ENST00000304312
  CDS Start-End: 92-301
agctccgcctttgcctccaaggctttgctggcttgtgcggcatcctgctccgtctgcaggttgtgcttccggtgcggaggtcagggacaagatggtgccaccggtgcaggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgtgata

SEQ ID NO: 109532 - DNA, 607 bp, Homo sapiens
  Payload ID: 1510
  Gene Symbol: ATP5J2
  Gene Name: ATP synthase, H+ transporting, mitochondrial Fo complex, subunit F2
  Uniprot ID: P56134
  ENST ID: ENST00000292475
  CDS Start-End: 191-475
actgcaggaccctcggatttttgctgtccaggcacctcgcccttcgcttcatggccttctagtagttccagggtgttcgcagttgtgacctgcttcccgtgagcctctgctctacgcccctggatggggcgtgcattccctacccagcagccctcgcgcggtccggcacagcggacaccaggactccaaaatggcgtcagttggtgagtgtccggccccagtaccagtgaaggacaagaaacttctggaggtcaaactgggggagctgccaagctggatcttgatgcgggacttcagtcctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagcggctccgcaaataccactgaagaggacacactctgcacccccccaccccacgaccttggcccgagcccctccgtgaggaacacaatctcaatcgttgctgaatcctttcatatcctaataggaattaacctccaaataaaacatgactggta

SEQ ID NO: 109533 - DNA, 323 bp, Homo sapiens
  Payload ID: 1510
  Gene Symbol: ATP5J2
  Gene Name: ATP synthase, H+ transporting, mitochondrial Fo complex, subunit F2
  Uniprot ID: P56134
  ENST ID: ENST00000359832
  CDS Start-End: 24-191
acagcggacaccaggactccaaaatggcgtcagttggtgagtgtccggccccagtaccagtgaaggacaagaaacttctggaggtcaaactgggggagctgccaagctggatcttgatgcgggacttcagtcctagtggcattttcggagcgtttcaaagagagcacgagcggctccgcaaataccactgaagaggacacactctgcacccccccaccccacgaccttggcccgagcccctccgtgaggaacacaatctcaatcgttgctgaatcctttcatatcctaataggaattaacctccaaataaaacatgactggta

SEQ ID NO: 109534 - DNA, 305 bp, Homo sapiens
  Payload ID: 1510
  Gene Symbol: ATP5J2
  Gene Name: ATP synthase, H+ transporting, mitochondrial Fo complex, subunit F2
  Uniprot ID: P56134
  ENST ID: ENST00000394186
  CDS Start-End: 21-287
gcggacaccaggactccaaaatggcgtcagttgtaccagtgaaggacaagaaacttctggaggtcaaactgggggagctgccaagctggatcttgatgcgggacttcagtcctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagcggctccgcaaataccactgaagaggacacactctgcac

SEQ ID NO: 109535 - DNA, 460 bp, Homo sapiens
  Payload ID: 1510
  Gene Symbol: ATP5J2
  Gene Name: ATP synthase, H+ transporting, mitochondrial Fo complex, subunit F2
  ENST ID: ENST00000449683
  CDS Start-End: 27-323
ggcacagcggacaccaggactccaaaatggcgtcagttgtgggtattttttctcactcttccgtttcagtaccagtgaaggacaagaaacttctggaggtcaaactgggggagctgccaagctggatcttgatgcgggacttcagtcctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagcggctccgcaaataccactgaagaggacacactctgcacccccccaccccacgaccttggcccgagcccctccgtgaggaacacaatctcaatcgttgctgaatcctttcatatcctaataggaattaacctccaaataaaacatgactggtacgtgt

SEQ ID NO: 109536 - DNA, 541 bp, Homo sapiens
  Payload ID: 1510
  Gene Symbol: ATP5J2
  Gene Name: ATP synthase, H+ transporting, mitochondrial Fo complex, subunit F2
  Uniprot ID: P56134
  ENST ID: ENST00000414062
  CDS Start-End: 25-174
cacagcggacaccaggactccaaaatggcgtcagttgtaccagtgaaggacaagaaacttctggaggtcaaactgggggagctgccaagctggatcttgatgcgggacttcagtcctagtggcattttcggagcgtttcaaagagagcacgagcggctccgcaaataccactgaagaggacacactctgcacccccccaccccacgaccttggcccgagcccctccgtgaggaacacaatctcaatcgttgctgaatcctttcatatcctaataggaattaacctccaaataaaacatgactgcagtgctttgaaagcatgaagcataccctgcactccctggctccctgcaggattccagcctcctgccgggctccctgcacaggaccagagccagcctcacgctgacccacagagctgcttcccgggaaacctggaagtgcagacctgagcggggaccctggggactccttccagcagggagcacatctctgccagactccgtgccagccccactgactccacccgggctcccgcttct

SEQ ID NO: 109537 - DNA, 306 bp, Homo sapiens
  Payload ID: 1510
  Gene Symbol: ATP5J2
  Gene Name: ATP synthase, H+ transporting, mitochondrial Fo complex, subunit F2
  Uniprot ID: P56134
  ENST ID: ENST00000488775
  CDS Start-End: 27-176
ggcacagcggacaccaggactccaaaatggcgtcagttgtaccagtgaaggacaagaaacttctggaggtcaaactgggggagctgccaagctggatcttgatgcgggacttcagtcctagtggcattttcggagcgtttcaaagagagcacgagcggctccgcaaataccactgaagaggacacactctgcacccccccaccccacgaccttggcccgagcccctccgtgaggaacacaatctcaatcgttgctgaatcctttcatatcctaataggaattaacctccaaataaaacatgactgg

SEQ ID NO: 109538 - DNA, 84 bp, Homo sapiens
  Payload ID: 1510
  Gene Symbol: ATP5J2
  Gene Name: ATP synthase, H+ transporting, mitochondrial Fo complex, subunit F2
  ENST ID: ENST00000523680
  CDS Start-End: 27-84
ggcacagcggacaccaggactccaaaatggcgtcagttggtgagtgtccggccccaggttactaccggtactacaacaagtaca

SEQ ID NO: 109539 - DNA, 614 bp, Homo sapiens
  Payload ID: 1511
  Gene Symbol: ATP5J
  Gene Name: ATP synthase, H+ transporting, mitochondrial Fo complex, subunit F6
  Uniprot ID: P18859
  ENST ID: ENST00000284971
  CDS Start-End: 128-454
tgaaacggcggcccataatgcattgcgatggcgggtaggcgtgtgggggcggagccagggccggaagtagagcggaggtggtggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttgagtgtgttcttgatgaattga

SEQ ID NO: 109540 - DNA, 826 bp, Homo sapiens
  Payload ID: 1511
  Gene Symbol: ATP5J
  Gene Name: ATP synthase, H+ transporting, mitochondrial Fo complex, subunit F6
  Uniprot ID: P18859
  ENST ID: ENST00000400087
  CDS Start-End: 340-666
aaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttgagtgtgttcttgatgaattga

SEQ ID NO: 109541 - DNA, 647 bp, Homo sapiens
  Payload ID: 1511
  Gene Symbol: ATP5J
  Gene Name: ATP synthase, H+ transporting, mitochondrial Fo complex, subunit F6
  Uniprot ID: P18859
  ENST ID: ENST00000400090
  CDS Start-End: 161-487
cccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccggaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttgagtgtgttcttgatgaattga

SEQ ID NO: 109542 - DNA, 1179 bp, Homo sapiens
  Payload ID: 1511
  Gene Symbol: ATP5J
  Gene Name: ATP synthase, H+ transporting, mitochondrial Fo complex, subunit F6
  Uniprot ID: P18859
  ENST ID: ENST00000400093
  CDS Start-End: 693-1019
gcggccgcgggggggcccttgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccgaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttgagtgtgttcttgatgaattga

SEQ ID NO: 109543 - DNA, 589 bp, Homo sapiens
  Payload ID: 1511
  Gene Symbol: ATP5J
  Gene Name: ATP synthase, H+ transporting, mitochondrial Fo complex, subunit F6
  Uniprot ID: P18859
  ENST ID: ENST00000400094
  CDS Start-End: 103-429
agagcggaggtggtggcggcggaggctttggcagctcgggactgagtgcaaggaatatgcactgaagaggcagcgaacctactaacctttggccgaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttgagtgtgttcttgatgaattga

SEQ ID NO: 109544 - DNA, 492 bp, Homo sapiens
  Payload ID: 1511
  Gene Symbol: ATP5J
  Gene Name: ATP synthase, H+ transporting, mitochondrial Fo complex, subunit F6
  ENST ID: ENST00000400099
  CDS Start-End: 47-406
cgtccggtcgcagactgtctccgagacgcttcctgtccgaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagagcatttttctcagcatttgagaagttggcagccatccagagatgatgacattctaatcttaagcagctaaccagcagctagccttgtagctacagaagaaaatgtttgccgatccctgactcgtggtgaaaattttattttgggggcagagccatg

SEQ ID NO: 109545 - DNA, 589 bp, Homo sapiens
  Payload ID: 1511
  Gene Symbol: ATP5J
  Gene Name: ATP synthase, H+ transporting, mitochondrial Fo complex, subunit F6
  Uniprot ID: P18859
  ENST ID: ENST00000457143
  CDS Start-End: 79-429
tagacccgtccggtcgcagactgtctccgagacgcttcctgtccggtgagcgtcgaccgactgaaacggcggcccataatgcattgcgatggcggaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttgagtgtgttcttgatgaattga

SEQ ID NO: 109546 - DNA, 1577 bp, Homo sapiens
  Payload ID: 1512
  Gene Symbol: ATP5L
  Gene Name: ATP synthase, H+ transporting, mitochondrial Fo complex, subunit G
  Uniprot ID: O75964
  ENST ID: ENST00000300688
  CDS Start-End: 513-824
tgattgctcggcccctaactttatatgtttggccttggaccctctctacctctgtacaacgatcgtgttggactagaagaatctcagcgaatccttctccagtactgacttcaaaggttctcagaatcgcggcgaaagcaccctacgcaaaatagcggaggtcggcgccaagaaaagcactgcaggttcagggcgcatgcgcatttccgctccttgccggttttccggacctctacgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctatagtct

SEQ ID NO: 109547 - DNA, 720 bp, Homo sapiens
  Payload ID: 1512
  Gene Symbol: ATP5L
  Gene Name: ATP synthase, H+ transporting, mitochondrial Fo complex, subunit G
  ENST ID: ENST00000524422
  CDS Start-End: 35-265
cggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaagaaaaaaagcagcacctgaggattctgaacagttctctgctcagtgatgatcaagccttcctttggacaagcttaaataactcagccactgttctttgttggaggactttgggactactgatgcaatgtgtccacttgggggccctttggagaaaaaattgctaatttcagaggggcagccgcaccagtggttaaggaaatccctggggagaaaatgtttctgtctggattagagagaagacatcttatttactcattcaatcttcatgataatcttgtgaagctataattaatatccttatttttgcagattaggaaactaagacgtactgaggctgggtgcctggttcaagatcatatagctaacattattggacatgcaaatcaagcccagatttgtgactctgagctgatgttaattctgtcacaatattggttctcaagataaatctttccaggtgagggggaaaggga

SEQ ID NO: 109548 - DNA, 799 bp, Homo sapiens
  Payload ID: 1513
  Gene Symbol: ATP5L2
  Gene Name: ATP synthase, H+ transporting, mitochondrial Fo complex, subunit G2
  Uniprot ID: Q7Z4Y8
  ENST ID: ENST00000505920
  CDS Start-End: 328-630
ttcaagaccagcctggccaacatggcgaaacattgtctctactaaaagtacaaaaattagccagacgtggtggtgctcacctgtaatcccagctactcgggaggctgaggcaggaaaatcacttgaacccgggaggcggaggtcacagttagccaagatcacaccactgtactccagcctgggtgatagagtgagactccatctcaaataaataaataaataaataaataaataaataaataaataaataagtgaaccacgcagggtccttccggggggtgaccttcagctggccattcgggatgatggactttccatcccagaaccatggctccatttgtccgtaaccttgtggagaagaccccagcactggtgaatgctgctgtgacttacttgaagcctcgattggccgcattttggtactacaccacggttgagctggttcctcccacccctgctgagatccctagagctattcagagcctgaaaaaaatagtcagtagtgctcagactggtagcttcaaacagctcacagttaaggaagctttgctgaacggtttggtggccactgaggtgtcgacgtggttttatgtcagagagatcacaggcaagcgtggcatcattggctagaatgtttgaagaccagtcttaacatctgattatatttgatttattatttgagtgttgttggaccaggtgtgatcagactgctatctgaataaaataagatttgtcagaaattccaaaaaaaaaaaaaagtgaatcaagcagttccaacccatgttcaagggtcaactgt

SEQ ID NO: 109549 - DNA, 1671 bp, Homo sapiens
  Payload ID: 1514
  Gene Symbol: ATP5S
  Gene Name: ATP synthase, H+ transporting, mitochondrial Fo complex, subunit s (factor B)
  Uniprot ID: Q99766
  ENST ID: ENST00000245448
  CDS Start-End: 693-1076
ggccagggtgccgcagacgcggggacgctggctcgctccctccctccctccctccgacgctgtgagtagagaagctaggccccgagccgggcgggactagggtggtggttgtgttctgccctcgcccgtcgccaacgctgggctgactgaaaacctggccctttgggtcgcgcgtcttcgaccttcaccgccatgcggacatggggccgtgggagaaactctgggcgggattacggtgaaaattcttgtttgggcgggccctgcggcttctttcttccggctcgccctcggccccgcccccgccccgcccccgctccagctccagccgggtcctcgctcggccccgcacgcggcccgcggtagacggagggcctgggcacccaccgtctccatcccggccccagcccagtcgagcgtccactagaagggcgctccctgtccggccctaatcctcgctcctcacggaggctctttgtcacagcgaagactgacagcccgcagtcttctggacttcttttatggggctcctggcggtgctattcattcagtcattgattcgtcttgtaaatatggagcgcctgctctgtactcgacccggcactgggtaccggaagaaccagacagctcggtttttgccaccatttataagtctgtgtccttttcttgagtactgaaccgagatacagttttaaatgtgctgtgcggtctctgagcagcgactcacctgtgcagatcaaatgatgccgtttggaaaaatttcccagcagttgtgtggcgtaaagaaactcccatggtcatgtgactccagatacttctggggctggttgaatgcagtgtttaataaggtggattatgatcgcatcagggatgttggccctgacagggcggcatccgagtggttgctgcgctgtggggccatggtgcgctaccatggccaggagaggtggcagaaggactacaaccaccttccaacaggccctctggacaaatacaagattcaggcgatcgacgccaccgactcttgtatcatgagcattggatttgatcacatggaaacctcaaatatttgttgttaagtgatcttcctggagtaagagaaaaagaaaatcttgtccaagcctttaagacagcactgccttctctggaactaaaattacaattgaagtaaaataatgtgtcttatttcagtataaaggatcatttgaaactgttgattccaaacatcaactaatattatatagtcatcagtagaattataaggatgccatatcatgacattttagaagtggagagtgcatcatatgtagaaaataaatattcagacgtggctcattaatgttactaagttggaagtgagaatttatgaacattaattcattttaagaaaagtgcagccaggcgcagtggctcatgcctgtaatcctagcactttgggaggccaaagcgggcagatcacctgaggtcaggagttcaagaccaaccatggccaacatggtgaaaccccatctctactaaaaaaacaaaattagctgaatgtggtggtgcacgcctttaatcccagctactctggaggctgaggcaggagaatcacttgacttgggaggtggaggttgcagggacccgagattgtgccactgcactccagcctgggtgacagagcgagactgtctc

SEQ ID NO: 109550 - DNA, 10212 bp, Homo sapiens
  Payload ID: 1514
  Gene Symbol: ATP5S
  Gene Name: ATP synthase, H+ transporting, mitochondrial Fo complex, subunit s (factor B)
  Uniprot ID: Q99766
  ENST ID: ENST00000311459
  CDS Start-End: 381-1028
gctccagctccagccgggtcctcgctcggccccgcacgcggcccgcggtagacggagggcctgggcacccaccgtctccatcccggccccagcccagtcgagcgtccactagaagggcgctccctgtccggccctaatcctcgctcctcacggaggctctttgtcacagcgaagactgacagcccgcagtcttctggacttcttttatggggctcctggcggtgctattcattcagtcattgattcgtcttgtaaatatggagcgcctgctctgtactcgacccggcactgggtaccggaagaaccagacagctcggtttttgccaccatttataagtctgtgtccttttcttgagtactgaaccgagatacagttttaaatgtgctgtgcggtctctgagcagcgactcacctgtgcagatcaaatgatgccgtttggaaaaatttcccagcagttgtgtggcgtaaagaaactcccatggtcatgtgactccagatacttctggggctggttgaatgcagtgtttaataaggtggattatgatcgcatcagggatgttggccctgacagggcggcatccgagtggttgctgcgctgtggggccatggtgcgctaccatggccaggagaggtggcagaaggactacaaccaccttccaacaggccctctggacaaatacaagattcaggcgatcgacgccaccgactcttgtatcatgagcattggatttgatcacatggagggcctagagcatgttgaaaaaataaggctgtgcaagtgtcattatatcgaggatgactgtttgctgagacttagtcaacttgaaaatttacaaaaaaccatattggaaatggaaataatatcctgtgggaatatcacagacaaaggcatcattgctttgcgtcatttaagaaacctcaaatatttgttgttaagtgatcttcctggagtaagagaaaaagaaaatcttgtccaagcctttaagacagcactgccttctctggaactaaaattacaattgaagtaaaataatgtgtcttatttcagtataaaggatcatttgaaactgttgattccaaacatcaactaatattatatagtcatcagtagaattataaggatgccatatcatgacattttagaagtggagagtgcatcatatgtagaaaataaatattcagacgtggctcattaatgttactaagttggaagtgagaatttatgaacattaattcattttaagaaaagtgcagccaggcgcagtggctcatgcctgtaatcctagcactttgggaggccaaagcgggcagatcacctgaggtcaggagttcaagaccaaccatggccaacatggtgaaaccccatctctactaaaaaaacaaaattagctgaatgtggtggtgcacgcctttaatcccagctactctggaggctgaggcaggagaatcacttgacttgggaggtggaggttgcagggacccgagattgtgccactgcactccagcctgggtgacagagcgagactgtctcaaaaaaaaaaaaaaaagaaaaatgtaaactaggtaacattttaattctaatatattcatttaatatgtaaatctatagatatctcttgatgtagatatttagaatcctttaaagttatttgtacaacagatgtttttattataacagtaatttacatttaactttaaagttagtgaagcatactaccataaatgcacaattatgaaaaattagaagctaaattacagattcattgatggagtcaattatgcaaagtggtcagtggttgttgaagcatgcattgcttcaacaggatttgcgtgcatttcccatgatcctgcattcttgtgttcttgatagcatacagacttactcagaatcaacagttgctgcttaatttgtctattttgtaagcttaggctactattttattaaaactggacatagatacttggctgaatacaaatagttttgcagattgcaatataataaaggaaacagtaaaaactagtgggctatgcttaggtttttcttgaaacctaacattgctttaggctgggtgccgtggctcgtgcctgtaatcccagtgctttgggaggctgaggtgggaggatcacttgagaccaggagtttgagaccaatttgggcaacacagtgagaccccatctctaaaaaaattttaaaaattaggcaggcatggtggtgcatacctgtaatctcagatacttgggaggttgaggtggtaggattgcttgagctcaggagtttgaggctgcagtaagctatgatcacggccactgcacaccagcctggtagcctgggtgaaagggggagaccctgtctcttaaaaaaaagggctggcctgtaatcccagcacttttgaaggccaaggcaggcagatcatttgagcccaggagttcaggacgagcctgggcaacatggcaaaaccctgtctctaccaaaaaattaaaaaataaaaaatagctgggtgtagtggcacatgcctgtagtcccaactactcaggagtctgaggtaggaggatcagttgagcccgggaagtcgaggctgcagtgagccatgttggcaccactgcactccagcctgggcaacagattaagaccctgtctcaaaaaaaaaaaaaaaagtgaaaaatagataaaacaggtcttcattgttacctgtgagaaatggccctgattctattactcttatatgccagtttgtttatagatttctgtgtgtttgatttgaacttttttttttttttttttttttttgagacagactctcactctgttgcccaggttggagtgcagtggtgtgatctcagttcactgcaacctctgcctcccgggttcaagcagttctctgtcgcagcgtcccaggtagctgggattacaggcgcccaccaccacgcccagctaatttttgtacttttagtagagacagggtttcaccatcttggccagactggtcttgaactcctaacctcaggatccacccgcctcggcctcccaaagtgctgggagccaccgcgcccagcctggtttgaacattattaagctgttgaatataaacttgaaaataattttctatgatacagctttcaggtagaaaaatgaattttcgttgtgtttaacaatgttgtgtttaacagcttatacaaataacacagtataaatggtaattgccactgtcattttaaaaatcagaaaatagtaaataaaaggatgtggaagagtctcatgtgatacagtggagatttcataccgaataaaagcattataaatatggttaaattgaacataagcataaatttaacggaactcattagaaaaaaataagccttttttctcaggtttgtttcattactgtatggtgagacaactgattcaccacgatttagtctagagctacttttctattctgaatagtttttggtaaaactattggctgaattattaggctgttatagtaatctgcctccgtcaagtgtattttcttgggttaaggaaaaaaaaatttttttttaactattcacggaagctggatgttcttccttgtcatttgaatcaaggccgtctaacaggaattgaataattcagggactagcatttaacccatatcaggtctaggcaagaaaagacatacattaggaagccttaggatatcattaaactgcctagggtagtcaaaattattgagtagacaccagacctcagtggattacttaagtaaatggggtcagatgtcatcatgaagaaaattaacaggaagaaaatgagagtacagaagaaatgttttgaaaatagagtgaaatacaactttgaagaccatggctgagaagtgctaggaatagtggcagcacatcaaccagaaatggtgttgagctgtaagaaacagacgtcaggcttcatattgcccttgtgtccaggggacaaggatgaaaaagctttttgattaagagcagtagaccaaatcaaagctaattatgtcattttggccaggcgcagtggctcatgcctgtaatgccagcactttggaaggccaaggcgctcagatcacgtgagcccaggagttcaagaccagcctggggaacatggcaaaaccctgcctctaccaaaaaatacaaaaaaattagccagtatagtggcacatgcctgcagtcccagctacttgggaggctgaggtggcaggttttatatatatatataaaaaacacatatatatatatgtgtgtgtgtgtcatcattttaagtctcactgtgcaaagctatgagtcctcaatactttggactacttagtgtaatatattagttgttagaatagcatatatatatatatatatatatatatacatacacatacatacacatacaaacatagtgcaaaaagatgtttcagggaaaacatcagtttacaacataatgtctttcatgactcaagtaaaagctcacaagtaatttcttctgaaacccagatcactgaattacaggtttgcctatagatgtaccaggtcaaaggctgtgccagagagaatgaaatactaattattttcaggctgataggttcagttcctgcaaagcctgtaggtcttgctctaccctttgactgccttaatcagctgccgagcttcatgccattgtttacaaggggaattgggtgaataaatgtagacagattacagtaaatccacgttgcctgcaaaagtgactaaggtgtatcctttactgataaagtaaggatgaaatgtggaaacatataattaaattataaattaccaagcttttgtgataattcatatgcttttaaatattttgaacctaagtgttaccctcaaaatgttttaaaatataaaaatcaagaaatagagcaagcaggaaatgggattttaaacattttgatttcaagaaatagaactatcttaaatatgatgctgaaacaatctgagaggcaggagataggactcaggcaacagagatccgaggaaatatatatgggcattttgtggttcatttttcttgtgtggcatgtggtacaactgaagcataaatctttttgatatcatctagttttgccagaggtatgggacagttcatattctgtccataagttcggctacttacataaactgaaatacaagtgcaactccaaacaggttttttcttttctggacaccatcatcaagcatggaagactggatctggaatttcccttcatatcttgccagttggcctcccagtttcttgcttatgttttctcctggtgtgttttcaacattgtaattgttttcaatcaactgtataagttttattttcttcaaagcatctattgattccttttttaaaatcatgtctcctagctcctttaaatgtttggaaaacggtagttaagtttcttggtatcacagtagtacttcttattatccaaagctggaaggatgctgctgccagttagctggggtaggtactgcaactaaaaatgcaaaacacagaattaggttcaaaactgtgccatgcatttttttcattatttagaatatatcacaaaagaggtaattaagctttttagtatagaagtactttttttgcacacaatccaggacttgagagaggattaaatgtttcaatttcgtcttggcttttccttttaaatgtttatattaaaaaggaaaaacattcacattaaagaagatttagagaatatgaaaaggggaaaatctacatgttaacattattgggaagaaaacatagatttacaggagttgagagcttgctgagatcttagggatcatttaagccaatgccttgtcttatagcggagaaaactgataaacagagcacctaggcaatttgcctactcactctcttcccttagttaaaaaggcaaatcaagcatggcacagtgtacacttgtagttccagctacaagggaggctgagtgggagcatcccttgagcccaggagagcagcctgggcaacatagcaagatccccatctctaaagaaaaaagacaaactgcttccttcaagcttcctgaaaatgtttgaatttattgtcaatgtcaaatgaaagaacacacctgtattttttgtattgcactatatgtccttcggtatccctaaaaagggaactgtttagtacttttactttctagaaaaaaatttttcagccattgtcctcagaaaagtgctttttagtacttttaaatcagttgattctttcaggatttaaaagcagtacaccaggccaggtgcggtggctcatgcctgtaatcccagcactttgggaggccaaggcggatggatcacctgaggtcaggagtcgagaccagcctgccaacatggcgaaaccctgtctctactaaaaatatagaaattagttaggcatactggcacatgcctgtaatcccagctactggggaggctgaggcaggagactcacttgaacctgggaggcagaggttgcagtgagccaagatcataccactgcactctagcctgagcgacagagtgagactcagtctcaaaaaaaatcaatacaccaaatagtggagtttccctattttttcaaatagaaatatttccatcaaaaccttttgctctcgaatacaaactaatactgagataaggaataattctggcgtgggggtggaggagtctgtttctggcctgttgtgctacctgggtcacatatgatggagaataaaacattaattttgtaactgtgatctacattagggccctggagttcatgctgtacttgttcctcatggacctttttcacccttttccctcctcccagcctcatacacaacacaccctggtaccattcagcatgctgggcagtggaagctgcaaagagaaagactaaggcaagataatgtatagcttaaggagtacctaggtagatcctgaggttacccaggatcagttgtggttccaactacagttcattctaaattattacagcttttggcttatcacaagatgcttaatgtaaggccattttataccaatcaggattcttcacagtctcccagtgtgcagtttggatgctgttctctggttaaatgtattcagctgataccaccaaaagcactcatcactgtatttgccctagccaactctgacaaaggatcagggaggaaaacagctccttttttggacaaacctggagtgttagttttaatactaaaagtgtacatgatgacacagaactgcatggggaaaatctgatttcattttccaaagcccaaaaagtctccttagctggactcatactcatgtaccttgttgagacctgtgctcatgcaggctggaaaccctggcccctgtgtggcatcaggaagcagcaggacaagggcacctttaggattcagggagagggggcttcaggagacagatgtccctggggccctggttgatagatcctatgacctgtctcctagtgctggaatgaggatgctggagctgaaagccacaactgccatcctcaagtctagattccaactctctgtaccaggtggcaggtaggagatcatttcaaattataaccttggatgtttctgtaaagcagtggtgctttcggctctttcttagggtcttccttgttggtttgttgtgttcttttgccaaatcctctatttctctgatgttttcaaaatatgggtgatgcaacagctgttcacatgtcagcctttgagtagggtccatgtggagacagccctaaaagaacagaaaattccttcttcttacttcttcaaaattgtattaacttattaatgtcatttttttcttctttgaaagatgaaacttcagttgcaataagaagggggaaaaggcaggaaaacacaccagtcatgattttagttccttccagtcattcctaaatggcactcacatattaaataaatagtttctagaagtagtaatgaaaaatcattttctccaccttattctgttcttgaagcaattggtactctgccctgggagagtaagatataattttagagtttacctcagtggccaaatggggtaatccatttagccagtttggtcccttgcatgtactttgtaaaaactagtgtttttattttaaaaatgatatttacacatgataacaaatacagttaatacagcatacagcaaagtctccaccactgtaggtgttcccttcacccttctaaaatcagctacttttttttttttttttttttggtgtatccctccagaaatagttgatgcattataagtatatatgatcatgtatataaggagaggcataacgtacatgcctttatattacatcattcttaactatttttgttgcaactaagtaggccatggagctcattcttggatagattagattaaatttcacaactacatactccaaggaattgactcagtttttgttggttatgtcagaggtgttgaaaccacagcaacaccatcttgaataggggctgggtaaaataaggctgagacctactgggctgcattcccaggaggtttggcattgttactcacaggatgagatagcaggtcggcacaaaatataggtcacaatgacctgatgataaaacaggatgcagtaaagaagccggccaaaaccaagatggtgatgaaagtgatgtctggttgtcctcactcctcgttgtacactaattataatgtgttagcatgctaaaagacactttcaccagcaccatgacagtctacaaatacccatagcaatgcccagaagttaccctaaatagtctaaaaaggggaggaaccctcagttccagaaaatccctgccctctcctggaaaactcataaaccaccccttgtttagcatataatcaagaaataactgtaagtatactcagttgagcagcccacagcactgctgcctatagagtagccattcttttattcctttactttgttaataaatttgcttccactttactgtgtggacacgccctgaattctttcttgcatgaggtccaagaaccttcctttggggtccggattgggacccctttcaggtaacagttacattatcatttatattaactcattatttaatacatcagtaaataaataatttttaaaccatgtgggacattgactgtaacttgcaaacattttagttgataccatacctcattttacataagagctatatttctaaatatatatatatataaatatatatatcaagtttttaaatgtacttcaaatgtaccagggagttagctatttaaaaggatcctgcagctaaggattttctgaagaaaaagttccctttgtaaaacaatcaccacccccctgaaatttctgttttgtgtaaatttagacttcaaatataatgttaggtttatttaaagtggaaaatacttgcaaatgttttcttaataggatgtgatccatttaaaaaaattgaaaatatacttttccaaggagaattttttttttttttgagacggagtcttactctgtcacccaagctggagtgcagtcgtgcaatctcaactcactgcaacctccgcctcccaggctcaagcaattctcccgcctcaccctcctgagtagtcgggattacaggcgagcgccaccacgcctaattttttttatttttagtagagacggtttcaccatgttgaccaggctggttttgaactgacctcaggtgatctgcctgccttggcctcccaaagtgctaggattacaggtgtgagccactgcccagccaggagaagaattctaaaaggaacacttttcattgcatggattgacataagtaattcagattccccagtgatgacaactgctgtgtgcttcctggtctgttggaagccatgatttttacctttaggagccccagggcaggataagagatgtttgggaattttaattcaagtggttcctgttgaaaagaaaagaggtttttaatttacagcatgtattcaaattaaggttacctcaaattaaatcttttgatagaaacattttcctggcaccttcctcacgtcctccaccctttgcccacccaacctcctgcccaaaacagtctccctttgcctttttcacaagctttctctccccacctccaaatcgcttttccaaatttgcttcgtaactactcccttaacttcctgctctgataccaatggagatagcaaattataaataaaaatactaatgaaaaaaaa

SEQ ID NO: 109551 - DNA, 801 bp, Homo sapiens
  Payload ID: 1514
  Gene Symbol: ATP5S
  Gene Name: ATP synthase, H+ transporting, mitochondrial Fo complex, subunit s (factor B)
  ENST ID: ENST00000358473
  CDS Start-End: 1-801
atgataagaggtagtggagcagaggcttgcagtaatgaagacggctgtagtgaaaaagggatgaaaggggtggattatgatcgcatcagggatgttggccctgacagggcggcatccgagtggttgctgcgctgtggggccatggtgcgctaccatggccaggagaggtggcagaaggactacaaccaccttccaacaggccctctggacaaatacaagattcaggcgatcgacgccaccgactcttgtatcatgagcattggatttgatcacatggagggcctagagcatgttgaaaaaataaggctgtgcaagtgtcattatatcgaggatgactgtttgctgagacttagtcaacttgaaaatttacaaaaaaccatattggaaatggaaataatatcctgtgggaatatcacagacaaaggcatcattgctttgcgtcatttaagaaacctcaaatatttgttgttaagtgatcttcctggagctggaaaccctggcccctgtgtggcatcaggaagcagcaggacaagggcacctttaggattcagggagagggggcttcaggagacagatgtccctggggccctggttgatagatcctatgacctgtctcctagtgctggaatgaggatgctggagctgaaagccacaactgccatcctcaagtctagattccaactctctgtaccaggtggcagcctgctgtttaaacagtctcctgtggggcattcgtcaatctccttttggccgtataaggcgattttgcgccagtcacgtgctggagacaatcaggaataa

SEQ ID NO: 109552 - DNA, 1171 bp, Homo sapiens
  Payload ID: 1514
  Gene Symbol: ATP5S
  Gene Name: ATP synthase, H+ transporting, mitochondrial Fo complex, subunit s (factor B)
  Uniprot ID: Q99766
  ENST ID: ENST00000426751
  CDS Start-End: 638-1048
gacgctgtgagtagagaagctaggccccgagccgggcgggactagggtggtggttgtgttctgccctcgcccgtcgccaacgctgggctgactgaaaacctggccctttgggtcgcgcgtcttcgaccttcaccgccatgcggacatggggccgtgggagaaactctgggcgggattacggtgaaaattcttgtttgggcgggccctgcggcttctttcttccggctcgccctcggccccgcccccgccccgcccccgctccagctccagccgggtcctcgctcggccccgcacgcggcccgcggtagacggagggcctgggcacccaccgtctccatcccggccccagcccagtcgagcgtccactagaagggcgctccctgtccggccctaatcctcgctcctcacggaggctctttgtcacagcgaagactgacagcccgcagtcttctggacttcttttatggggctcctggcggtgctattcattcagtcattgattcgtcttgtaaatatggagcgcctgctctgtactcgacccggcactgggtaccggaagaaccagacagctcggtttttgccaccatttataagtctgtgtccttttcttgagtactgaaccgagatacagttttaaatgtgctgtgcggtctctgagcagcgactcacctgtgcagatcaaatgatgccgtttggaaaaatttcccagcagttgtgtggcgtaaagaaactcccatggtcatgtgactccagatacttctggggctggttgaatgcagtgtttaataaggtggattatgatcgcatcagggatgttggccctgacagggcggcatccgagtggttgctgcgctgtggggccatggtgcgctaccatggccaggagaggtggcagaaggactacaaccaccttccaacaggccctctggacaaatacaagattcaggcgatcgacgccaccgactcttgtatcatgagcattggatttgatcacatgggtaactaccctatcgttttgctaatagaaaatgcagatgatttgcagtgaccattttgttgcagttgactcacgattatagtcataggtatgtcctttttgcccatttcattatagtcaagtttgtttcttcctgtgtttgatatttattttcaaattaaattgaggttacag

SEQ ID NO: 109553 - DNA, 1476 bp, Homo sapiens
  Payload ID: 1514
  Gene Symbol: ATP5S
  Gene Name: ATP synthase, H+ transporting, mitochondrial Fo complex, subunit s (factor B)
  ENST ID: ENST00000554204
  CDS Start-End: 462-506
tacggtgaaaattcttgtttgggcgggccctgcggcttctttcttccggctcgccctcggccccgcccccgccccgcccccgctccagctccagccgggtcctcgctcggccccgcacgcggcccgcggtagacggagggcctgggcacccaccgtctccatcccggccccagcccagtcgagcgtccactagaagggcgctccctgtccggccctaatcctcgctcctcacggaggctctttgtcacagcgaagactgacagcccgcagtcttctggacttcttttatggggctcctggcggtgctattcattcagtcattgattcgtcttgtaaatatggagcgcctgctctgtactcgacccggcactgggtaccggaagaaccagacagctcggtttttgccaccatttataagtctgtgtccttttcttgagtactgaaccgagatacagttttaaatgtgctgtgcggtctctgagcagcgactcacctgtgcaggataagtgcccaagagtacaattgctgggtcatatgatcaaatgatgccgtttggaaaaatttcccagcagttgtgtggcgtaaagaaactcccatggtcatgtgactccagatacttctggggctggttgaatgcagtgtttaataaggtggattatgatcgcatcagggatgttggccctgacagggcggcatccgagtggttgctgcgctgtggggccatggtgcgctaccatggccaggagaggtggcagaaggactacaaccaccttccaacaggccctctggacaaatacaagattcaggcgatcgacgccaccgactcttgtatcatgagcattggatttgatcacatggaaacctcaaatatttgttgttaagtgatcttcctggagtaagagaaaaagaaaatcttgtccaagcctttaagacagcactgccttctctggaactaaaattacaattgaagtaaaataatgtgtcttatttcagtataaaggatcatttgaaactgttgattccaaacatcaactaatattatatagtcatcagtagaattataaggatgccatatcatgacattttagaagtggagagtgcatcatatgtagaaaataaatattcagacgtggctcattaatgttactaagttggaagtgagaatttatgaacattaattcattttaagaaaagtgcagccaggcgcagtggctcatgcctgtaatcctagcactttgggaggccaaagcgggcagatcacctgaggtcaggagttcaagaccaaccatggccaacatggtgaaaccccatctctactaaaaaaacaaaattagctgaatgtggtggtgcacgcctttaatcccagctactctggaggctgaggcaggagaatcacttgacttgggaggtggaggttgcagggacccgagattgtgccactgcactccagcctgggtgacagagcgagactgtctc

SEQ ID NO: 109554 - DNA, 4473 bp, Homo sapiens
  Payload ID: 1515
  Gene Symbol: AGTPBP1
  Gene Name: ATP/GTP binding protein 1
  ENST ID: ENST00000337006
  CDS Start-End: 68-3904
ctgcgcgtgctgggagccggctggcaaggcgtgcggtgggcggggcgccgcgctgacgttgcccgggatgcggacaggttccgccgcctccagcgccgccgccgcagctgccgccgccgccgcctccgcctcgcctgccaccggggtttgtatgaaaacaccgggcggcgggcggcgagggatccgccgtgatccaggtgctgagccgggtgctgcggctctgcgcggtccccgccagcgccccatcctgagccgccttaccaataattctaggatcgtaggactcctggctcaactggagaagatcaatgctgagccttcagaatcagacactgcccgatatgttacatcaaaaattcttcatctggctcagagtcaagaaaaaacaaggagagaaatgacagccaaaggttctacaggaatggaaattctgctgtcaacattagagaacacaaaagatcttcaaactacacttaatatcttaagcattcttgttgagctggtgtcagctggtggaggtcgaagagtgagtttcttagtcaccaaaggtggttcacaaatattgttgcagttacttatgaatgccagcaaagaatctcccccacatgaggacttaatggtacagattcattctattcttgcaaagattggaccaaaagataaaaaatttggagtaaaggctagaattaatggggctctgaatataaccctgaatttggtcaagcagaatttgcagaatcatcgcttggttctaccttgccttcagcttttacgagtatattctgccaactctgtgaattcagtatccttagggaaaaatggagttgtggaactgatgtttaaaatcattggaccatttagtaagaagaattccagtcttataaaggttgctttagacactcttgctgcattgctaaaatcaaaaacaaatgccaggagagctgtagacagaggatatgtccaagtgcttttaacaatttatgtagattggcaccgccatgataaccggcatagaaacatgctcattcggaaaggaattttacagagtttaaaaagtgttacaaacatcaagttgggaagaaaagcatttattgatgccaatgggatgaaaattctgtataatacttcgcaagaatgtctggcagtcaggactctggatcctcttgtcaatacctccagtctgataatgaggaagtgtttcccaaaaaatcgactgccactcccaacaattaaaagttcttttcatttccagttgcctgttattcctgtgactggtcctgtggctcagctctacagcttacctcctgaagtggatgacgtagtagatgaaagtgatgacaacgatgatattgatgtagaagctgaaaacgaaactgagaatgaagatgacctagatcaaaattttaagaatgatgatattgaaacagatattaacaaactaaaaccccagcaagaaccgggacgaacaatagaagatctaaaaatgtatgaacaccttttccctgagcttgttgatgattttcaggactatgatttaatctccaaagaaccaaagccttttgtatttgagggaaaagtacgtggtcctattgttgttcctacggcaggcgaggaaacatctgggaattctggcaatttaagaaaagttgtaatgaaggagaacatatcttctaaaggagatgaaggtgaaaagaagtctacctttatggatctagcaaaagaagatattaaagataatgatagaacattacaacagcagccaggtgatcaaaatagaactatttcatcagtccatggtttaaacaatgatattgtaaaggccttggaccgaattacattgcagaatattccttctcaaacagccccaggttttactgcagaaatgaagaaggactgcagtcttcctcttactgtccttacctgtgctaaagcatgtccacacatggctacttgtggaaatgttctgtttgagggaagaacagttcagctagggaagctttgctgcactggagttgaaactgaagatgatgaagatactgagtcaaattcatcggtagaacaagcatcggttgaagtacctgatggaccaacactccatgacccagacctctatattgagattgtgaaaaatacgaagtctgtcccagaatattcagaggtggcttatcccgattattttggtcacattccgcctccattcaaagagcctattttagaaaggccttatggtgtacaaaggacaaaaattgctcaagatattgaaaggctaatacatcagagtgatatcatagatcgtgtggtatatgacttggataacccaaattacaccattccagaagagggagatattttgaaatttaactccaaatttgagtctgggaatctgcgcaaagtaattcaaattagaaaaaatgaatatgatcttattctgaactcagacataaacagcaatcattatcatcagtggttttactttgaagtcagtggaatgcgaccaggtgttgcttacaggtttaacatcattaactgtgaaaagtccaacagtcagtttaattatggtatgcaaccactcatgtattcggttcaggaagcattaaatgccagaccatggtggattcgtatggggactgacatttgttactataaaaatcatttctcaagaagttcagttgctgcaggtgggcaaaagggaaaatcctactatacaattacatttactgtcaattttccacataaagatgatgtttgctactttgcttatcactatccatatacgtattcaactttacagatgcatcttcaaaaattggaatcagcacacaatcctcagcaaatctattttcggaaagatgtgttatgtgaaaccctgtctggaaacagctgccccttggtgactataacagcaatgccagagtctaattattatgaacatatctgccatttcagaaatcgcccttacgttttcttgtctgctcgggtacatcctggagaaactaatgcaagttgggttatgaaaggaacgttggaatatctcatgagcaataaccccactgctcagagcttacgagaatcttatatttttaaaattgtccctatgttaaatccagatggtgtcatcaatggaaatcatcgctgttctttaagtggagaggatttgaataggcagtggcaaagtccaagtccggatttacatcctacaatttaccatgctaaggggctgttgcaatacttggctgcagtgaagcgtttacccttggtttattgtgattatcatggccattcccgaaagaagaatgtatttatgtatggttgcagcatcaaagagacagtgtggcataccaatgataatgcaacttcatgtgatgttgtggaggatacgggatacaggacattgcctaagatactgagccatatcgccccagcattttgcatgagcagctgtagcttcgtagtggaaaaatctaaagaatccacagcacgtgttgtagtttggagggaaataggagtacaaagaagttataccatggagagtactttatgtggctgtgatcagggaaaatacaagggtttacagattggtacccgagaactggaagagatgggagcaaaattttgtgttggtcttttacgtttgaaaagactgacctctccattggagtataatctgccttccagcctgcttgactttgaaaatgatttaattgaatcaagctgcaaagtaactagccctaccacttatgtcttggatgaagatgaacctcgattccttgaagaagttgattacagtgcagaaagtaatgatgagttagatattgagttggctgaaaatgtaggagattatgaaccttctgctcaagaagaagtactttctgactctgaattatcaagaacatacctaccttgagcccgctgccatctcttgttaactgcaaagaataaatgaaatatcttggtttttatttcccaggaagcttgagagaaatgagtttatacagagctgactcaaaaagacaaaaagtaacttgggccagtttggtttcaagataataaatgtgttattaattaatgataaaattggcgcttgttttattttcgatattcaatgcactttatgtagcattgaatgatcaaatattggatttacctttaaaaaaaaaacctgagtatcattgcatgaatttttatctccctatggttatatcctgcatcaagtggataattttgaagtgtgttcagaatataaaattgaaattttagagttgttgaaaatcctgacttgttgaaaactaatatatatgtacatggatttctatagatgtgtttgtttagaagtgggtagatattgcagataagactgttcttcagaatcatgttaactattgggttgtgactgaagtagtccagggtttgccttgaaaccattacattctacatttaccaaattaaacaaataaaaactgtattaaatgttgc

SEQ ID NO: 109555 - DNA, 4393 bp, Homo sapiens
  Payload ID: 1515
  Gene Symbol: AGTPBP1
  Gene Name: ATP/GTP binding protein 1
  Uniprot ID: Q9UPW5
  ENST ID: ENST00000357081
  CDS Start-End: 146-3826
gggtttgtatgaaaacaccgggcggcgggcggcgagggatccgccgtgatccaggtgctgagccgggtgctgcggctctgcgcggtccccgccagcgccccatcctgagccgattatctgcaattatgaaatgaagtaactcaagatgagcaagttaaaagtgataccagaaaaaagccttaccaataattctaggatcgtaggactcctggctcaactggagaagatcaatgctgagccttcagaatcagacactgcccgatatgttacatcaaaaattcttcatctggctcagagtcaagaaaaaacaaggagagaaatgacagccaaaggttctacaggaatggaaattctgctgtcaacattagagaacacaaaagatcttcaaactacacttaatatcttaagcattcttgttgagctggtgtcagctggtggaggtcgaagagtgagtttcttagtcaccaaaggtggttcacaaatattgttgcagttacttatgaatgccagcaaagaatctcccccacatgaggacttaatggtacagattcattctattcttgcaaagattggaccaaaagataaaaaatttggagtaaaggctagaattaatggggctctgaatataaccctgaatttggtcaagcagaatttgcagaatcatcgcttggttctaccttgccttcagcttttacgagtatattctgccaactctgtgaattcagtatccttagggaaaaatggagttgtggaactgatgtttaaaatcattggaccatttagtaagaagaattccagtcttataaaggttgctttagacactcttgctgcattgctaaaatcaaaaacaaatgccaggagagctgtagacagaggatatgtccaagtgcttttaacaatttatgtagattggcaccgccatgataaccggcatagaaacatgctcattcggaaaggaattttacagagtttaaaaagtgttacaaacatcaagttgggaagaaaagcatttattgatgccaatgggatgaaaattctgtataatacttcgcaagaatgtctggcagtcaggactctggatcctcttgtcaatacctccagtctgataatgaggaagtgtttcccaaaaaatcgactgccactcccaacaattaaaagttcttttcatttccagttgcctgttattcctgtgactggtcctgtggctcagctctacagcttacctcctgaagtggatgacgtagtagatgaaagtgatgacaacgatgatattgatgtagaagctgaaaacgaaactgagaatgaagatgacctagatcaaaattttaagaatgatgatattgaaacagatattaacaaactaaaaccccagcaagaaccgggacgaacaatagaagatctaaaaatgtatgaacaccttttccctgagcttgttgatgattttcaggactatgatttaatctccaaagaaccaaagccttttgtatttgagggaaaagtacgtggtcctattgttgttcctacggcaggcgaggaaacatctgggaattctggcaatttaagaaaagttgtaatgaaggagaacatatcttctaaaggagatgaaggtgaaaagaagtctacctttatggatctagcaaaagaagatattaaagataatgatagaacattacaacagcagccaggtgatcaaaatagaactatttcatcagtccatggtttaaacaatgatattgtaaaggccttggaccgaattacattgcagaatattccttctcaaacagccccaggttttactgcagaaatgaagaaggactgcagtcttcctcttactgtccttacctgtgctaaagcatgtccacacatggctacttgtggaaatgttctgtttgagggaagaacagttcagctagggaagctttgctgcactggagttgaaactgaagatgatgaagatactgagtcaaattcatcggtagaacaagcatcggttgaagtacctgatggaccaacactccatgacccagacctctatattgagattgtgaaaaatacgaagtctgtcccagaatattcagaggtggcttatcccgattattttggtcacattccgcctccattcaaagagcctattttagaaaggccttatggtgtacaaaggacaaaaattgctcaagatattgaaaggctaatacatcagagtgatatcatagatcgtgtggtatatgacttggataacccaaattacaccattccagaagagggagatattttgaaatttaactccaaatttgagtctgggaatctgcgcaaagtaattcaaattagaaaaaatgaatatgatcttattctgaactcagacataaacagcaatcattatcatcagtggttttactttgaagtcagtggaatgcgaccaggtgttgcttacaggtttaacatcattaactgtgaaaagtccaacagtcagtttaattatggtatgcaaccactcatgtattcggttcaggaagcattaaatgccagaccatggtggattcgtatggggactgacatttgttactataaaaatcatttctcaagaagttcagttgctgcaggtgggcaaaagggaaaatcctactatacaattacatttactgtcaattttccacataaagatgatgtttgctactttgcttatcactatccatatacgtattcaactttacagatgcatcttcaaaaattggaatcagcacacaatcctcagcaaatctattttcggaaagatgtgttatgtgaaaccctgtctggaaacagctgccccttggtgactataacagcaatgccagagtctaattattatgaacatatctgccatttcagaaatcgcccttacgttttcttgtctgctcgggtacatcctggagaaactaatgcaagttgggttatgaaaggaacgttggaatatctcatgagcaataaccccactgctcagagcttacgagaatcttatatttttaaaattgtccctatgttaaatccagatggtgtcatcaatggaaatcatcgctgttctttaagtggagaggatttgaataggcagtggcaaagtccaagtccggatttacatcctacaatttaccatgctaaggggctgttgcaatacttggctgcagtgaagcgtttacccttggtttattgtgattatcatggccattcccgaaagaagaatgtatttatgtatggttgcagcatcaaagagacagtgtggcataccaatgataatgcaacttcatgtgatgttgtggaggatacgggatacaggacattgcctaagatactgagccatatcgccccagcattttgcatgagcagctgtagcttcgtagtggaaaaatctaaagaatccacagcacgtgttgtagtttggagggaaataggagtacaaagaagttataccatggagagtactttatgtggctgtgatcagggaaaatacaagggtttacagattggtacccgagaactggaagagatgggagcaaaattttgtgttggtcttttacgtttgaaaagactgacctctccattggagtataatctgccttccagcctgcttgactttgaaaatgatttaattgaatcaagctgcaaagtaactagccctaccacttatgtcttggatgaagatgaacctcgattccttgaagaagttgattacagtgcagaaagtaatgatgagttagatattgagttggctgaaaatgtaggagattatgaaccttctgctcaagaagaagtactttctgactctgaattatcaagaacatacctaccttgagcccgctgccatctcttgttaactgcaaagaataaatgaaatatcttggtttttatttcccaggaagcttgagagaaatgagtttatacagagctgactcaaaaagacaaaaagtaacttgggccagtttggtttcaagataataaatgtgttattaattaatgataaaattggcgcttgttttattttcgatattcaatgcactttatgtagcattgaatgatcaaatattggatttacctttaaaaaaaaaacctgagtatcattgcatgaatttttatctccctatggttatatcctgcatcaagtggataattttgaagtgtgttcagaatataaaattgaaattttagagttgttgaaaatcctgacttgttgaaaactaatatatatgtacatggatttctatagatgtgtttgtttagaagtgggtagatattgcagataagactgttcttcagaatcatgttaactattgggttgtgactgaagtagtccagggtttgccttgaaaccattacattctacatttaccaaattaaacaaataaaaactgtattaaatgtt

SEQ ID NO: 109556 - DNA, 4208 bp, Homo sapiens
  Payload ID: 1515
  Gene Symbol: AGTPBP1
  Gene Name: ATP/GTP binding protein 1
  Uniprot ID: Q9UPW5
  ENST ID: ENST00000376083
  CDS Start-End: 78-3638
gctgcggctctgcgcggtccccgccagcgccccatcctgagccgattatctgcaattatgaaatgaagtaactcaagatgagcaagttaaaagtgataccagaaaaaagccttaccaataattctaggatcgtaggactcctggctcaactggagaagatcaatgctgagccttcagaatcagacactgcccgatatgttacatcaaaaattcttcatctggctcagagtcaagaaaaaacaaggagagaaatgacagccaaaggttctacaggaatggaaattctgctgtcaacattagagaacacaaaagatcttcaaactacacttaatatcttaagcattcttgttgagctggtgtcagctggtggaggtcgaagagtgagtttcttagtcaccaaaggtggttcacaaatattgttgcagttacttatgaatgccagcaaagaatctcccccacatgaggacttaatggtacagattcattctattcttgcaaagattggaccaaaagataaaaaatttggagtaaaggctagaattaatggggctctgaatataaccctgaatttggtcaagcagaatttgcagaatcatcgcttggttctaccttgccttcagcttttacgagtatattctgccaactctgtgaattcagtatccttagggaaaaatggagttgtggaactgatgtttaaaatcattggaccatttagtaagaagaattccagtcttataaaggttgctttagacactcttgctgcattgctaaaatcaaaaacaaatgccaggagagctgtagacagaggatatgtccaagtgcttttaacaatttatgtagattggcaccgccatgataaccggcatagaaacatgctcattcggaaaggaattttacagagtttaaaaagtgttacaaacatcaagttgggaagaaaagcatttattgatgccaatgggatgaaaattctgtataatacttcgcaattgcctgttattcctgtgactggtcctgtggctcagctctacagcttacctcctgaagtggatgacgtagtagatgaaagtgatgacaacgatgatattgatgtagaagctgaaaacgaaactgagaatgaagatgacctagatcaaaattttaagaatgatgatattgaaacagatattaacaaactaaaaccccagcaagaaccgggacgaacaatagaagatctaaaaatgtatgaacaccttttccctgagcttgttgatgattttcaggactatgatttaatctccaaagaaccaaagccttttgtatttgagggaaaagtacgtggtcctattgttgttcctacggcaggcgaggaaacatctgggaattctggcaatttaagaaaagttgtaatgaaggagaacatatcttctaaaggagatgaaggtgaaaagaagtctacctttatggatctagcaaaagaagatattaaagataatgatagaacattacaacagcagccaggtgatcaaaatagaactatttcatcagtccatggtttaaacaatgatattgtaaaggccttggaccgaattacattgcagaatattccttctcaaacagccccaggttttactgcagaaatgaagaaggactgcagtcttcctcttactgtccttacctgtgctaaagcatgtccacacatggctacttgtggaaatgttctgtttgagggaagaacagttcagctagggaagctttgctgcactggagttgaaactgaagatgatgaagatactgagtcaaattcatcggtagaacaagcatcggttgaagtacctgatggaccaacactccatgacccagacctctatattgagattgtgaaaaatacgaagtctgtcccagaatattcagaggtggcttatcccgattattttggtcacattccgcctccattcaaagagcctattttagaaaggccttatggtgtacaaaggacaaaaattgctcaagatattgaaaggctaatacatcagagtgatatcatagatcgtgtggtatatgacttggataacccaaattacaccattccagaagagggagatattttgaaatttaactccaaatttgagtctgggaatctgcgcaaagtaattcaaattagaaaaaatgaatatgatcttattctgaactcagacataaacagcaatcattatcatcagtggttttactttgaagtcagtggaatgcgaccaggtgttgcttacaggtttaacatcattaactgtgaaaagtccaacagtcagtttaattatggtatgcaaccactcatgtattcggttcaggaagcattaaatgccagaccatggtggattcgtatggggactgacatttgttactataaaaatcatttctcaagaagttcagttgctgcaggtgggcaaaagggaaaatcctactatacaattacatttactgtcaattttccacataaagatgatgtttgctactttgcttatcactatccatatacgtattcaactttacagatgcatcttcaaaaattggaatcagcacacaatcctcagcaaatctattttcggaaagatgtgttatgtgaaaccctgtctggaaacagctgccccttggtgactataacagcaatgccagagtctaattattatgaacatatctgccatttcagaaatcgcccttacgttttcttgtctgctcgggtacatcctggagaaactaatgcaagttgggttatgaaaggaacgttggaatatctcatgagcaataaccccactgctcagagcttacgagaatcttatatttttaaaattgtccctatgttaaatccagatggtgtcatcaatggaaatcatcgctgttctttaagtggagaggatttgaataggcagtggcaaagtccaagtccggatttacatcctacaatttaccatgctaaggggctgttgcaatacttggctgcagtgaagcgtttacccttggtttattgtgattatcatggccattcccgaaagaagaatgtatttatgtatggttgcagcatcaaagagacagtgtggcataccaatgataatgcaacttcatgtgatgttgtggaggatacgggatacaggacattgcctaagatactgagccatatcgccccagcattttgcatgagcagctgtagcttcgtagtggaaaaatctaaagaatccacagcacgtgttgtagtttggagggaaataggagtacaaagaagttataccatggagagtactttatgtggctgtgatcagggaaaatacaagggtttacagattggtacccgagaactggaagagatgggagcaaaattttgtgttggtcttttacgtttgaaaagactgacctctccattggagtataatctgccttccagcctgcttgactttgaaaatgatttaattgaatcaagctgcaaagtaactagccctaccacttatgtcttggatgaagatgaacctcgattccttgaagaagttgattacagtgcagaaagtaatgatgagttagatattgagttggctgaaaatgtaggagattatgaaccttctgctcaagaagaagtactttctgactctgaattatcaagaacatacctaccttgagcccgctgccatctcttgttaactgcaaagaataaatgaaatatcttggtttttatttcccaggaagcttgagagaaatgagtttatacagagctgactcaaaaagacaaaaagtaacttgggccagtttggtttcaagataataaatgtgttattaattaatgataaaattggcgcttgttttattttcgatattcaatgcactttatgtagcattgaatgatcaaatattggatttacctttaaaaaaaaaacctgagtatcattgcatgaatttttatctccctatggttatatcctgcatcaagtggataattttgaagtgtgttcagaatataaaattgaaattttagagttgttgaaaatcctgacttgttgaaaactaatatatatgtacatggatttctatagatgtgtttgtttagaagtgggtagatattgcagataagactgttcttcagaatcatgttaactattgggttgtgactgaagtagtccagggtttgccttgaaaccattacattctacatttaccaaattaaacaaataaaaactgtattaaatgttgca

SEQ ID NO: 109557 - DNA, 4222 bp, Homo sapiens
  Payload ID: 1515
  Gene Symbol: AGTPBP1
  Gene Name: ATP/GTP binding protein 1
  Uniprot ID: Q9UPW5
  ENST ID: ENST00000628899
  CDS Start-End: 68-3784
ctgcgcgtgctgggagccggctggcaaggcgtgcggtgggcggggcgccgcgctgacgttgcccgggatgcggacaggttccgccgcctccagcgccgccgccgcagctgccgccgccgccgcctccgcctcgcctgccaccggggtttgtatgaaaacaccgggcggcgggcggcgagggatccgccgtgatccaggtgctgagccgggtgctgcggctctgcgcggtccccgccagcgccccatcctgagccgccttaccaataattctaggatcgtaggactcctggctcaactggagaagatcaatgctgagccttcagaatcagacactgcccgatatgttacatcaaaaattcttcatctggctcagagtcaagaaaaaacaaggagagaaatgacagccaaaggttctacaggaatggaaattctgctgtcaacattagagaacacaaaagatcttcaaactacacttaatatcttaagcattcttgttgagctggtgtcagctggtggaggtcgaagagtgagtttcttagtcaccaaaggtggttcacaaatattgttgcagttacttatgaatgccagcaaagaatctcccccacatgaggacttaatggtacagattcattctattcttgcaaagattggaccaaaagataaaaaatttggagtaaaggctagaattaatggggctctgaatataaccctgaatttggtcaagcagaatttgcagaatcatcgcttggttctaccttgccttcagcttttacgagtatattctgccaactctgtgaattcagtatccttagggaaaaatggagttgtggaactgatgtttaaaatcattggaccatttagtaagaagaattccagtcttataaaggttgctttagacactcttgctgcattgctaaaatcaaaaacaaatgccaggagagctgtagacagaggatatgtccaagtgcttttaacaatttatgtagattggcaccgccatgataaccggcatagaaacatgctcattcggaaaggaattttacagagtttaaaaagtgttacaaacatcaagttgggaagaaaagcatttattgatgccaatgggatgaaaattctgtataatacttcgcaattgcctgttattcctgtgactggtcctgtggctcagctctacagcttacctcctgaagtggatgacgtagtagatgaaagtgatgacaacgatgatattgatgtagaagctgaaaacgaaactgagaatgaagatgacctagatcaaaattttaagaatgatgatattgaaacagatattaacaaactaaaaccccagcaagaaccgggacgaacaatagaagatctaaaaatgtatgaacaccttttccctgagcttgttgatgattttcaggactatgatttaatctccaaagaaccaaagccttttgtatttgagggaaaagtacgtggtcctattgttgttcctacggcaggcgaggaaacatctgggaattctggcaatttaagaaaagttgtaatgaaggagaacatatcttctaaaggagatgaaggtgaaaagaagtctacctttatggatctagcaaaagaagatattaaagataatgatagaacattacaacagcagccaggtgatcaaaatagaactatttcatcagtccatggtttaaacaatgatattgtaaaggccttggaccgaattacattgcagaatattccttctcaaacagccccaggttttactgcagaaatgaagaaggactgcagtcttcctcttactgtccttacctgtgctaaagcatgtccacacatggctacttgtggaaatgttctgtttgagggaagaacagttcagctagggaagctttgctgcactggagttgaaactgaagatgatgaagatactgagtcaaattcatcggtagaacaagcatcggttgaagtacctgatggaccaacactccatgacccagacctctatattgagattgtgaaaaatacgaagtctgtcccagaatattcagaggtggcttatcccgattattttggtcacattccgcctccattcaaagagcctattttagaaaggccttatggtgtacaaaggacaaaaattgctcaagatattgaaaggctaatacatcagagtgatatcatagatcgtgtggtatatgacttggataacccaaattacaccattccagaagagggagatattttgaaatttaactccaaatttgagtctgggaatctgcgcaaagtaattcaaattagaaaaaatgaatatgatcttattctgaactcagacataaacagcaatcattatcatcagtggttttactttgaagtcagtggaatgcgaccaggtgttgcttacaggtttaacatcattaactgtgaaaagtccaacagtcagtttaattatggtatgcaaccactcatgtattcggttcaggaagcattaaatgccagaccatggtggattcgtatggggactgacatttgttactataaaaatcatttctcaagaagttcagttgctgcaggtgggcaaaagggaaaatcctactatacaattacatttactgtcaattttccacataaagatgatgtttgctactttgcttatcactatccatatacgtattcaactttacagatgcatcttcaaaaattggaatcagcacacaatcctcagcaaatctattttcggaaagatgtgttatgtgaaaccctgtctggaaacagctgccccttggtgactataacagcaatgccagagtctaattattatgaacatatctgccatttcagaaatcgcccttacgttttcttgtctgctcgggtacatcctggagaaactaatgcaagttgggttatgaaaggaacgttggaatatctcatgagcaataaccccactgctcagagcttacgagaatcttatatttttaaaattgtccctatgttaaatccagatggtgtcatcaatggaaatcatcgctgttctttaagtggagaggatttgaataggcagtggcaaagtccaagtccggatttacatcctacaatttaccatgctaaggggctgttgcaatacttggctgcagtgaagcgtttacccttggtttattgtgattatcatggccattcccgaaagaagaatgtatttatgtatggttgcagcatcaaagagacagtgtggcataccaatgataatgcaacttcatgtgatgttgtggaggatacgggatacaggacattgcctaagatactgagccatatcgccccagcattttgcatgagcagctgtagcttcgtagtggaaaaatctaaagaatccacagcacgtgttgtagtttggagggaaataggagtacaaagaagttataccatggagagtactttatgtggctgtgatcagggaaaatacaagggtttacagattggtacccgagaactggaagagatgggagcaaaattttgtgttggtcttttacgtttgaaaagactgacctctccattggagtataatctgccttccagcctgcttgactttgaaaatgatttaattgaatcaagctgcaaagtaactagccctaccacttatgtcttggatgaagatgaacctcgattccttgaagaagttgattacagtgcagaaagtaatgatgagttagatattgagttggctgaaaatgtaggagattatgaaccttctgctcaagaagaagtactttctgactctgaattatcaagaacatacctaccttgagcccgctgccatctcttgttaactgcaaagaataaatgaaatatcttggtttttatttcccaggaagcttgagagaaatgagtttatacagagctgactcaaaaagacaaaaagtaacttgggccagtttggtttcaagataataaatgtgttattaattaatgataaaattggcgcttgttttattttcgatattcaatgcactttatgtagcattgaatgatcaaatattggatttacctttaaaaaaaaaacctgagtatcattgcatgaatttttatctccctatggttatatcctgcatcaagtggataattttgaagtgtgttcagaatataaaattgaaattttagagttgttgaaaatcctgacttgttgaaaactaatatatatgtacatggatttctatagatgtgtttgtttagaagtgggtagata

SEQ ID NO: 109558 - DNA, 3176 bp, Homo sapiens
  Payload ID: 1516
  Gene Symbol: AGBL1
  Gene Name: ATP/GTP binding protein-like 1
  ENST ID: ENST00000421325
  CDS Start-End: 81-3176
ctgacaaggagtccatcctgaccatcctcaaggtcctcggagatctgctttctgttggcacagaccggagaattcactacatgatcagcaagggtggcagtgaagctcttctgcagaccctggtagacacagcgaggacagctcctccagactatgacatcctcctgcctctcttccggctgctggccaaagttggcctaagagataaaaagattggacggaaggccctagaattggaagcacttgatgtgacattgattctggccaggaagaacctatcccatggccagaatctcctccactgtctctgggctctgcgtgtgtttgcctccagtgtctccatgggagccatgctgggaattaatggagccatggaactgcttttcaaggttattactccttacacccgaaagcgcacccaagcaatcagggcagccactgaagttttggcagcattgctgaaatccaagtcgaacggccgcagagcagtgaaccgaggctacgtcaccagcctgctcgggctgcaccaggactggcacagccatgacacagccaacgcctacgtgcagatccgacggggcttgctgctctgcctcaggcacattgctgccctccggtccggcagggaggccttcctggcagcacagggcatggagatcctcttcagcaccacacagaactgcctggatgacaagagcatggagcccgtcatctctgtggtgcttcagatcctgaggcagtgctaccctacgagtccacttcccttggtcacagccagcagtgcctatgccttcccggtccccgggtgcatcaccactgaacctccacatgatctacctgaagaggattttgaagatgatggcgatgatgaagtggacaaagactctgatactgaagatgggaaagtggaagatgatgacttggaaacagacgtgaacaagctgagttccaaacctggtcttgaccgacctgaagaggaactgatgcaatatgaggtgatgtgtcttgagctctcctatagctttgaggaactgcagtccaaacttggagatgatttgaactctgaaaagactcagtatgccaatcaccaccacattccagccgctgcctcctcaaaacagcattgctacagcaaggaccaaagctcctgtgggcaagaaagagaatatgctgtccagacttcccttctgtgcagggtgaagacgggaaggtccactgtgcatctaggctccaaaaaaaatcctggagtgaacctgtaccaaaatgtgcaatccaatagtctcaggagagattcttctgaaagtgaaatccctgacattcaggcttccccgaaagcagatgcctgggacgtagatgcaattttctgcccaaggatgagtgcctccttttctaattccactaggactagagaagttgtcaaagtaatagataagcttctgcagacacatctgaagcgtgtccctttccacgatccctatctttatatggccaaagccagaagaaccagctctgtggtggacttcaagatgatggcatttcctgatgtctggggacactgtccccctcccaccacccagcctatgttggaacgaaaatgtggagtccaaaggatcaggatatttgaggatattcggaggctcatccagccaagtgatgttataaataaagttgtcttcagtttagatgagccttggcctttgcaagacaatgcttccaattgtttacggttcttctccaaatttgagtcaggaaatcttcgcaaagccatccaagtgcgtgagttcgagtatgacttgctggtcaacgcagatgtgaatagcacccagcaccagcagtggttctatttcaaagtgagcggtatgcaggcggccatcccttaccacttcaacatcatcaactgtgagaagcccaacagccagtttaattatgggatgcagcccaccctatattctgtgaaggaggctcttcttggcaaacccacctggataaggacaggccatgaaatatgttattacaaaaatcattatcgccagagtacagctgttgcaggcggagcatctgggaagtgctactataccctcacctttgctgtcaccttcccacacagtgaggatgtctgctacctggcctaccactatccctatacctacacagccctcatgactcatcttgacatcctggaaaagagtgtcaacctcaaagaggtctacttccggcaagatgttctctgccagacgctgggagggaatccgtgtcccttggtgaccatcacggccatgcctgagtccaacagtgatgagcatctagagcagttccgacatcgtccatatcaggtgatcactgctcgagttcatccaggagagagcaatgccagttgggtgatgaagggtaccttggagttcctggtcagcagtgaccctgtggctaggctcttgagggaaaacttcatcttcaagatcatacccatgctcaacccagatggtgtcatcaacggcaaccacagatgctcactgagcggggaagatttgaacagacaatggctttctcccagtgctcatctgcagccaaccatttaccatgccaaaggcctcctctaccacctgagcagcattggccgaagtcccgtggttttctgtgacttccatggccactcccaaaagaagaatgtgttcctttatggctgtagcatcaaggaaaccttgtggcaagcagcatgcactgtgggcacatctactatcctagaggaggtcaactacaggactcttcccaaaatccttgataagctagcaccagcattcacaatgagcagctgcagctttctcgtggagaaatctcgagcttccacggcccgggtggtggtgtggagagagatgggggtgtccagaagctacaccatggaaagcagctactgtggctgcaaccagggcccttatcagtgtacacagaggctgttggagaggacaaagaatgaaagggctcacccagtggatggccttcagggtctacagtttggtaccagagaactggaggagatgggagccatgttctgtttgggcctcctcatcctggagctcaaatctgccagctgcagccatcagctcctggctcaagctgcaactctgctgagtgctgaggaggacgctctggaccagcacctccaacgggatgctcccaag

SEQ ID NO: 109559 - DNA, 3508 bp, Homo sapiens
  Payload ID: 1516
  Gene Symbol: AGBL1
  Gene Name: ATP/GTP binding protein-like 1
  Uniprot ID: Q96MI9
  ENST ID: ENST00000441037
  CDS Start-End: 96-3296
cattgcagagctcctctgacaaggagtccatcctgaccatcctcaaggtcctcggagatctgctttctgttggcacagaccggagaattcactacatgatcagcaagggtggcagtgaagctcttctgcagaccctggtagacacagcgaggacagctcctccagactatgacatcctcctgcctctcttccggctgctggccaaagttggcctaagagataaaaagattggacggaaggccctagaattggaagcacttgatgtgacattgattctggccaggaagaacctatcccatggccagaatctcctccactgtctctgggctctgcgtgtgtttgcctccagtgtctccatgggagccatgctgggaattaatggagccatggaactgcttttcaaggttattactccttacacccgaaagcgcacccaagcaatcagggcagccactgaagttttggcagcattgctgaaatccaagtcgaacggccgcagagcagtgaaccgaggctacgtcaccagcctgctcgggctgcaccaggactggcacagccatgacacagccaacgcctacgtgcagatccgacggggcttgctgctctgcctcaggcacattgctgccctccggtccggcagggaggccttcctggcagcacagggcatggagatcctcttcagcaccacacagaactgcctggatgacaagagcatggagcccgtcatctctgtggtgcttcagatcctgaggcagtgctaccctacgagtccacttcccttggtcacagccagcagtgcctatgccttcccggtccccgggtgcatcaccactgaacctccacatgatctacctgaagaggattttgaagatgatggcgatgatgaagtggacaaagactctgatactgaagatgggaaagtggaagatgatgacttggaaacagacgtgaacaagctgagttccaaacctggtcttgaccgacctgaagaggaactgatgcaatatgaggtgatgtgtcttgagctctcctatagctttgaggaactgcagtccaaacttggagatgatttgaactctgaaaagactcagtatgccaatcaccaccacattccagccgctgcctcctcaaaacagcattgctacagcaaggaccaaagctcctgtgggcaagaaagagaatatgctgtccagacttcccttctgtgcagggtgaagacgggaaggtccactgtgcatctaggctccaaaaaaaatcctggagtgaacctgtaccaaaatgtgcaatccaatagtctcaggagagattcttctgaaagtgaaatccctgacattcaggcttccccgaaagcagatgcctgggacgtagatgcaattttctgcccaaggatgagtgcctccttttctaattccactaggactagagaagttgtcaaagtaatagataagcttctgcagacacatctgaagcgtgtccctttccacgatccctatctttatatggccaaagccagaagaaccagctctgtggtggacttcaagatgatggcatttcctgatgtctggggacactgtccccctcccaccacccagcctatgttggaacgaaaatgtggagtccaaaggatcaggatatttgaggatattcggaggctcatccagccaagtgatgttataaataaagttgtcttcagtttagatgagccttggcctttgcaagacaatgcttccaattgtttacggttcttctccaaatttgagtcaggaaatcttcgcaaagccatccaagtgcgtgagttcgagtatgacttgctggtcaacgcagatgtgaatagcacccagcaccagcagtggttctatttcaaagtgagcggtatgcaggcggccatcccttaccacttcaacatcatcaactgtgagaagcccaacagccagtttaattatgggatgcagcccaccctatattctgtgaaggaggctcttcttggcaaacccacctggataaggacaggccatgaaatatgttattacaaaaatcattatcgccagagtacagctgttgcaggcggagcatctgggaagtgctactataccctcacctttgctgtcaccttcccacacagtgaggatgtctgctacctggcctaccactatccctatacctacacagccctcatgactcatcttgacatcctggaaaagagtgtcaacctcaaagaggtctacttccggcaagatgttctctgccagacgctgggagggaatccgtgtcccttggtgaccatcacggccatgcctgagtccaacagtgatgagcatctagagcagttccgacatcgtccatatcaggtgatcactgctcgagttcatccaggagagagcaatgccagttgggtgatgaagggtaccttggagttcctggtcagcagtgaccctgtggctaggctcttgagggaaaacttcatcttcaagatcatacccatgctcaacccagatggtgtcatcaacggcaaccacagatgctcactgagcggggaagatttgaacagacaatggctttctcccagtgctcatctgcagccaaccatttaccatgccaaaggcctcctctaccacctgagcagcattggccgaagtcccgtggttttctgtgacttccatggccactcccaaaagaagaatgtgttcctttatggctgtagcatcaaggaaaccttgtggcaagcagcatgcactgtgggcacatctactatcctagaggaggtcaactacaggactcttcccaaaatccttgataagctagcaccagcattcacaatgagcagctgcagctttctcgtggagaaatctcgagcttccacggcccgggtggtggtgtggagagagatgggggtgtccagaagctacaccatggaaagcagctactgtggctgcaaccagggcccttatcagtgtacacagaggctgttggagaggacaaagaatgaaagggctcacccagtggatggccttcagggtctacagtttggtaccagagaactggaggagatgggagccatgttctgtttgggcctcctcatcctggagctcaaatctgccagctgcagccatcagctcctggctcaagctgcaactctgctgagtgctgaggaggacgctctggaccagcacctccaacgattaaaatcatccaatttcctgccaaagcatatttggtttgcttaccacttttttgccattacaaactttttcaagatgaaccttcttctgcatgtctccccagtttgtgacacttgatgaggctcccttcaaatgagcaagtattgaagttcatgccatgtgcccagctcctcctggatctgtgaggaaatatctgaaaccttcaagatgttgtacatgtcttatggaaaatgttgctccatcatccctgcactcccttatctagtatatctacctccataagaaaacataaggacaggcaatcttcataaaaatagactccacctatt

SEQ ID NO: 109560 - DNA, 3295 bp, Homo sapiens
  Payload ID: 1517
  Gene Symbol: AGBL2
  Gene Name: ATP/GTP binding protein-like 2
  ENST ID: ENST00000357610
  CDS Start-End: 1-2715
atgttcccagctttggaaacgcacctaaagcagactattcctgatccttatgaagactttatgtaccgtcacctccaatattatggctactttaaagctcagagaggcagtttaccaaactctgctacgcatcagcatgttcggaagaataaccctcaatgcctgttgaatggctctcttggggaaaaagatgatttgataccagacaccctgcaaaaggagaagcttctatggcctatcagtttatcttcagctgtgcacagacagatagaagccatcaacagagactttcactcttgcctgggctggatgcagtggcgcggcctcagctcactgcaacctccacctcccagattcaaggattctcctgcctcagctttccgagtagctgggattacagattcacatatgctgagtttaccacatcttaggagcagacagcttctttatgatgagttggatgaagtaaacccacgtcttcgagaaccccaagagctcttttccattttgtctaccaagaggccactgcaggctccaagatggccaattgaatgtgaggtcatcaaggaaaacatccatcatattgagtgggctccacctcaaccagaatatttctatcagcctaaaggaaatgaaaaggtaccagagattgtaggagagaaaaaaggaacagttgtctatcaattagattcagtgcctatagaaggttcctattttaccagttccagagtgggaggcaaacgaggaattgtcaaggaacttgctgtcacgttgcaaggaccagaagataatactctactgtttgaatcaaggtttgagagtgggaatctgcaaaaagctgtcagagtagacacctatgagtatgaactcaccttgcgaactgacctctacactaacaaacacactcagtggttttattttcgtgttcagaacaccagaaaagatgctacctatcgcttcaccattgtcaacttgctaaaacccaagagtctttatactgtagggatgaagccactcttgtactcccaattggatgccaacacccgcaatattggctggaggagagaaggaaatgaaatcaagtactacaagaacaacacggatgatgggcagcagcccttctactgtctcacgtggaccattcagtttccatatgaccaggacacttgcttctttgcacacttctacccatatacatacactgatttgcaatgctacctcctgtcagtggcaaacaaccctatccagtctcagttctgcaagctccaaactttatgcaggagcctagcaggaaataccgtttacttgctcaccatcaccaacccatcccagacccctcaagaggcagctgcaaagaaagctgtggtcttgagtgccagagttcaccctggagaaagtaatggctcctgggttatgaaaggctttttggacttcatccttagcaactccccagatgcccagctcctcagagatatttttgtcttcaaggtgcttcccatgttaaatccagatggtgtgattgtggggaattatcggtgttccttggccggaagggatttgaacaggcattataaaaccattctgaaggagtctttcccttgtatttggtacaccaggaacatgatcaaaagacttcttgaagaaagagaggttctgttgtattgtgatttccatggccacagtcgtaagaataatatcttcctgtatggctgtaataacaacaatcgcaaatactggcttcatgaacgagtctttcctttaatgttatgcaaaaatgcaccagataagttctcttttcacagttgtaattttaaggtccaaaaatgcaaagaaggaacaggacgagttgttatgtggcggatgggaatcctaaacagctacaccatggagtctacctttggcgggtccaccctgggtaataaaagagacacccactttaccatcgaagatctgaagtccttaggttatcatgtctgtgacacccttctggacttttgtgatcctgaccaaatgaagttcactcagtgtctagcagagcttaaggagcttttacgacaggaaatccacaagaaattccatgaacttggacaagatgtagatttagaaggaagttggagtgacatctctttgtctgacattgaatccagaaacagcaccagtggctctgacagttctctctcagatggtcttcctgttcacctagcaaacatagcagatgagctgactcagaaaaagaagatgtttaagaagaaaaaaaagaagtcacttcagactaggaaacagcgaaatgagcagtatcagaaaaaaaatttgatgcagaagttaaagttaacagaagatacctcagaaaaggcaggatttgcttctactctgcaaaagcagccaacctttttcaaaaactcagagaattccagttttttaccaatgaaaaatgaaaacccaaggttaaatgagacaaatttaaatagaagagacaaagacacccccctggacccatcaatggccaccctgattctgcctaagaataaagggagaatgcagaataagaagccaggctttacagtatcatgctctccaaagagaaccataaactccagccaagagccagctccaggtatgaagccaaactggcctaggagcagatatcctgccacaaagagaggctgtgctgccatggcggcatacccatccttgcacatatacacatacccgtaggtgagcctgggctgtgccacacaagcacttcatcgggggttttgagattagacacattttataatgggggagatgtatgactgggaactgcatttacttgtggtatactgtgttgtgcactcatgcactgaccttacactttgtacttacactgtgggcatgtggtcaagatgcatacctcatgaattcaactattttttcataaaatgaaattttattatgatgtgtaaaaatgctttatcagaaactgaagtgtgttctcatggcacacttcatggcagcacagatatacctcattttaaccaatagatattctctctaaaattatgtgcaaatcaatttttaaaaatcaaaatctatgttaaacacattttggcagtgtgctataataaaaaaaagtgttgtgtcaaagctttctagtgacggtcagtcctactgctgtatgtcaggtttgctcacaatgaggtattcccacatagaaataacaatgcatgtattacccagaatttaatgttgcgtaccttatgttcaatgaggttttgtaatttttttaggctgatgattaaaattctttctctct

SEQ ID NO: 109561 - DNA, 479 bp, Homo sapiens
  Payload ID: 1517
  Gene Symbol: AGBL2
  Gene Name: ATP/GTP binding protein-like 2
  ENST ID: ENST00000530969
  CDS Start-End: 383-479
gcttcctgctttcggttgctagactacccgggccctcacagaaggcggtggcgggcgggtgcagcgagtttgtccccttgcccgcacactgcttggcctctgtacttaagtgcggtggccgcctgcctcgctggagcttctctgccgcagccatccgtgctgcttgggacgggccggggcgcgaaggcggtcgcatccatcgctctgccctcctgggaagtttctgctctccttccccgctcctacccttaggaaaccccctcaccacctgccccagaccagcttctcttgtgtaatcagctgcctatttggaaattgggcagggtttgcgactggatgctaatgtcactgactagttttcagcctaccatccagaagtaacatgttcccagctttggaaacgcacctaaagcagactattcctgatccttatgaagactttatgtaccgtcacctccaatattatggctactttaaag

SEQ ID NO: 109562 - DNA, 1798 bp, Homo sapiens
  Payload ID: 1517
  Gene Symbol: AGBL2
  Gene Name: ATP/GTP binding protein-like 2
  ENST ID: ENST00000528609
  CDS Start-End: 1-380
ctcaagaggcagctgcaaagaaagctgtggtcttgagtgccagagttcaccctggagaaagtaatggctcctgggttatgaaaggctttttggacttcatccttagcaactccccagatgcccagctcctcagagatatttttgtcttcaaggtgcttcccatgttaaatccagatggtgtgattgtggggaattatcggtgttccttggccggaagggatttgaacaggcattataaaaccattctgaaggagtctttcccttgtatttggtacaccaggaacatgatcaaaagttctcttttcacagttgtaattttaaggtccaaaaatgcaaagaaggaacaggacgagttgttatgtggcggatgggaatcctaaacagctacaccatggagtctacctttggcgggtccaccctgggtaataaaagagacacccactttaccatcgaagatctgaagtccttaggttatcatgtctgtgacacccttctggacttttgtgatcctgaccaaatgaagttcactcagtgtctagcagagcttaaggagcttttacgacaggaaatccacaagaaattccatgaacttggacaagatgtagatttagaaggaagttggagtgacatctctttgtctgacattgaatccagcaccagtggctctgacagttctctctcagatggtcttcctgttcacctagcaaacatagcagatgagctgactcagaaaaagaagatgtttaagaagaaaaaaaagaagtcacttcagactaggaaacagcgaaatgagcagtatcagaaaaaaaatttgatgcagaagttaaagttaacagaagatacctcagaaaaggcaggatttgcttctactctgcaaaagcagccaacctttttcaaaaactcagagaattccagttttttaccaatgaaaaatgaaaacccaaggttaaatgagacaaatttaaatagaagagacaaagacacccccctggacccatcaatggccaccctgattctgcctaagaataaagggagaatgcagaataagaagccaggctttacagtatcatgctctccaaagagaaccataaactccagccaagagccagctccaggtatgaagccaaactggcctaggagcagatatcctgccacaaagagaggctgtgctgccatggcggcatacccatccttgcacatatacacatacccgtaggtgagcctgggctgtgccacacaagcacttcatcgggggttttgagattagacacattttataatgggggagatgtatgactgggaactgcatttacttgtggtatactgtgttgtgcactcatgcactgaccttacactttgtacttacactgtgggcatgtggtcaagatgcatacctcatgaattcaactattttttcataaaatgaaattttattatgatgtgtaaaaatgctttatcagaaactgaagtgtgttctcatggcacacttcatggcagcacagatatacctcattttaaccaatagatattctctctaaaattatgtgcaaatcaatttttaaaaatcaaaatctatgttaaacacattttggcagtgtgctataataaaaaaaagtgttgtgtcaaagctttctagtgacggtcagtcctactgctgtatgtcaggtttgctcacaatgaggtattcccacatagaaataacaatgcatgtattacccagaatttaatgttgcgtaccttatgttcaatgaggttttgtaatttttttaggctgatgattaaaattctttctctctaa

SEQ ID NO: 109563 - DNA, 550 bp, Homo sapiens
  Payload ID: 1517
  Gene Symbol: AGBL2
  Gene Name: ATP/GTP binding protein-like 2
  ENST ID: ENST00000528632
  CDS Start-End: 60-245
ggtttgcgactggatgctaatgtcactgactagttttcagcctaccatccagaagtaacatgttcccagctttggaaacgcacctaaagcagactattcctgatccttatgaagactttatgtaccgtcacctccaatattatggctactttaaaggatctcgctctgtcactcaggctggagggcagtggcctccacatcccaggctcaagcaaccctcccagcctttggctatcattttctgagttccaacacagcccttgtagcttcagaatctttctgcctgccaagtcctttctcactccactacaccaggctgcttctcaagtctcctcttcacatccatttcctcagctgtaagctcagagaggcagtttaccaaactctgctacgcatcagcatgttcggaagaataaccctcaatgcctgttgaatggctctcttggggaaaaagatgatttgataccagacaccctgcaaaaggagaagcttctatggcctatcagtttatcttcagctgtgcacagacagatagaagccatcaacagag

SEQ ID NO: 109564 - DNA, 552 bp, Homo sapiens
  Payload ID: 1517
  Gene Symbol: AGBL2
  Gene Name: ATP/GTP binding protein-like 2
  ENST ID: ENST00000530577
  CDS Start-End: 108-552
aacaacgctcatgtactttttgttgagtctattatggtttgaaaacattatcttgattgaagtggcctttcctttcacagactattcctgatccttatgaagactttatgtaccgtcacctccaatattatggctactttaaagctcagagaggcagtttaccaaactctgctacgcatcagcatgttcggaagaataaccctcaatgcctgttgaatggctctcttggggaaaaagatgatttgataccagacaccctgcaaaaggagaagcttctatggcctatcagtttatcttcagctgtgcacagacagatagaagccatcaacagagattcacatatgctgagtttaccacatcttaggagcagacagcttctttatgatgagttggatgaagtaaacccacgtcttcgagaaccccaagagctcttttccattttgtctaccaagaggccactgcaggctccaagatggccaattgaatgtgaggtcatcaaggaaaacatccatcatattgagtgggctccacctcaaccagaatatttctatc

SEQ ID NO: 109565 - DNA, 3577 bp, Homo sapiens
  Payload ID: 1517
  Gene Symbol: AGBL2
  Gene Name: ATP/GTP binding protein-like 2
  Uniprot ID: Q5U5Z8
  ENST ID: ENST00000525123
  CDS Start-End: 287-2995
gggccctcacagaaggcggtggcgggcgggtgcagcgagtttgtccccttgcccgcacactgcttggcctctgtacttaagtgcggtggccgcctgcctcgctggagcttctctgccgcagccatccgtgctgcttgggacgggccggggcgcgaaggcggtcgcatccatcgctctgccctcctgcttctcttgtgtaatcagctgcctatttggaaattgggcagggtttgcgactggatgctaatgtcactgactagttttcagcctaccatccagaagtaacatgttcccagctttggaaacgcacctaaagcagactattcctgatccttatgaagactttatgtaccgtcacctccaatattatggctactttaaagctcagagaggcagtttaccaaactctgctacgcatcagcatgttcggaagaataaccctcaatgcctgttgaatggctctcttggggaaaaagatgatttgataccagacaccctgcaaaaggagaagcttctatggcctatcagtttatcttcagctgtgcacagacagatagaagccatcaacagagactttcactcttgcctgggctggatgcagtggcgcggcctcagctcactgcaacctccacctcccagattcaaggattctcctgcctcagctttccgagtagctgggattacagattcacatatgctgagtttaccacatcttaggagcagacagcttctttatgatgagttggatgaagtaaacccacgtcttcgagaaccccaagagctcttttccattttgtctaccaagaggccactgcaggctccaagatggccaattgaatgtgaggtcatcaaggaaaacatccatcatattgagtgggctccacctcaaccagaatatttctatcagcctaaaggaaatgaaaaggtaccagagattgtaggagagaaaaaaggaacagttgtctatcaattagattcagtgcctatagaaggttcctattttaccagttccagagtgggaggcaaacgaggaattgtcaaggaacttgctgtcacgttgcaaggaccagaagataatactctactgtttgaatcaaggtttgagagtgggaatctgcaaaaagctgtcagagtagacacctatgagtatgaactcaccttgcgaactgacctctacactaacaaacacactcagtggttttattttcgtgttcagaacaccagaaaagatgctacctatcgcttcaccattgtcaacttgctaaaacccaagagtctttatactgtagggatgaagccactcttgtactcccaattggatgccaacacccgcaatattggctggaggagagaaggaaatgaaatcaagtactacaagaacaacacggatgatgggcagcagcccttctactgtctcacgtggaccattcagtttccatatgaccaggacacttgcttctttgcacacttctacccatatacatacactgatttgcaatgctacctcctgtcagtggcaaacaaccctatccagtctcagttctgcaagctccaaactttatgcaggagcctagcaggaaataccgtttacttgctcaccatcaccaacccatcccagacccctcaagaggcagctgcaaagaaagctgtggtcttgagtgccagagttcaccctggagaaagtaatggctcctgggttatgaaaggctttttggacttcatccttagcaactccccagatgcccagctcctcagagatatttttgtcttcaaggtgcttcccatgttaaatccagatggtgtgattgtggggaattatcggtgttccttggccggaagggatttgaacaggcattataaaaccattctgaaggagtctttcccttgtatttggtacaccaggaacatgatcaaaagacttcttgaagaaagagaggttctgttgtattgtgatttccatggccacagtcgtaagaataatatcttcctgtatggctgtaataacaacaatcgcaaatactggcttcatgaacgagtctttcctttaatgttatgcaaaaatgcaccagataagttctcttttcacagttgtaattttaaggtccaaaaatgcaaagaaggaacaggacgagttgttatgtggcggatgggaatcctaaacagctacaccatggagtctacctttggcgggtccaccctgggtaataaaagagacacccactttaccatcgaagatctgaagtccttaggttatcatgtctgtgacacccttctggacttttgtgatcctgaccaaatgaagttcactcagtgtctagcagagcttaaggagcttttacgacaggaaatccacaagaaattccatgaacttggacaagatgtagatttagaaggaagttggagtgacatctctttgtctgacattgaatccagcaccagtggctctgacagttctctctcagatggtcttcctgttcacctagcaaacatagcagatgagctgactcagaaaaagaagatgtttaagaagaaaaaaaagaagtcacttcagactaggaaacagcgaaatgagcagtatcagaaaaaaaatttgatgcagaagttaaagttaacagaagatacctcagaaaaggcaggatttgcttctactctgcaaaagcagccaacctttttcaaaaactcagagaattccagttttttaccaatgaaaaatgaaaacccaaggttaaatgagacaaatttaaatagaagagacaaagacacccccctggacccatcaatggccaccctgattctgcctaagaataaagggagaatgcagaataagaagccaggctttacagtatcatgctctccaaagagaaccataaactccagccaagagccagctccaggtatgaagccaaactggcctaggagcagatatcctgccacaaagagaggctgtgctgccatggcggcatacccatccttgcacatatacacatacccgtaggtgagcctgggctgtgccacacaagcacttcatcgggggttttgagattagacacattttataatgggggagatgtatgactgggaactgcatttacttgtggtatactgtgttgtgcactcatgcactgaccttacactttgtacttacactgtgggcatgtggtcaagatgcatacctcatgaattcaactattttttcataaaatgaaattttattatgatgtgtaaaaatgctttatcagaaactgaagtgtgttctcatggcacacttcatggcagcacagatatacctcattttaaccaatagatattctctctaaaattatgtgcaaatcaatttttaaaaatcaaaatctatgttaaacacattttggcagtgtgctataataaaaaaaagtgttgtgtcaaagctttctagtgacggtcagtcctactgctgtatgtcaggtttgctcacaatgaggtattcccacatagaaataacaatgcatgtattacccagaatttaatgttgcgtaccttatgttcaatgaggttttgtaatttttttaggctgatgattaaaattctttctctctaa

SEQ ID NO: 109566 - DNA, 1288 bp, Homo sapiens
  Payload ID: 1517
  Gene Symbol: AGBL2
  Gene Name: ATP/GTP binding protein-like 2
  ENST ID: ENST00000532595
  CDS Start-End: 296-1288
agactacccgggccctcacagaaggcggtggcgggcgggtgcagcgagtttgtccccttgcccgcacactgcttggcctctgtacttaagtgcggtggccgcctgcctcgctggagcttctctgccgcagccatccgtgctgcttgggacgggccggggcgcgaaggcggtcgcatccatcgctctgccctcctgcttctcttgtgtaatcagctgcctatttggaaattgggcagggtttgcgactggatgctaatgtcactgactagttttcagcctaccatccagaagtaacatgttcccagctttggaaacgcacctaaagcagactattcctgatccttatgaagactttatgtaccgtcacctccaatattatggctactttaaagctcagagaggcagtttaccaaactctgctacgcatcagcatgttcggaagaataaccctcaatgcctgttgaatggctctcttggggaaaaagatgatttgataccagacaccctgcaaaaggagaagcttctatattcacatatgctgagtttaccacatcttaggagcagacagcttctttatgatgagttggatgaagtaaacccacgtcttcgagaaccccaagagctcttttccattttgtctaccaagaggccactgcaggctccaagatggccaattgaatgtgaggtcatcaaggaaaacatccatcatattgagtgggctccacctcaaccagaatatttctatcagcctaaaggaaatgaaaaggtaccagagattgtaggagagaaaaaaggaacagttgtctatcaattagattcagtgcctatagaaggttcctattttaccagttccagagtgggaggcaaacgaggaattgtcaaggaacttgctgtcacgttgcaaggaccagaagataatactctactgtttgaatcaaggtttgagagtgggaatctgcaaaaagctgtcagagtagacacctatgagtatgaactcaccttgcgaactgacctctacactaacaaacacactcagtggttttattttcgtgttcagaacaccagaaaagatgctacctatcgcttcaccattgtcaacttgctaaaacccaagagtctttatactgtagggatgaagccactcttgtactcccaattggatgccaacacccgcaatattggctggaggagagaaggaaatgaaatcaagtactacaagaacaacacggatgatgggcagcagcccttctactgtctcacgtggaccattcagtttccatatgaccag

SEQ ID NO: 109567 - DNA, 927 bp, Homo sapiens
  Payload ID: 1517
  Gene Symbol: AGBL2
  Gene Name: ATP/GTP binding protein-like 2
  ENST ID: ENST00000529154
  CDS Start-End: 642-927
gctttcggttgctagactacccgggccctcacagaaggcggtggcgggcgggtgcagcgagtttgtccccttgcccgcacactgcttggcctctgtacttaagtgcggtggccgcctgcctcgctggagcttctctgccgcagccatccgtgctgcttgggacgggccggggcgcgaaggcggtcgcatccatcgctctgccctcctgggaagtttctgctctccttccccgctcctacccttaggaaaccccctcaccacctgccccagaccaggttcctctgaaccctaaattcaatctttagggcccactttcccaaccccctgacctttttccatcggcacctaccgagacgacttcgtcgcgtgctcccatacccatttctttcactttcctgtggcgagcatctcctttctcagggaaagggaagcatggggccagcaccttgggaagaagaagcgggaagatacgctgccctccctgtctcagatgcacctctggcctcggcgtgaccaccttgtttagctgaggagaagctggcttctcttgtgtaatcagctgcctatttggaaattgggcagggtttgcgactggatgctaatgtcactgactagttttcagcctaccatccagaagtaacatgttcccagctttggaaacgcacctaaagcagactattcctgatccttatgaagactttatgtaccgtcacctccaatattatggctactttaaagctcagagaggcagtttaccaaactctgctacgcatcagcatgttcggaagaataaccctcaatgcctgttgaatggctctcttggggaaaaagatgatttgataccagacaccctgcaaaaggagaagcttctatggcctatcagtttatcttcagctgtgcacagacagatagaagccatcaacagag

SEQ ID NO: 109568 - DNA, 2929 bp, Homo sapiens
  Payload ID: 1517
  Gene Symbol: AGBL2
  Gene Name: ATP/GTP binding protein-like 2
  ENST ID: ENST00000528244
  CDS Start-End: 255-2729
agactacccgggccctcacagaaggcggtggcgggcgggtgcagcgagtttgtccccttgcccgcacactgcttggcctctgtacttaagtgcggtggccgcctgcctcgctggagcttctctgccgcagccatccgtgctgcttgggacgggccggggcgcgaaggcggtcgcatccatcgctctgccctcctgggtttgcgactggatgctaatgtcactgactagttttcagcctaccatccagaagtaacatgttcccagctttggaaacgcacctaaagcagactattcctgatccttatgaagactttatgtaccgtcacctccaatattatggctactttaaagctcagagaggcagtttaccaaactctgctacgcatcagcatgttcggaagaataaccctcaatgcctgttgaatggctctcttggggaaaaagatgatttgataccagacaccctgcaaaaggagaagcttctatggcctatcagtttatcttcagctgtgcacagacagatagaagccatcaacagagattcacatatgctgagtttaccacatcttaggagcagacagcttctttatgatgagttggatgaagtaaacccacgtcttcgagaaccccaagagctcttttccattttgtctaccaagaggccactgcaggctccaagatggccaattgaatgtgaggtcatcaaggaaaacatccatcatattgagtgggctccacctcaaccagaatatttctatcagcctaaaggaaatgaaaaggtaccagagattgtaggagagaaaaaaggaacagttgtctatcaattagattcagtgcctatagaaggttcctattttaccagttccagagtgggaggcaaacgaggaattgtcaaggaacttgctgtcacgttgcaaggaccagaagataatactctactgtttgaatcaaggtttgagagtgggaatctgcaaaaagctgtcagagtagacacctatgagtatgaactcaccttgcgaactgacctctacactaacaaacacactcagtggttttattttcgtgttcagaacaccagaaaagatgctacctatcgcttcaccattgtcaacttgctaaaacccaagagtctttatactgtagggatgaagccactcttgtactcccaattggatgccaacacccgcaatattggctggaggagagaaggaaatgaaatcaagtactacaagaacaacacggatgatgggcagcagcccttctactgtctcacgtggaccattcagtttccatatgaccaggacacttgcttctttgcacacttctacccatatacatacactgatttgcaatgctacctcctgtcagtggcaaacaaccctatccagtctcagttctgcaagctccaaactttatgcaggagcctagcaggaaataccgtttacttgctcaccatcaccaacccatcccagacccctcaagaggcagctgcaaagaaagctgtggtcttgagtgccagagttcaccctggagaaagtaatggctcctgggttatgaaaggctttttggacttcatccttagcaactccccagatgcccagctcctcagagatatttttgtcttcaaggtgcttcccatgttaaatccagatggtgtgattgtggggaattatcggtgttccttggccggaagggatttgaacaggcattataaaaccattctgaaggagtctttcccttgtatttggtacaccaggaacatgatcaaaagacttcttgaagaaagagaggttctgttgtattgtgatttccatggccacagtcgtaagaataatatcttcctgtatggctgtaataacaacaatcgcaaatactggcttcatgaacgagtctttcctttaatgttatgcaaaaatgcaccagataagttctcttttcacagttgtaattttaaggtccaaaaatgcaaagaaggaacaggacgagttgttatgtggcggatgggaatcctaaacagctacaccatggagtctacctttggcgggtccaccctgggtaataaaagagacacccactttaccatcgaagatctgaagtccttaggttatcatgtctgtgacacccttctggacttttgtgatcctgaccaaatgaagttcactcagtgtctagcagagcttaaggagcttttacgacaggaaatccacaagaaattccatgaacttggacaagatgtagatttagaaggaagttggagtgacatctctttgtctgacattgaatccagcaccagtggctctgacagttctctctcagatggtcttcctgttcacctagcaaacatagcagatgagctgactcagaaaaagaagatgtttaagaagaaaaaaaagaagtcacttcagactaggaaacagcgaaatgagcagtatcagaaaaaaaatttgatgcagaagttaaagttaacagaagatacctcagaaaaggcaggatttgcttctactctgcaaaagcagccaacctttttcaaaaactcagagaattccagttttttaccaatgaaaaatgaaaacccaaggttaaatgaggtagtatttttgtttttgactctttgtcacacagattctctaacctctcgaattagcacctctctcccacaatgtgacaaatgtaatagccatttacgttaccctaacctgacagtgccactgggagcaagaaaacattaaaactgggggagacattgacactgctttggattagacatgactgaagtctggaatcaaatattggtgatttgtgattttacaccaagaacataagaacaggctgccttacttaccatccattcatccctctactcacccatctactcaatcagcaaatgttattttaaaataaatcaatgaattttattgggcacctacta

SEQ ID NO: 109569 - DNA, 2973 bp, Homo sapiens
  Payload ID: 1518
  Gene Symbol: AGBL3
  Gene Name: ATP/GTP binding protein-like 3
  Uniprot ID: Q8NEM8
  ENST ID: ENST00000275763
  CDS Start-End: 235-2100
ctgatgacgagagttgggagtgtggctggggctgcggatctccagcagtggcgttacttctagcggctggataccgggttctccgcgagatcgcgagatcccgagatattctccccgcacggaagcgacgactggcctggccagaggactcgcgtgggagcgaggtgccggccccgacaggacggtgagcctacccgtatattacaagaaatctcaagtcaaacactggaaaagatgtcagaagattcagaaaaggaagactattcagacagaacaatcagtgatgaagatgaatcggatgaggatatgttcatgaaatttgtaagtgaagatcttcatcggtgtgcacttttaacagctgactcttttggtgatcccttcttcccccggactacacagatactattagaatatcagctagggagatgggtgccacgtcttcgtgaaccaagggatttatatggtgtctcttcttctggtccattgagcccaacacggtggccataccattgtgaagtcatcgatgaaaaagtccagcatattgattggactccttcttgtcctgagccagtgtatatcccaacgggcttagaaacggaacccctttatccagactccaaggaagctactgtggtttatctagctgaagatgcttacaaagagccctgttttgtgtattcccgagttgggggtaaccgaacacctttgaagcagcctgtggattaccgtgacaatactttgatgtttgaagcaaggtttgagagtggtaatctacagaaggtagtcaaagtggcagaatacgaataccaattgactgtacgccctgacctcttcacaaataaacacacccagtggtactatttccaagtcactaatatgcgagcaggaatagtctacagattcactattgtcaacttcaccaaacctgctagtctttacagtcggggtatgcgcccactgttctattctgaaaaagaggccaaggctcatcacattggctggcagagaataggagaccaaatcaagtattataggaacaacccaggccaagatgggcgccattatttctctcttacatggacatttcaatttccacacaacaaagatacctgctactttgctcattgctatccatacacttacaccaacctgcaagaatacctttctggcatcaataatgatccagtacggtcaaagttttgtaaaatacgtgttttgtgccacacgcttgctaggaacatggtgtatattttaacaatcactacccccttgaagaactctgactcaagaaagcggaaggctgtgattctgactgcaagggtccatccaggggaaaccaacagctcttggatcatgaaaggcttcctagattatattttaggaaactcaagtgatgcacagttgcttcgggacacttttgtcttcaaggtggtacccatgctcaatccagatggtgtgattgtgggaaattatcgctgttccttagctggacgggatttaaaccgtaattatacatctctcctgaaggaatcttttccttctgtatggtatacccggaacatggttcatagactgatggagaaacgagaggttattttatactgtgatcttcatggccatagtaggaaagagaacatcttcatgtatggctgtgatggtagtgacagatctaagacattatacttacagcaacgaatcttcccacttatgctaagcaaaaattgtccagataaattttcattctcagcttgcaagtttaatgtccagaagagcaaagaaggaacaggaagggtggtaatgtggaaaatgggaatcaggaacagctttaccatggaggccaccttctgtggatctactctgggtaacaaacgaggcactcatttcagcacgaaagacctggaatcaatgggatatcatttttgtgattctctcttggattattgtgatcccgaccggaccaagtattatcggtgcctgaaagaattagaagaaatggaaagacatataaccctggaaaaagtctttgaggattcagacacacctgtgatagacattacattggatgtagagtctagagaactgacatttttattgagatgacacaaaagcagtataataaaaggtaatgaataataactggaaaattcaatgccacaggaatatagttggaagaaagaatgtactaattttataagctcccacttatagtagccgaggctctgacagttcagaatccattgactctctgacttaccttctcaagttaacttctcagaaaaaacatttgaaaacaaagaaggaaaggaattctaccatagcaagccaccaaaatgccagaggacaagaggtttatgatagagggcatttgctgcaaagacacacacaatcaaattctgatgtgaaagatacaaggccaaatgaaccagatgattatatggttgattatttcagaagacaattacctaatcaaggtttggatctgcaccacaacttaaaaagcaaaataaaagaatgcatatctttccaaagcaagaagactggcataaattggacagatgatgaaaaaagaagctacaaggataaaggaatagttcaaactcaagaaatattgcagtatttgctccccatcgtgcatagcactaaaaacatgcaaaccactcagataaaacagctattcaatccaagaaccaacttccaaatccaacatcagtaagtcaatacaattttatcactcttatctatttaacacatcttttttaaaaaagcagggcttattaatttattatcctacgaaaaaaaaatctgctcttgaaaatgatgtcagctccatcacatttggcaaagaacaaagacccaaagctgtcagaaaacactggataaatgaaggagtaagttatcaggccttatttaattgattatttgcatgaaactactcattaatttagatctattaataaagtaggcataaataaa

SEQ ID NO: 109570 - DNA, 3533 bp, Homo sapiens
  Payload ID: 1518
  Gene Symbol: AGBL3
  Gene Name: ATP/GTP binding protein-like 3
  Uniprot ID: Q8NEM8
  ENST ID: ENST00000436302
  CDS Start-End: 254-3016
gttgcctgatgacgagagttgggagtgtggctggggctgcggatctccagcagtggcgttacttctagcggctggataccgggttctccgcgagatcgcgagatcccgagatattctccccgcacggaagcgacgactggcctggccagaggactcgcgtgggagcgaggtgccggccccgacaggacggtgagaaattgttttacagcctacccgtatattacaagaaatctcaagtcaaacactggaaaagatgtcagaagattcagaaaaggaagactattcagacagaacaatcagtgatgaagatgaatcggatgaggatatgttcatgaaatttgtaagtgaagatcttcatcggtgtgcacttttaacagctgactcttttggtgatcccttcttcccccggactacacagatactattagaatatcagctagggagatgggtgccacgtcttcgtgaaccaagggatttatatggtgtctcttcttctggtccattgagcccaacacggtggccataccattgtgaagtcatcgatgaaaaagtccagcatattgattggactccttcttgtcctgagccagtgtatatcccaacgggcttagaaacggaacccctttatccagactccaaggaagctactgtggtttatctagctgaagatgcttacaaagagccctgttttgtgtattcccgagttgggggtaaccgaacacctttgaagcagcctgtggattaccgtgacaatactttgatgtttgaagcaaggtttgagagtggtaatctacagaaggtagtcaaagtggcagaatacgaataccaattgactgtacgccctgacctcttcacaaataaacacacccagtggtactatttccaagtcactaatatgcgagcaggaatagtctacagattcactattgtcaacttcaccaaacctgctagtctttacagtcggggtatgcgcccactgttctattctgaaaaagaggccaaggctcatcacattggctggcagagaataggagaccaaatcaagtattataggaacaacccaggccaagatgggcgccattatttctctcttacatggacatttcaatttccacacaacaaagatacctgctactttgctcattgctatccatacacttacaccaacctgcaagaatacctttctggcatcaataatgatccagtacggtcaaagttttgtaaaatacgtgttttgtgccacacgcttgctaggaacatggtgtatattttaacaatcactacccccttgaagaactctgactcaagaaagcggaaggctgtgattctgactgcaagggtccatccaggggaaaccaacagctcttggatcatgaaaggcttcctagattatattttaggaaactcaagtgatgcacagttgcttcgggacacttttgtcttcaaggtggtacccatgctcaatccagatggtgtgattgtgggaaattatcgctgttccttagctggacgggatttaaaccgtaattatacatctctcctgaaggaatcttttccttctgtatggtatacccggaacatggttcatagactgatggagaaacgagaggttattttatactgtgatcttcatggccatagtaggaaagagaacatcttcatgtatggctgtgatggtagtgacagatctaagacattatacttacagcaacgaatcttcccacttatgctaagcaaaaattgtccagataaattttcattctcagcttgcaagtttaatgtccagaagagcaaagaaggaacaggaagggtggtaatgtggaaaatgggaatcaggaacagctttaccatggaggccaccttctgtggatctactctgggtaacaaacgaggcactcatttcagcacgaaagacctggaatcaatgggatatcatttttgtgattctctcttggattattgtgatcccgaccggaccaagtattatcggtgcctgaaagaattagaagaaatggaaagacatataaccctggaaaaagtctttgaggattcagacacacctgtgatagacattacattggatgtagagtctagtagccgaggctctgacagttcagaatccattgactctctgacttaccttctcaagttaacttctcagaaaaaacatttgaaaacaaagaaggaaaggaattctaccatagcaagccaccaaaatgccagaggacaagaggtttatgatagagggcatttgctgcaaagacacacacaatcaaattctgatgtgaaagatacaaggccaaatgaaccagatgattatatggttgattatttcagaagacaattacctaatcaaggtttggatctgcaccacaacttaaaaagcaaaataaaagaatgcatatctttccaaagcaagaagactggcataaattggacagatgatgaaaaaagaagctacaaggataaaggaatagttcaaactcaagaaatattgcagtatttgctccccatcgtgcatagcactaaaaacatgcaaaccactcagataaaacagctattcaatccaagaaccaacttccaaatccaacatcaactaaatccggctacttgcagaaatataaagaaatacagcacatcttggacagcacccagaaatcacccttttgtaatccaaggggatgttatggcaaactcttcagaatgggtccagtctaagccccacaggtcattggaaagtttatcacctctcaaaggccccaagaagaataaacattctcaaatctgggccataaagaatgaagacataaaacctctcagcagcaagtgggagactgcttcttcaagctttggaatggatgcaaatgttctaaaatataagagtcttcaagctgaagaaactaaccagcaaagctctaagcatacagccctccatctaactaaaaataaggatgagcaggccaataagaatgatggacaacccaccttatatctgaagttccaaagggagagttaatctagctttatactgctctgagaactgtgaatgaaggataacatatgcttatgtagtaaaaagaaaaaaaggaaagccctccccttcccctttccctatctctccccttacacatgcatatgcataaactaaaaattttagatatcccatcttctgtagtgggaacatctttcagagatttaaaaagaaatccagagaaaatatggaaaaatattaaagcagatatttatatttagtttttatcagcatggaaaaaaatctctgaagttttgatttcttccaaaactacttacacattcgacaccaaaaaaacttaagaactcaaagtaggaatgacatataatatgtcactgattttaacctccctactagacactttaatcaattagtcaacaaacatcatttcctgattttctgttatatcattagtgtgctaggaaccatttctctctactaggagattaccacataattgtacagataaaacatacctgaataaaatgattacagaataaga

SEQ ID NO: 109571 - DNA, 2495 bp, Homo sapiens
  Payload ID: 1518
  Gene Symbol: AGBL3
  Gene Name: ATP/GTP binding protein-like 3
  ENST ID: ENST00000435976
  CDS Start-End: 235-2349
ctgatgacgagagttgggagtgtggctggggctgcggatctccagcagtggcgttacttctagcggctggataccgggttctccgcgagatcgcgagatcccgagatattctccccgcacggaagcgacgactggcctggccagaggactcgcgtgggagcgaggtgccggccccgacaggacggtgagcctacccgtatattacaagaaatctcaagtcaaacactggaaaagatgtcagaagattcagaaaaggaagactattcagacagaacaatcagtgatgaagatgaatcggatgaggatatgttcatgaaatttgtaagtgaagatcttcatcggtgtgcacttttaacagctgactcttttggtgatcccttcttcccccggactacacagatactattagaatatcagctagggagatgggtgccacgtcttcgtgaaccaagggatttatatggtgtctcttcttctggtccattgagcccaacacggtggccataccattgtgaagtcatcgatgaaaaagtccagcatattgattggactccttcttgtcctgagccagtgtatatcccaacgggcttagaaacggaacccctttatccagactccaaggaagctactgtggtttatctagctgaagatgcttacaaagagccctgttttgtgtattcccgagttgggggtaaccgaacacctttgaagcagcctgtggattaccgtgacaatactttgatgtttgaagcaaggtttgagagtggtaatctacagaaggtagtcaaagtggcagaatacgaataccaattgactgtacgccctgacctcttcacaaataaacacacccagtggtactatttccaagtcactaatatgcgagcaggaatagtctacagattcactattgtcaacttcaccaaacctgctagtctttacagtcggggtatgcgcccactgttctattctgaaaaagaggccaaggctcatcacattggctggcagagaataggagaccaaatcaagtattataggaacaacccaggccaagatgggcgccattatttctctcttacatggacatttcaatttccacacaacaaagatacctgctactttgctcattgctatccatacacttacaccaacctgcaagaatacctttctggcatcaataatgatccagtacggtcaaagttttgtaaaatacgtgttttgtgccacacgcttgctaggaacatggtgtatattttaacaatcactacccccttgaagaactctgactcaagaaagcggaaggctgtgattctgactgcaagggtccatccaggggaaaccaacagctcttggatcatgaaaggcttcctagattatattttaggaaactcaagtgatgcacagttgcttcgggacacttttgtcttcaaggtggtacccatgctcaatccagatggtgtgattgtgggaaattatcgctgttccttagctggacgggatttaaaccgtaattatacatctctcctgaaggaatcttttccttctgtatggtatacccggaacatggttcatagactgatggagaaacgagaggttattttatactgtgatcttcatggccatagtaggaaagagaacatcttcatgtatggctgtgatggtagtgacagatctaagacattatacttacagcaacgaatcttcccacttatgctaagcaaaaattgtccagataaattttcattctcagcttgcaagtttaatgtccagaagagcaaagaaggaacaggaagggtggtaatgtggaaaatgggaatcaggaacagctttaccatggaggccaccttctgtggatctactctgggtaacaaacgaggcactcatttcagcacgaaagacctggaatcaatgggatatcatttttgtgattctctcttggattattgtgatcccgaccggaccaagtattatcggtgcctgaaagaattagaagaaatggaaagacatataaccctggaaaaagtctttgaggattcagacacacctgtgatagacattacattggatgtagagtctagtagccgaggctctgacagttcagaatccattgactctctgacttaccttctcaagttaacttctcagaaaaaacatttgaaaacaaagaaggaaaggaattctaccatagcaagccaccaaaatgccagaggacaagaggtttatgatagagggcatttgctgcaaagacacacacaatcaaattctgatgtgaaagatacaaggccaaatgaaccagatgattatatggttgattatttcagaagacaattacctaatcaaggtttggtttaaatcactgggagcttcgagagttctttggctccttccctttctggaattattgtgtgatataatcaagacatttacctggctctttaaatcagttggtttgccggctacagtgtaggtaaagagtatgtcataatggacaataaaaa

SEQ ID NO: 109572 - DNA, 497 bp, Homo sapiens
  Payload ID: 1518
  Gene Symbol: AGBL3
  Gene Name: ATP/GTP binding protein-like 3
  ENST ID: ENST00000455283
  CDS Start-End: 218-497
gagtgtggctggggctgcggatctccagcagtggcgttacttctagcggctggataccgggttctccgcgagatcgcgagatcccgagatattctccccgcacggaagcgacgactggcctggccagaggactcgcgtgggagcgaggtgccggccccgacaggacggtgagcctacccgtatattacaagaaatctcaagtcaaacactggaaaagatgtcagaagattcagaaaaggaagactattcagacagaacaatcagtgatgaagatgaatcggatgaggatatgttcatgaaatttgtaagtgaagatcttcatcggtgtgcacttttaacagattggactccttcttgtcctgagccagtgtatatcccaacgggcttagaaacggaacccctttatccagactccaaggaagctactgtggtttatctagctgaagatggtgagcacataatgacacatgttgctgtaaaatataatttggtactta

SEQ ID NO: 109573 - DNA, 881 bp, Homo sapiens
  Payload ID: 1519
  Gene Symbol: AGBL4
  Gene Name: ATP/GTP binding protein-like 4
  ENST ID: ENST00000334103
  CDS Start-End: 3-881
cagacaatctccgggaaggggcagagcagaaggtggtattcatcacaggacgagtccacccaggggaaacaccctcatcatttgtgtgccaagggatcattgacttccttgtaagccagcaccctattgcctgtgtcctccgggaatacctggtcttcaagatcgcaccaatgctcaatcctgatggagtctacctgggcaattacaggtgttctctgatgggatttgatctgaatcgtcactggctggatccctctccatgggtccatcctaccctgcatggagtgaaacaactcatcgtccagatgtacaacgacccaaaaacaagcctggagttttatattgacatccatgcccactccaccatgatgaatggcttcatgtatggcaacatctttgaggatgaggaacggttccagaggcaggccatttttcccaagctcctctgccagaatgctgaggacttctcctattccagcacatcctttaaccgggacgctgtgaaagcaggaactggccgtcgcttcctcggtggactcctggaccacacttcctattgctacaccctagaggtctccttctacagctacatcatcagtggcaccacggctgctgtgccctacactgaagaagcctatatgaagctggggcggaatgtggcaagaacctttttggactattatcggctgaaccccgtggttgaaaaggtggcaattcccatgccgagactgcgaaataaagaaatagaagtccagagaaggaaagaaaaatcccctccttacaagcacccactcctgcggggcccagccagcaactaccccaacagcaaaggggacaagaagagctcagtgaaccacaaagacccttcaacccctttttaa

SEQ ID NO: 109574 - DNA, 1454 bp, Homo sapiens
  Payload ID: 1519
  Gene Symbol: AGBL4
  Gene Name: ATP/GTP binding protein-like 4
  ENST ID: ENST00000371836
  CDS Start-End: 105-758
gccgcgtcttcctgaggtagctcctgtcagcccactgatcccaccacccgctccctactgccccgcggtcttcgcgtgagctcggagactgagggacaacaaaaatggcggaggggagccagtcggcgcctgaggcaggcaatgatatgggaaatgatgatgccattggagggaatgtgagcaaatatatagtgcttccaactggctattgtggacagcccaagaaaggacatcttatctttgatgcttgctttgaaagtggtaacctgggccgggtggaccaggtctctgagtttgagtatgatctgttcattaggccggacacctgtaatccacgcttccgagtctggttcaactttactgttgaaaatgtgaaagaatcacagagggtcattttcaacattgttaacttcagtaaaaccaagagtctctatagagatgggatggcccctatggtgaaatctaccagcagaccaaaatggcaaaggctgccacccaaaaatgtttactactaccgctgcccggaccataggaagaactatgtgatgtcctttgccttttgttttgaccgagaagaagatatttaccagtttgcttactgctacccatatacatacactcgcttccaacattaccttgacagcctgcaaaagagaaacatggattacttctttcgggagcagctgggccagagtgtgcaacaacgaaagcttgacctcctgacgataaccagccctgctggaagatggagctggtgaaatcatttgcttctgaaggagaatggtggcctttccaaatttgactatcagatatgaatttgacctaatctcgggaatgtttccggctggaagatggagctggtgaaatcatttgcttctgaaggagaatggtggcctttccaaatttgactatcagatatgaatttgacctaatctcgggaatgtttccggtaagactgcagactctcaggtgcttaagaagtcactgaggctctggacaaacaggaacgtattagctttttgcctactgactacacagcctccaccattcacccaaaatggatctgcatctcccaggtgcatctgcaagcacacaaaaacacacactgggaaggggtatgagctgaggttagtcctaggtgctgcactttctattcctgacatatcaggatgtgtgggagggaggccaaagctgcagcaccaggctgggcttccagtcctgttgctactgtggaagctggctccagacaggtgggggcagcaaagagccagcctgtatggtcagctgggattctagttgaccaaagctgttgggagaactcaagctcatcagtgtggcaagttagacaacttgatctggacacatgcataaatggaacaggggtccagatacccacaggattaatactaataaaccattttgcttaagcagcaaaactcggtttatatattgaa

SEQ ID NO: 109575 - DNA, 1353 bp, Homo sapiens
  Payload ID: 1519
  Gene Symbol: AGBL4
  Gene Name: ATP/GTP binding protein-like 4
  ENST ID: ENST00000371838
  CDS Start-End: 118-1080
aggcaaccgtcgtgccgcgtcttcctgaggtagctcctgtcagcccactgatcccaccacccgctccctactgccccgcggtcttcgcgtgagctcggagactgagggacaacaaaaatggcggaggggagccagtcggcgcctgaggcaggcaatgatatgggaaatgatgatgccattggagggaatgtgagcaaatatatagtgcttccaactggctattgtggacagcccaagaaaggacatcttatctttgatgcttgctttgaaagtggtaacctgggccgggtggaccaggtctctgagtttgagtatgatctgttcattaggccggacacctgtaatccacgcttccgagtctggttcaactttactgttgaaaatgtgaaagaatcacagagggtcattttcaacattgttaacttcagtaaaaccaagagtctctatagagatgggatggcccctatggtgaaatctaccagcagaccaaaatggcaaaggctgccacccaaaaatgtttactactaccgctgcccggaccataggaagaactatgtgatgtcctttgccttttgttttgaccgagaagaagatatttaccagtttgcttactgctacccatatacatacactcgcttccaacattaccttgacagcctgcaaaagagaaacatggattacttctttcgggagcagctgggccagagtgtgcaacaacgaaagcttgacctcctgacgataaccagccctgacaatctccgggaaggggcagagcagaaggtggtattcatcacaggacgagtccacccaggggaaacaccctcatcatttgtgtgccaagggatcattgacttccttgtaagccagcaccctattgcctgtgtcctccgggaatacctggtcttcaagatcgcaccaatgctcaatcctgatggagtctacctgggcaattacaggtgttctctgatgggatttgatctgaatcgtcactggctggatccctctccatgggtccatcctaccctgcatggagtgaaacaactcatcgtccagatgtacaacgacccagtaagtaactgaatgccctccacagctgctgatctatggcttgatctgggaaagggcagcattgtattgggaaagtccactagaagctgcaaattaggaatacatagctaaaaccagggaggcactaggcctgctcttctctgaatccagcagacccaaggaccttctcccaatctcttttcctgcaacctctcacaaatagtggattcagttttggaggtctggagggttaaaggaaatatattggagtgtatccatatttgtcagggatctttggttacaagc

SEQ ID NO: 109576 - DNA, 2947 bp, Homo sapiens
  Payload ID: 1519
  Gene Symbol: AGBL4
  Gene Name: ATP/GTP binding protein-like 4
  Uniprot ID: Q5VU57
  ENST ID: ENST00000371839
  CDS Start-End: 118-1629
aggcaaccgtcgtgccgcgtcttcctgaggtagctcctgtcagcccactgatcccaccacccgctccctactgccccgcggtcttcgcgtgagctcggagactgagggacaacaaaaatggcggaggggagccagtcggcgcctgaggcaggcaatgatatgggaaatgatgatgccattggagggaatgtgagcaaatatatagtgcttccaactggctattgtggacagcccaagaaaggacatcttatctttgatgcttgctttgaaagtggtaacctgggccgggtggaccaggtctctgagtttgagtatgatctgttcattaggccggacacctgtaatccacgcttccgagtctggttcaactttactgttgaaaatgtgaaagaatcacagagggtcattttcaacattgttaacttcagtaaaaccaagagtctctatagagatgggatggcccctatggtgaaatctaccagcagaccaaaatggcaaaggctgccacccaaaaatgtttactactaccgctgcccggaccataggaagaactatgtgatgtcctttgccttttgttttgaccgagaagaagatatttaccagtttgcttactgctacccatatacatacactcgcttccaacattaccttgacagcctgcaaaagagaaacatggattacttctttcgggagcagctgggccagagtgtgcaacaacgaaagcttgacctcctgacgataaccagccctgacaatctccgggaaggggcagagcagaaggtggtattcatcacaggacgagtccacccaggggaaacaccctcatcatttgtgtgccaagggatcattgacttccttgtaagccagcaccctattgcctgtgtcctccgggaatacctggtcttcaagatcgcaccaatgctcaatcctgatggagtctacctgggcaattacaggtgttctctgatgggatttgatctgaatcgtcactggctggatccctctccatgggtccatcctaccctgcatggagtgaaacaactcatcgtccagatgtacaacgacccaaaaacaagcctggagttttatattgacatccatgcccactccaccatgatgaatggcttcatgtatggcaacatctttgaggatgaggaacggttccagaggcaggccatttttcccaagctcctctgccagaatgctgaggacttctcctattccagcacatcctttaaccgggacgctgtgaaagcaggaactggccgtcgcttcctcggtggactcctggaccacacttcctattgctacaccctagaggtctccttctacagctacatcatcagtggcaccacggctgctgtgccctacactgaagaagcctatatgaagctggggcggaatgtggcaagaacctttttggactattatcggctgaaccccgtggttgaaaaggtggcaattcccatgccgagactgcgaaataaagaaatagaagtccagagaaggaaagaaaaatcccctccttacaagcacccactcctgcggggcccagccagcaactaccccaacagcaaaggggacaagaagagctcagtgaaccacaaagacccttcaacccctttttaaagacacggagtcctgggaggtcttatggggacaggagcatgcattttctgctggggaatgaaattaatcactcttctctagcttccaaggatttgtggattaatgcataggctagtgaaagggaagggatacaatgagaaacttcatcactgattttccctttttccaatggaaaatcaattgtaagccttcagctcaaaaagctcaggaacaaaataggagatcggaaccaggtgagcacagatgctattttctacaacatagagatcttccaagatgaggaaaacctacacatcccttttaagagatttgacacatatcaggtcagttctttcaaagccactttacatttttaagttttatagttactgcagatggttaccttttaaataggcttggttgtttacagctttagaaatgcagtgtttgtattttctgatccaaaacaacagcaacaacacatgcaaccaaagggcaaatgcatcctagggaacaatgggacagaatttttgaaatcaacggtggacttaaatatatggtcactgtatctaagctgcatgcttgctgattccctcaaaccccagcatgcagatttagaaaactgttttgagagctgtttcccaatttcctcggtagtttaattaaaattttagctctaaagacaaaaagcactggtcactcattttaaaaggtttattatggttaaggtctccagatcccaggtgacagggattaagcctggcccctgaagatgtaggcattgctaatctgcaatgaggaaagggtgattgccaggcaaggaagatgcaaaagacagaaggatgcaccctgaggcagggaggaatgataaaataaaacagtagtagcaattcccaaggtgtggcaagctaaatattggcatttttgtgaagagtaaagtgcctttgtatgatgaatgggtccaggggggtctgctcccttcctgtctgtggaaacagcaggctgagtcaccatgacagcctgctaattaaaatgacctcccggaaatgaggattagaacacagggagaggaagggaggctccagggaggaaaatcccttagcacagagctccactaaagcattttttgtttgtttgtttgtttgtttgtttgtttgagttggagattattgaagtttgctacaaaaatcaaaaagaaaacttgttctcctttgcatgctagttttcagaaatgatgacaaagagccatatgttgattggctacaaatgtcatgttgtatatacagcttctcccctgggttcgttttgcccagaggaacacaaataaagtgttttgtgc

SEQ ID NO: 109577 - DNA, 3938 bp, Homo sapiens
  Payload ID: 1519
  Gene Symbol: AGBL4
  Gene Name: ATP/GTP binding protein-like 4
  ENST ID: ENST00000416121
  CDS Start-End: 1-899
accgagaagaagatatttaccagtttgcttactgctacccatatacatacactcgcttccaacattaccttgacagcctgcaaaagagaaacatggattacttctttcgggagcagctgggccagagtgtgcaacaacgaaagcttgacctcctgacgataaccagccctgacaatctccgggaaggggcagagcagaaggtggtattcatcacaggacgagtccacccaggggaaacaccctcatcatttgtgtgccaagggatcattgacttccttgtaagccagcaccctattgcctgtgtcctccgggaatacctggtcttcaagatcgcaccaatgctcaatcctgatggagtctacctgggcaattacaggtgttctctgatgggatttgatctgaatcgtcactggctggatccctctccatgggtccatcctaccctgcatggagtgaaacaactcatcgtccagatgtacaacgacccaaaaacaagcctggagttttatattgacatccatgcccactccaccatgatgaatggcttcatgtatggcaacatctttgaggatgaggaacggttccagaggcaggccatttttcccaagctcctctgccagaatgctgaggacttctcctattccagcacatcctttaaccgggacgctgtgaaagcaggaactggccgtcgcttcctcggtggactcctggaccacacttcctattgctacaccctagaggtctccttctacagctacatcatcagtggcaccacggctgctgtgccctacactgaagaagcctgtatccttagtccccacccagccttgggccagccctcatccagccgagagtatccaagtctgacaggtcaggaattaggcccccagctcaggtaagggctgagactctcaggtgaggatggaggtgcttcttcttctggtggcgtctttggattgtccagtttgcctcagcccttagtatgatactcctaccccaattgccatgctccaaatctttcccaggccagccggacccatggcctgcccatatcttactctgcttccatctctctcccctctcttctctcatgatgcagtgagtctcctgccatctaagctatgcaagtccacaggctggatgaccatccccagggttgctgaggaagagcttgatgatcttgactccttctaaccctgaacatacaaaaacatatgttctcttttcatcttttgtctaacctatcctctcccactttctcttccctctactcactatttccccttctacttacttttctcacccttgttccctctccttctatgccctcctcctccctcctcacctgtcctgtgcttctctttccttacttctttttccccctcctcccctcctttctgtcctctctctcatcccatcctccttttctttctctcctctttgcctgtcttctgtcttccttgtctttcccctctcatcctctgtgcatctttctctctgcctttgcatttcctttgacaaattccttttcctcttagtttcttcataaaatttctctgaaaactccaaagccttccatgatgaaattagaagttattttctagtttgcctaattttttaaggattaggtagtaactctagtttcccgagtgttgattttaatatcaaggtcactgcatcagagctgtaacagatcgtggcagattctgctttccttgatcctttgttttcgggttgatctatgtctcctttcctaacacttagttttctcagagaagtggagggaggaggaaggaactttagatgaaatgaactctgtatttctgcaaattccccctccctggaggtagaagtgctcttttagcattttttcaacccttggtgagtgtttatggaattcctctgtgcaggaaaacatcttttctgaacgtggcatgacttagggctagtcccaccagccaactgcaacttagtggctctgtttgtatgtgtgtttgggagggttgggggtatggtgtccaggtaccttgccaggaacatcggaagtagggcaatggccctagaaggaggggctgtcagggggtaggccaggtgttagagcaatgttccacatcctgttggacacagagatattatgattggaactgagagttccctatgtacagtcatcaagactgagggtcatcttgcagtctgctttaatacccacctgactcagcaaggccaagggagtaggctctgctctgaggaagagggtctgtgggttccaaagtcctggccacctgttatgtgccacattgcccctcttcatgccccatacacaccttagatgatgcatatggcctatgccttctccagaatctgctaactcctataacacatgcatatgcttcattccacattgtacttgctttgctctcccataatattatggcaaagggacagagagctgcctggaataagagtttgagcttgtgcactaaaggggattctgcaacccttattcatagtgagatgagggtccctccagaggaggcctgcccttagtttgttgttttttgctgtccaatctgacaggctctcctaccttttcttagcacttctgacatgcttctgtcttagaagaaaatgtgtttcttagtagaaagcccacccttggttcaggcccaaggtttccacccctcaacagccaacactcatttatcaaaagtaaacacagcattagtacataccaggaatcataaaaggcacctagggtaaaatactgaataaaaaggcatgattcctgactcacagaactttcagtctacttggggagacagaaaagggaagagataattacaatgtatgtgataaattctggtggaggaattccagaaggctctgggacattttcatttgacaagtatatattgagtgcctgtcataggtcaggtaaagttctaggcacagggaatgtaacagagaacatactaaagacaagaatgtctttacatgggggaaagagggaactcacacgcagtcctaggagtcagggaagatttcccaggaaaagagacatctaaactgagattttttgtttgtttgtttttgagatggagtctcactctgttacccaggctagagtgtagtggcatgatctcagctcactgcaacttctgcctcctgggttcaagcgattcccctgcctcagcctcctgagtagctgggattacaggtgtgcgccaccatgtccggctaatttttgtatttttagcagagatggggttttaccatgttggtcaggctggtctcaaacttctgacctcgtgatccacctgcttcggcctcccaaagtgctgagattacaggtgtaagccactgagcccggcctaaactgagtttttaatatgaactagtcaaactgggtgagggtgttgttgaagggaggatgtggtagacagagaggggagtacagaaggtatgggcagaagctgtaagtggtcccttagggctgaaggacttcagactcaatgataagtctgaagtggaaagatgtaagaagtttgatcttgaatgtagacaatggaaggacagattcgagggggccagtattgtagacagggacatgcattaggaggctgttataaaaatccaggtgagaaataatccaggccaagaccagagtggtggctgtagaatacttagaatgtggaactgagaagacttggtaattgactatttgggagtggcgacagggaatgggagctcgtgattggaaggggttaaggtgagtagagaggctatgcacaagctgagcaggtcgtgatactgatggacctaccctgccttgttctgtcctctagaggatgagaagaggaaacaaactgcaccagggaagctcaggccgattcaatgcatgcaagggtgatttaacctgggttctgtttgaaatactt

SEQ ID NO: 109578 - DNA, 2382 bp, Homo sapiens
  Payload ID: 1520
  Gene Symbol: AGBL5
  Gene Name: ATP/GTP binding protein-like 5
  Uniprot ID: Q8NDL9
  ENST ID: ENST00000323064
  CDS Start-End: 163-2316
cccggcaccgcggcgctcgggtgtttttgggggcccgggtggagggcccgggtgccggggcccaaggtgcggcctcgctagcgggagagggagcgggatcaccggcccggagagagctctcagggccagagcggggcaggaggatgctttcccagccccaccatggagctgcgctgtgggggattgctgttcagttctcgctttgattcagggaatctagcccacgtggagaaggtggaatctttgtccagtgatggggaaggggtaggaggtggggcgtcagccctgaccagtggcattgcctcttcccctgactatgaattcaacgtgtggacccgaccagactgtgctgaaacggaatttgagaatgggaacaggtcatggttctacttcagcgtccggggaggaatgccaggaaaactcatcaagatcaacattatgaacatgaacaagcagagcaagctgtattcccagggcatggccccctttgtgcgcacactgcccacccggccacgctgggaacgcattcgagaccggcccacctttgagatgacagagacgcagtttgtgttatcctttgttcatcgtttcgtggagggccgtggggccaccaccttcttcgccttctgctaccccttctcctacagtgactgccaggaactgctaaaccagctagaccagcgctttccggagaaccaccctacccatagcagccccctggataccatctattaccatcgggagctcctttgctattctctggatggacttcgtgtagatctgctgacgatcacttcctgccatgggcttcgagaagatcgagagccccgtctagagcagctatttcctgataccagcacccctcgaccattccgtttcgcaggcaagaggatattcttcttaagcagtagagtacacccaggggagactccatctagctttgtcttcaatggctttctggacttcatcctccgacctgatgatccccgggcccaaaccctccgtcgcctcttcgtctttaagctgattcccatgttgaaccccgatggtgtggtccggggacactaccgcacagactcacgtggagtgaatctgaaccgtcagtacctgaagcctgatgccgtcctgcacccggccatctatggggccaaagctgtgcttctctaccaccatgtgcactctcgtctgaactcccagagttcctctgagcaccagcccagttcctgtctccctcctgatgctcctgtttctgacctggagaaagccaacaatctccaaaatgaagctcagtgtgggcactcagctgacaggcataacgctgaagcctggaaacaaacagagccagcagaacagaagctcaacagtgtgtggattatgccacaacagtctgcggggcttgaagagtcagcccctgataccatcccccccaaagagagtggcgttgcttactatgtggacctgcatggacatgcttccaaaaggggctgcttcatgtacggaaacagctttagtgatgagagcacccaggtggaaaacatgctatatccaaagctcatctccttgaattcagcccacttcgacttccagggctgcaatttctcagagaagaatatgtatgcccgagaccgtagagatggccagtctaaagagggaagcggccgtgttgcaatctacaaagcctcagggataatccacagctacacacttgaatgcaactacaacactggacgctcagtaaacagcatccctgctgcctgccatgacaatgggcgtgccagcccccctcccccgccggctttcccctccagatacactgtggaactatttgagcaggtgggacgagctatggccattgcagccctggacatggcggaatgtaatccgtggccccgaattgtactgtcagagcacagcagccttactaatctacgggcctggatgctgaaacatgtacgcaacagccgaggcctaagcagcactctgaatgtgggtgtcaacaagaagaggggccttcgaactccacccaaaagtcacaatgggttgcctgtctcctgctccgaaaacaccttgagtcgggcacgaagttttagcaccggcacaagtgccggtggtagcagcagcagccaacaaaattctccacagatgaagaattcccccagctttccttttcatggcagtcggcctgcagggctgccaggcctgggctctagtacccaaaaggtcacccaccgggtgctgggccccgtcagaggtaagccagtctgggagcccctgcaacatgtgttcggttgtctggggcattgctgggggaagtaagagcttgaagatatactgttggcccaggaccaaggggtgaatcaataaaattagtttgtagcagaa

SEQ ID NO: 109579 - DNA, 3177 bp, Homo sapiens
  Payload ID: 1520
  Gene Symbol: AGBL5
  Gene Name: ATP/GTP binding protein-like 5
  Uniprot ID: Q8NDL9
  ENST ID: ENST00000360131
  CDS Start-End: 160-2820
ggcaccgcggcgctcgggtgtttttgggggcccgggtggagggcccgggtgccggggcccaaggtgcggcctcgctagcgggagagggagcgggatcaccggcccggagagagctctcagggccagagcggggcaggaggatgctttcccagccccaccatggagctgcgctgtgggggattgctgttcagttctcgctttgattcagggaatctagcccacgtggagaaggtggaatctttgtccagtgatggggaaggggtaggaggtggggcgtcagccctgaccagtggcattgcctcttcccctgactatgaattcaacgtgtggacccgaccagactgtgctgaaacggaatttgagaatgggaacaggtcatggttctacttcagcgtccggggaggaatgccaggaaaactcatcaagatcaacattatgaacatgaacaagcagagcaagctgtattcccagggcatggccccctttgtgcgcacactgcccacccggccacgctgggaacgcattcgagaccggcccacctttgagatgacagagacgcagtttgtgttatcctttgttcatcgtttcgtggagggccgtggggccaccaccttcttcgccttctgctaccccttctcctacagtgactgccaggaactgctaaaccagctagaccagcgctttccggagaaccaccctacccatagcagccccctggataccatctattaccatcgggagctcctttgctattctctggatggacttcgtgtagatctgctgacgatcacttcctgccatgggcttcgagaagatcgagagccccgtctagagcagctatttcctgataccagcacccctcgaccattccgtttcgcaggcaagaggatattcttcttaagcagtagagtacacccaggggagactccatctagctttgtcttcaatggctttctggacttcatcctccgacctgatgatccccgggcccaaaccctccgtcgcctcttcgtctttaagctgattcccatgttgaaccccgatggtgtggtccggggacactaccgcacagactcacgtggagtgaatctgaaccgtcagtacctgaagcctgatgccgtcctgcacccggccatctatggggccaaagctgtgcttctctaccaccatgtgcactctcgtctgaactcccagagttcctctgagcaccagcccagttcctgtctccctcctgatgctcctgtttctgacctggagaaagccaacaatctccaaaatgaagctcagtgtgggcactcagctgacaggcataacgctgaagcctggaaacaaacagagccagcagaacagaagctcaacagtgtgtggattatgccacaacagtctgcggggcttgaagagtcagcccctgataccatcccccccaaagagagtggcgttgcttactatgtggacctgcatggacatgcttccaaaaggggctgcttcatgtacggaaacagctttagtgatgagagcacccaggtggaaaacatgctatatccaaagctcatctccttgaattcagcccacttcgacttccagggctgcaatttctcagagaagaatatgtatgcccgagaccgtagagatggccagtctaaagagggaagcggccgtgttgcaatctacaaagcctcagggataatccacagctacacacttgaatgcaactacaacactggacgctcagtaaacagcatccctgctgcctgccatgacaatgggcgtgccagcccccctcccccgccggctttcccctccagatacactgtggaactatttgagcaggtgggacgagctatggccattgcagccctggacatggcggaatgtaatccgtggccccgaattgtactgtcagagcacagcagccttactaatctacgggcctggatgctgaaacatgtacgcaacagccgaggcctaagcagcactctgaatgtgggtgtcaacaagaagaggggccttcgaactccacccaaaagtcacaatgggttgcctgtctcctgctccgaaaacaccttgagtcgggcacgaagttttagcaccggcacaagtgccggtggtagcagcagcagccaacaaaattctccacagatgaagaattcccccagctttccttttcatggcagtcggcctgcagggctgccaggcctgggctctagtacccaaaaggtcacccaccgggtgctgggccccgtcagagagccccgaagccaggacaggagacggcagcagcagcccctgaaccatcgtcctgcaggcagcctcgctccatccccagctcctactagttctggcccagcctcctcacacaagctgggctcctgtctactgcctgattcattcaacataccagggagcagttgctcactcttgtcctctggagacaaaccagaggctgtcatggtaatcgggaaaggtctgctagggactggagctcggatgccctgcatcaagactcgattgcaggctaggcccaggttgggccggggctcaccgccgactcgcagagggatgaaaggctcttcaggccccacatcccctaccccccggaccagggagagcagtgagctggagctgggatcctgctctgctacaccagggctgcctcaggccaggcccccacggccccgctctgcccctgccttttctcctatatcctgtagtctatctgactccccatcctggaattgttacagcaggggtcccttgggccaacctgaggtttgttttgtccctaaatctcccccactgactgtttctccccgggtctgataatgcctttatgttcaagcccaggatatagccccaagatggggtaacagtgggaaatatgctagttcccctccaggccgctgattccatgtgacagccgttaagtccttggaatgccagccacgctgtccaaggcattacagagtatcaccttgagacagaacaaaacagggacctgccaccccttccctccctccgcagcacaagattttgggaccacaaaaaaaagtctatatttttatattggggggagggagtagaaaagcaagcccctatactgggccctattcagtggcagcttcttgttccataggattaaggaagactctgaggaaataaaagttgtttggaaaaatc

SEQ ID NO: 109580 - DNA, 673 bp, Homo sapiens
  Payload ID: 1520
  Gene Symbol: AGBL5
  Gene Name: ATP/GTP binding protein-like 5
  ENST ID: ENST00000453161
  CDS Start-End: 202-673
tttctgcgttcaatgtacatgtgttgagtcccagtttctgccgctttatctttcccgcctcccggcaggcaggccgttaaccgtcttccggaagacgctgctagaaccctccggccgctcctgcccgccatcgtccccgaacgacactcgctcagctctcagggccagagcggggcaggaggatgctttcccagccccaccatggagctgcgctgtgggggattgctgttcagttctcgctttgattcagggaatctagcccacgtggagaaggtggaatctttgtccagtgatggggaaggggtaggaggtggggcgtcagccctgaccagtggcattgcctcttcccctgactatgaattcaacgtgtggacccgaccagactgtgctgaaacggaatttgagaatgggaacaggtcatggttctacttcagcgtccggggaggaatgccaggaaaactcatcaagatcaacattatgaacatgaacaagcagagcaagctgtattcccagggcatggccccctttgtgcgcacactgcccacccggccacgctgggaacgcattcgagaccggcccacctttgagatgacagagacgcagtttgtgttatcctttgttcatcgtttcgtggagggccgtggggccaccaccttcttcgccttctgctacc

SEQ ID NO: 109581 - DNA, 559 bp, Homo sapiens
  Payload ID: 1520
  Gene Symbol: AGBL5
  Gene Name: ATP/GTP binding protein-like 5
  ENST ID: ENST00000421915
  CDS Start-End: 364-559
aaagtgaggtcatgaatacaacagcatctcgtgttcgctacgtttcctctggaattagcccacaagcagaccccttgctctcctagtggcaattaaccatgaccatcttcctggagaagagaaactacctggcaaagggccaaagtcttaggactgctgggcaggagaactggcctgtgttcaagttgagtcccagtttctgccgctttatctttcccgcctcccggcaggcaggccgttaaccgtcttccggaagacgctgctagaaccctccggccgctcctgcccgccatcgtccccgaacgacactcgctcagctctcagggccagagcggggcaggaggatgctttcccagccccaccatggagctgcgctgtgggggattgctgttcagttctcgctttgattcagggaatctagcccacgtggagaaggtggaatctttgtccagtgatggggaaggggtaggaggtggggcgtcagccctgaccagtggcattgcctcttcccctgactatgaattcaacgtgtggacccgaccagactgtgctgaaacgg

SEQ ID NO: 109582 - DNA, 489 bp, Homo sapiens
  Payload ID: 1520
  Gene Symbol: AGBL5
  Gene Name: ATP/GTP binding protein-like 5
  ENST ID: ENST00000437006
  CDS Start-End: 414-489
ccccgctcccgacctggcttacgcggtcccgaccccgcccagctccgtggcctcacctctgactcctaggccctccctgcctaatcccctgccgcgggagcccgtctcgaccccttccatgcctcccagtcccaccctgcccagggcaagcccgctcggtgtgacggttccccgcgagtcgagggtggagaagccagcctccttcccccgagtgggactctagcagcccacctcttttaggggtgctgagaacacccattactcatccacagctactagggtagctttctcagggtgcagtgcttacggggcggagggggatggaaacagacccatgccctggctggaagggagctccagtcgctagctctcagggccagagcggggcaggaggatgctttcccagccccaccatggagctgcgctgtgggggattgctgttcagttctcgctttgattcagggaatctagcccacgtggagaaggtgg

SEQ ID NO: 109583 - DNA, 481 bp, Homo sapiens
  Payload ID: 1520
  Gene Symbol: AGBL5
  Gene Name: ATP/GTP binding protein-like 5
  ENST ID: ENST00000441931
  CDS Start-End: 1-414
agcagcagcagccaacaaaattctccacagatgaagaattcccccagctttccttttcatggcagtcggcctgcagggctgccaggcctgggctctagtacccaaaaggtcacccaccgggtgctgggccccgtcagagagccccgaagccaggacaggagacggcagcagcagcccctgaaccatcgtcctgcaggcagcctcgctccatccccagctcctactagttctggcccagcctcctcacacaagctgggctcctgtctactgcctgattcattcaacataccaggtctgtacccactgccactgaaatctgggtttgccagcctcctccatggccaggccaggttctttaagcctagttgggagaccaggggcatcacttatcctcttggtatcctaaacctctaacactggtgcctttgtataggaagctggaatttattaatgtgtctgtgtaataaaacaatagttaaca

SEQ ID NO: 109584 - DNA, 581 bp, Homo sapiens
  Payload ID: 1520
  Gene Symbol: AGBL5
  Gene Name: ATP/GTP binding protein-like 5
  ENST ID: ENST00000451003
  CDS Start-End: 384-581
agagcggggtcccggcaccgcggcgctcgggtgtttttgggggcccgggtggagggcccgggtgccggggcccaaggtgcggcctcgctagcgggagagggagcgggatcaccggcccggagagaggcataaggtaggaacaaaaaaggaagaaccagcccttccagggctcaggggagcaacaccagaatgtccgctcagtacttgtgaggacagaggctggagagaggactacccatttacactcagaacctcgattcctctctctgctctgtgctggagagtgcagagccagagatccagaacggcccatctctaaaggtggccatgtatggtgctctcagggccagagcggggcaggaggatgctttcccagccccaccatggagctgcgctgtgggggattgctgttcagttctcgctttgattcagggaatctagcccacgtggagaaggtggaatctttgtccagtgatggggaaggggtaggaggtggggcgtcagccctgaccagtggcattgcctcttcccctgactatgaattcaacgtgtggacccgaccagactgtgctgaaacggaa

SEQ ID NO: 109585 - DNA, 3261 bp, Homo sapiens
  Payload ID: 1520
  Gene Symbol: AGBL5
  Gene Name: ATP/GTP binding protein-like 5
  Uniprot ID: Q8NDL9
  ENST ID: ENST00000487078
  CDS Start-End: 195-2645
gagagacttcttgtttcctggcagagcggggtcccggcaccgcggcgctcgggtgtttttgggggcccgggtggagggcccgggtgccggggcccaaggtgcggcctcgctagcgggagagggagcgggatcaccggcccggagagagctctcagggccagagcggggcaggaggatgctttcccagccccaccatggagctgcgctgtgggggattgctgttcagttctcgctttgattcagggaatctagcccacgtggagaaggtggaatctttgtccagtgatggggaaggggtaggaggtggggcgtcagccctgaccagtggcattgcctcttcccctgactatgaattcaacgtgtggacccgaccagactgtgctgaaacggaatttgagaatgggaacaggtcatggttctacttcagcgtccggggaggaatgccaggaaaactcatcaagatcaacattatgaacatgaacaagcagagcaagctgtattcccagggcatggccccctttgtgcgcacactgcccacccggccacgctgggaacgcattcgagaccggcccacctttgagatgacagagacgcagtttgtgttatcctttgttcatcgtttcgtggagggccgtggggccaccaccttcttcgccttctgctaccccttctcctacagtgactgccaggaactgctaaaccagctagaccagcgctttccggagaaccaccctacccatagcagccccctggataccatctattaccatcgggagctcctttgctattctctggatggacttcgtgtagatctgctgacgatcacttcctgccatgggcttcgagaagatcgagagccccgtctagagcagctatttcctgataccagcacccctcgaccattccgtttcgcaggcaagaggatattcttcttaagcagtagagtacacccaggggagactccatctagctttgtcttcaatggctttctggacttcatcctccgacctgatgatccccgggcccaaaccctccgtcgcctcttcgtctttaagctgattcccatgttgaaccccgatggtgtggtccggggacactaccgcacagactcacgtggagtgaatctgaaccgtcagtacctgaagcctgatgccgtcctgcacccggccatctatggggccaaagctgtgcttctctaccaccatgtgcactctcgtctgaactcccagagttcctctgagcaccagcccagttcctgtctccctcctgatgctcctgtttctgacctggagaaagccaacaatctccaaaatgaagctcagtgtgggcactcagctgacaggcataacgctgaagcctggaaacaaacagagccagcagaacagaagctcaacagtgtgtggattatgccacaacagtctgcggggcttgaagagtcagcccctgataccatcccccccaaagagagtggcgttgcttactatgtggacctgcatggacatgcttccaaaaggggctgcttcatgtacggaaacagctttagtgatgagagcacccaggtggaaaacatgctatatccaaagctcatctccttgaattcagcccacttcgacttccagggctgcaatttctcagagaagaatatgtatgcccgagaccgtagagatggccagtctaaagagggaagcggccgtgttgcaatctacaaagcctcagggataatccacagctacacacttgaatgcaactacaacactggacgctcagtaaacagcatccctgctgcctgccatgacaatgggcgtgccagcccccctcccccgccggctttcccctccagatacactgtggaactatttgagcaggtgggacgagctatggccattgcagccctggacatggcggaatgtaatccgtggccccgaattgtactgtcagagcacagcagccttactaatctacgggcctggatgctgaaacatgtacgcaacagccgaggcctaagcagcactctgaatgtgggtgtcaacaagaagaggggccttcgaactccacccaaaagtcacaatgggttgcctgtctcctgctccgaaaacaccttgagtcgggcacgaagttttagcaccggcacaagtgccggtggtagcagcagcagccaacaaaattctccacagatgaagaattcccccagctttccttttcatggcagtcggcctgcagggctgccaggcctgggctctagtacccaaaaggtcacccaccgggtgctgggccccgtcagagagccccgaagccaggacaggagacggcagcagcagcccctgaaccatcgtcctgcaggcagcctcgctccatccccagctcctactagttctggcccagcctcctcacacaagctgggctcctgtctactgcctgattcattcaacataccagggagcagttgctcactcttgtcctctggagacaaaccagaggctgtcatggtaatcgggaaaggtctgctagggactggagctcggatgccctgcatcaagactcgattgcagacctgtccgaggagagtttccgccaggaggggtcccggattccccaggctaggcccaggttgggccggggctcaccgccgactcgcagagggatgaaaggctcttcaggccccacatcccctaccccccggaccagggagagcagtgagctggagctgggatcctgctctgctacaccagggctgcctcaggccaggcccccacggccccgctctgcccctgccttttctcctatatcctgtagtctatctgactccccatcctggaattgttacagcaggggtcccttgggccaacctgaggtttgttttgtccctaaatctcccccactgactgtttctccccgggtctgataatgcctttatgttcaagcccaggatatagccccaagatggggtaacagtgggaaatatgctagttcccctccaggccgctgattccatgtgacagccgttaagtccttggaatgccagccacgctgtccaaggcattacagagtatcaccttgagacagaacaaaacagggacctgccaccccttccctccctccgcagcacaagattttgggaccacaaaaaaaagtctatatttttatattggggggagggagtagaaaagcaagcccctatactgggccctattcagtggcagcttcttgttccataggattaaggaagactctgaggaaataaaagttgtttggaaaaatcca

SEQ ID NO: 109586 - DNA, 2491 bp, Homo sapiens
  Payload ID: 1521
  Gene Symbol: ATP5J2-PTCD1
  Gene Name: ATP5J2-PTCD1 readthrough
  ENST ID: ENST00000413834
  CDS Start-End: 24-2273
acagcggacaccaggactccaaaatggcgtcagttgtaccagtgaaggacaagaaacttctggaggtcaaactgggggagctgccaagctggatcttgatgcgggacttcagtcctagtggcattttcggagcgtttcaaagaggccctggagggacaggaaagccagaaatggacttcgtgagactcgctcgactgttcgccagggcccgccccatgggactgttcatcctgcaacacctggacccctgtagagccaggtgggcaggaggcagggaggggctgatgcggccaatgtgggcgcccttcagcagctcctcctctcagctgcccctcggccaggagcgtcaggaaaacacgggcagcctgggctctgacccgagccactccaactccacggccacgcaggaagaagacgaggaggaggaggagagttttgggaccctctctgacaaatactcctcccggagactattccgcaaatccgcagcccagttccataacctgcggtttggggaacggagagatgagcaaatggaaccggagcccaaattatggcgaggccggagaaacaccccgtactggtacttcttgcagtgcaaacacctgatcaaggaagggaagctggttgaagccctggacctgtttgagaggcagatgctgaaggaggagcgattgcagcccatggagagcaactacacggtgctgattgggggctgcgggcgggttggctacctgaagaaggccttcaacctctacaaccagatgaaaaagcgggacctggagccctcggacgccacctacacggccctgttcaacgtctgtgccgagtccccctggaaggactcagctctacagagcgccctgaagctccggcagcagctgcaggccaaaaacttcgagctcaacttgaaaacataccacgcgctgctgaagatggctgccaagtgcgcagaccttaggatgtgcctcgatgtgttcaaggaaatcatccacaaagggcacgtggtcacagaggagaccttcagtttcctgctcatgggctgcatccaagacaagaagacaggcttccggtacgccctccaggtgtggcggctgatgctgagtctagggctacagccgagccgggacagctacaacctgctgttggtggcagctcgggactgtggcctaggggacccccaggtggcctcagagctgcttctgaagcccagggaggaggcgactgtgcttcagcccccagtgagcaggcagcggccaaggaggacagcccaggccaaggcaggcaacctcatgtcagccatgctgcatgtggaggccctggagaggcagctgtttctggaaccttctcaggcacttgggcctccagagcctccggaagccagagtgcccggcaaggcccaaccagaggtggatactaaggcagagcccagccacacagcagccctcaccgcagtggccctgaagccacctcccgtggagctggaagtcaacctcctgacccccggggccgttccccctacagtggtctcctttggaacggtgaccaccccagctgaccggctggccttgatagggggcctggagggcttcctgagcaagatggcagagcacaggcagcagcccgacatcaggaccctcacgctactggccgaggtggtggagtccgggagtcctgcagagtccttgctgctggccctcctggatgagcaccaggtagaggccgacctgacattctttaacacgctggtgagaaagaagagcaagctgggagacctggagggggccaaggcgctgttgccggtcctggcaaagaggggcctcgtccccaacctgcagacattctgcaacctggccatcgggtgccacaggccgaaggacggtctacagcttctcacagacatgaagaagtcccaggtgacccccaacactcacatctacagtgccctcatcaacgcggccatcaggaagctgaactacacctatctcatcagcatcttgaaggacatgaagcagaacagggtcccggtgaacgaagtggtcatccgccagctggagtttgcagcccagtaccctcccacctttgaccggtaccaagggaagaacacctacctggagaagattgacggcttccgagcctattacaagcagtggctgacagtgatgcccgcagaggaaaccccgcacccctggcagaagttccggaccaagccccagggggaccaggacaccggcaaggaggctgatgacggatgtgcccttgggggcaggtgatgggagcacagctggaacaatgtgctcggcccccagtgctctgtgggagccccaggacaagtgagctggtgtcacctcctgcctgggggaagagccaggccctgaggaacagccgcagcgtgtcacaggtgttggtgaggacacacactaggcccaaggtgcctgtgctcccagcaggtccaagtgcagctccagccacctttgcgtgtcaccttcac

SEQ ID NO: 109587 - DNA, 331 bp, Homo sapiens
  Payload ID: 1521
  Gene Symbol: ATP5J2-PTCD1
  Gene Name: ATP5J2-PTCD1 readthrough
  ENST ID: ENST00000451138
  CDS Start-End: 22-186
agcggacaccaggactccaaaatggcgtcagttgtaccagtgaaggacaagaaacttctggaggtcaaactgggggagctgccaagctggatcttgatgcgggacttcagtcctagtggcattttcggagcgtttcaaagaggatatggacaagcagcgagtgtggagggtgcctaccgactctgaagccctggctggagcaacacccatggctaggtgtgtcccgggcctcaggaacaggccctggagggacaggaaagccagaaatggacttcgtgagactcgctcgactgttcgccagggcccgccccatgggactgttcatcctgca

SEQ ID NO: 109588 - DNA, 1692 bp, Homo sapiens
  Payload ID: 1522
  Gene Symbol: ATP5SL
  Gene Name: ATP5S-like
  Uniprot ID: Q9NW81
  ENST ID: ENST00000221943
  CDS Start-End: 7-780
agcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccaaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcaagtt

SEQ ID NO: 109589 - DNA, 1134 bp, Homo sapiens
  Payload ID: 1522
  Gene Symbol: ATP5SL
  Gene Name: ATP5S-like
  Uniprot ID: Q9NW81
  ENST ID: ENST00000301183
  CDS Start-End: 31-606
ataagagagcttggaagggattgttcgaggatgtgggatttggtcttagaagaccgaaggatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcacccc

SEQ ID NO: 109590 - DNA, 1454 bp, Homo sapiens
  Payload ID: 1522
  Gene Symbol: ATP5SL
  Gene Name: ATP5S-like
  Uniprot ID: Q9NW81
  ENST ID: ENST00000438807
  CDS Start-End: 12-488
accttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccaaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcaagtta

SEQ ID NO: 109591 - DNA, 1065 bp, Homo sapiens
  Payload ID: 1522
  Gene Symbol: ATP5SL
  Gene Name: ATP5S-like
  Uniprot ID: Q9NW81
  ENST ID: ENST00000417807
  CDS Start-End: 31-822
ataagagagcttggaagggattgttcgaggatgtgggatttggtcttagaagaccgaaggatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggt

SEQ ID NO: 109592 - DNA, 541 bp, Homo sapiens
  Payload ID: 1522
  Gene Symbol: ATP5SL
  Gene Name: ATP5S-like
  ENST ID: ENST00000589102
  CDS Start-End: 12-541
accttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaagatcttacacctggctggagaagcaacatggtccatacggcgcaggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcct

SEQ ID NO: 109593 - DNA, 979 bp, Homo sapiens
  Payload ID: 1522
  Gene Symbol: ATP5SL
  Gene Name: ATP5S-like
  Uniprot ID: Q9NW81
  ENST ID: ENST00000589970
  CDS Start-End: 10-567
cttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacaca

SEQ ID NO: 109594 - DNA, 1622 bp, Homo sapiens
  Payload ID: 1522
  Gene Symbol: ATP5SL
  Gene Name: ATP5S-like
  Uniprot ID: Q9NW81
  ENST ID: ENST00000592922
  CDS Start-End: 38-730
taagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccaaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatatt

SEQ ID NO: 109595 - DNA, 1026 bp, Homo sapiens
  Payload ID: 1522
  Gene Symbol: ATP5SL
  Gene Name: ATP5S-like
  ENST ID: ENST00000590641
  CDS Start-End: 68-604
aaggagctaatggacaggcaagggtggggcctgtaggataagagagcttggaagggattgttcgaggatgtgggatttggtcttagaagaccgaaggatgaattccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagtgagacctcagctcaggctgggccacatgcccaggcacctctcccacctaacccagatgcaggagaggaagtggggaggggcaatgttaggcagttctcatatccccctgcatccatcacaaacctagagtatttatggtagatgagcagtcacagtgagtctctggaagaattaaatgactcctggttttcttcctttttgttttagtcaaaactgtgtgatatcgacgctgttgcagaacagcaggagctggagttgcatatttgcaattaacacagtgggcttcatgtgcctggacagctataaagattttattttaggaagctaaggttgaaatttggggccagtacctccctatacacacacacatgcacgcatgcacgcacgcacacacacacacgcacgcacacacactgtcctgtaa

SEQ ID NO: 109596 - DNA, 562 bp, Homo sapiens
  Payload ID: 1522
  Gene Symbol: ATP5SL
  Gene Name: ATP5S-like
  ENST ID: ENST00000586786
  CDS Start-End: 259-562
cacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaagtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttct

SEQ ID NO: 109597 - DNA, 782 bp, Homo sapiens
  Payload ID: 1522
  Gene Symbol: ATP5SL
  Gene Name: ATP5S-like
  ENST ID: ENST00000594339
  CDS Start-End: 29-97
aagagagcttggaagggattgttcgaggatgtgggatttggtcttagaagaccgaaggatgaatgtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagtgagacctcagctcaggctgggccacatgcccaggcacctctcccacctaacccagatgcaggagaggaagtggggaggggcaatgttaggcagttctcatatccccctgcatccatcacaaacctagagtatttatggtagatgagcagtcacagtgagtctctggaagaattaaatgactcctggttttcttcctttttgttttagtcaaaactgtgtgatatcgacgctgttgcagaacagcaggagctggagttgcatatttgcaattaacacagtgggcttcatgtgcctggacagctataaagattttattttaggaagctaaggttgaaatttggggccagtacctccctatacacacacacatgcacgcatgcacgcacgcacacacacacacgcacgcacacacactg

SEQ ID NO: 109598 - DNA, 572 bp, Homo sapiens
  Payload ID: 1522
  Gene Symbol: ATP5SL
  Gene Name: ATP5S-like
  ENST ID: ENST00000595425
  CDS Start-End: 10-528
cttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagtgagacctcagctcaggctgggccacatgcccaggcacctctcccac

SEQ ID NO: 109599 - DNA, 582 bp, Homo sapiens
  Payload ID: 1522
  Gene Symbol: ATP5SL
  Gene Name: ATP5S-like
  ENST ID: ENST00000594660
  CDS Start-End: 1-451
atacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgagggaccctgactgacacaggggctactactgacactttacagggatggttctcccccgtgcagggccgctgtgcccactgcaggacatgcagcatccttcgccccactccactcactaaaggccagcgcaccccaggcccc

SEQ ID NO: 109600 - DNA, 492 bp, Homo sapiens
  Payload ID: 1522
  Gene Symbol: ATP5SL
  Gene Name: ATP5S-like
  ENST ID: ENST00000597457
  CDS Start-End: 7-372
agcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctcaaaactgtgtgatatcgacgctgttgcagaacagcaggagctggagttgcatatttgcaattaacacagtgggcttcatgtgcctggacagctataaagattttattttaggaagctaaggttgaaatttgg

SEQ ID NO: 109601 - DNA, 2039 bp, Homo sapiens
  Payload ID: 1523
  Gene Symbol: ATP6V1G2-DDX39B
  Gene Name: ATP6V1G2-DDX39B readthrough (NMD candidate)
  ENST ID: ENST00000376185
  CDS Start-End: 24-323
cagcatcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 109602 - DNA, 552 bp, Homo sapiens
  Payload ID: 1523
  Gene Symbol: ATP6V1G2-DDX39B
  Gene Name: ATP6V1G2-DDX39B readthrough (NMD candidate)
  ENST ID: ENST00000480131
  CDS Start-End: 50-349
atctggtactttgacagcattcaaaacagcatcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagttatggcagagaacgatgtggacaatgagctcttggactatgaagatgatgaggtggagacagcagctgggggagatggggctgaggcccctgccaagaaggatgtcaagggctcctatgt

SEQ ID NO: 109603 - DNA, 2939 bp, Homo sapiens
  Payload ID: 1524
  Gene Symbol: ATAD1
  Gene Name: ATPase family, AAA domain containing 1
  Uniprot ID: Q8NBU5
  ENST ID: ENST00000328142
  CDS Start-End: 284-1369
gtatttttcaaataaaatgattaattctactaccaaataaatcttaatttctagtctacttctagtttgcaagaggagctttaaatgtatttgtttacttaacatttaaaaatccatttctccttaaaatgaaacactttttttaaggtaggtaatattttaatttgactagaagttagtttttctttcttagtttaagctactttgttagtcttacaattttaataagtatagttattacctagtgacatttctgtttgtttttttaaggttaacattcaagatggtacatgctgaagccttttctcgtcctttgagtcggaatgaagttgttggtttaattttccgtttgacaatatttggtgcagtgacatactttactatcaaatggatggtagatgcaattgatccaaccagaaagcaaaaagtagaagctcagaaacaggcagaaaaactaatgaagcaaattggagtgaaaaatgtgaagctctcagaatatgaaatgagtattgctgctcatcttgtagaccctcttaatatgcatgttacttggagtgatatagcaggtttagatgatgtcattacggatctgaaagacacagtcatcttacctatcaaaaagaaacatttgtttgagaattccaggcttctgcagcctccaaaaggtgttcttctctatgggcctccaggctgtggtaaaacgttgattgccaaggccacagccaaagaagcaggctgtcgatttattaaccttcagccttcgacactgaccgataagtggtatggagaatctcagaaattggctgctgctgtcttctcccttgccataaagctacaaccatccatcatctttatagatgaaatagactcctttctacgaaaccgttcaagttctgaccatgaagctacagccatgatgaaagctcagtttatgagtctctgggatggattggatactgatcacagctgccaggtcatagtaatgggagctaccaatcgtcctcaggaccttgactcggctataatgagaagaatgcctacaagatttcatatcaaccagcctgctttaaaacagagagaagcaatcctgaaactcatcttgaaaaatgaaaatgtggataggcatgtagacctgctagaagttgcccaggaaactgatgggttttcaggaagtgacctaaaagagatgtgtcgagatgctgccctcctctgtgttagagaatatgttaattctacatcagaagaaagccatgacgaagatgaaattcggcctgttcaacagcaggacctgcatcgggcaattgaaaagatgaagaaatcaaaggatgcagcatttcagaatgttttaacacatgtttgtttagattaagagtaaagatcatttgtacagttcagtgatctagtttggtgtgtcctcttatcagttagtggaaatagaacggaaagagtgctctttaaacaatgagggagctcagtgtttatggttttatactctgaattctaagttattgagatatagttgttacataggtggtattactgttggtcaaaaatcatgaggaggaacagttgaatccagcctgaacgtgggtgcttgtgtttgaccttttcagccatatattgtacagccttatagaatctaagctggtcttaaagtcataaatgattcattgggtcattagtgagaaacggggatgtggttaggtgctggttcctagacatgtgagtatgcgtttgtgtgtgtgcgtgtatgtatgtgtatattaaatgtatatatccacacattttatattgacattctgtagatatgtttgaatatagaaactttttttaccccaactactgaatccaggagtaccaaataatatatagtaaaactaagatttaaggttgtgtcaaaaaggtacagtgattcagccatttccatttgtcatttgtttcaaccttttttaagttgagtgtttttatttctgcagttattagttggatcctccacatcttgcatatatacatgggctcaattattatgtttgtcaggataatcaaatgaaaatactagttcagtgatcagcattgaatggttgttaggcagccatgtgctcaacactgatttcacctcttgagtataaactttttaaatttaaattggtttacatgaaagtggattaaaaggcctttcaaaagaatgggtttgaaaaacctcagtaccctttaatacatgtacatttctttccttttttcatttaatgtaacatgtctgttgtaactatgtttcttaaatattattttaaggttatgtgttctttaattatggtcaaatataatttggtcaccaaaaatgaaataatagtttaaaacaagtagctgttactaagtgtgctaaaaatactcattttataattaattttagttttcttagtatattattataaattgtgccctaagtcaggtacaaatgtacacatcaaaatgcccatattgtatctatctgtagtcgtttaatgtgaattatatgtgaatttttttcaaaattttactaaccagaattctgttataggcacctaaccacgcagcatgaggaaaacggcacaacacaatcttgaggtgccttctgaatcatcagattaaattatgcttcatatgtttttgcttttactgtatttctttaaaaactctaaatctttattcatgtgtcactggattaatttatctgataatgtgtctcacaagaatctgttagatcgtttattcttcagttgtactttgaatggtggggtggaagtttcaggtgaacaatggataacaaaaagcaagttatggaagattgtgaagaggatggaaaaactgaatacaagataccaaaaatgaaaaaaagtgtcccatttttaataactatattctattattttataaatgtgtaataaaggggtccctcttta

SEQ ID NO: 109604 - DNA, 4640 bp, Homo sapiens
  Payload ID: 1524
  Gene Symbol: ATAD1
  Gene Name: ATPase family, AAA domain containing 1
  Uniprot ID: Q8NBU5
  ENST ID: ENST00000308448
  CDS Start-End: 380-1465
agctggttcccgtggggcctcatgggatggttgtcgtatccttctgaggtcctttaaggaccgtctcggacctgggaacccccggaggaaaggtcaccccggtcttctcccacgccctacctcagtgccgcccccaagcgccccgcagcccttagtatctagaggattaacctccaagggcgtcccgggcctcgccttggcgtccggcccggcctgggcccttagggtctgcttagctcttccccaagactcgtgccattcccgagggaatctttgtcggcatcctggtcactgtgggggtttgaggtcgtcccggaagacttcagaaccaggcgaacctagacgaaggcggctggaatgaaccaggttaacattcaagatggtacatgctgaagccttttctcgtcctttgagtcggaatgaagttgttggtttaattttccgtttgacaatatttggtgcagtgacatactttactatcaaatggatggtagatgcaattgatccaaccagaaagcaaaaagtagaagctcagaaacaggcagaaaaactaatgaagcaaattggagtgaaaaatgtgaagctctcagaatatgaaatgagtattgctgctcatcttgtagaccctcttaatatgcatgttacttggagtgatatagcaggtttagatgatgtcattacggatctgaaagacacagtcatcttacctatcaaaaagaaacatttgtttgagaattccaggcttctgcagcctccaaaaggtgttcttctctatgggcctccaggctgtggtaaaacgttgattgccaaggccacagccaaagaagcaggctgtcgatttattaaccttcagccttcgacactgaccgataagtggtatggagaatctcagaaattggctgctgctgtcttctcccttgccataaagctacaaccatccatcatctttatagatgaaatagactcctttctacgaaaccgttcaagttctgaccatgaagctacagccatgatgaaagctcagtttatgagtctctgggatggattggatactgatcacagctgccaggtcatagtaatgggagctaccaatcgtcctcaggaccttgactcggctataatgagaagaatgcctacaagatttcatatcaaccagcctgctttaaaacagagagaagcaatcctgaaactcatcttgaaaaatgaaaatgtggataggcatgtagacctgctagaagttgcccaggaaactgatgggttttcaggaagtgacctaaaagagatgtgtcgagatgctgccctcctctgtgttagagaatatgttaattctacatcagaagaaagccatgacgaagatgaaattcggcctgttcaacagcaggacctgcatcgggcaattgaaaagatgaagaaatcaaaggatgcagcatttcagaatgttttaacacatgtttgtttagattaagagtaaagatcatttgtacagttcagtgatctagtttggtgtgtcctcttatcagttagtggaaatagaacggaaagagtgctctttaaacaatgagggagctcagtgtttatggttttatactctgaattctaagttattgagatatagttgttacataggtggtattactgttggtcaaaaatcatgaggaggaacagttgaatccagcctgaacgtgggtgcttgtgtttgaccttttcagccatatattgtacagccttatagaatctaagctggtcttaaagtcataaatgattcattgggtcattagtgagaaacggggatgtggttaggtgctggttcctagacatgtgagtatgcgtttgtgtgtgtgcgtgtatgtatgtgtatattaaatgtatatatccacacattttatattgacattctgtagatatgtttgaatatagaaactttttttaccccaactactgaatccaggagtaccaaataatatatagtaaaactaagatttaaggttgtgtcaaaaaggtacagtgattcagccatttccatttgtcatttgtttcaaccttttttaagttgagtgtttttatttctgcagttattagttggatcctccacatcttgcatatatacatgggctcaattattatgtttgtcaggataatcaaatgaaaatactagttcagtgatcagcattgaatggttgttaggcagccatgtgctcaacactgatttcacctcttgagtataaactttttaaatttaaattggtttacatgaaagtggattaaaaggcctttcaaaagaatgggtttgaaaaacctcagtaccctttaatacatgtacatttctttccttttttcatttaatgtaacatgtctgttgtaactatgtttcttaaatattattttaaggttatgtgttctttaattatggtcaaatataatttggtcaccaaaaatgaaataatagtttaaaacaagtagctgttactaagtgtgctaaaaatactcattttataattaattttagttttcttagtatattattataaattgtgccctaagtcaggtacaaatgtacacatcaaaatgcccatattgtatctatctgtagtcgtttaatgtgaattatatgtgaatttttttcaaaattttactaaccagaattctgttataggcacctaaccacgcagcatgaggaaaacggcacaacacaatcttgaggtgccttctgaatcatcagattaaattatgcttcatatgtttttgcttttactgtatttctttaaaaactctaaatctttattcatgtgtcactggattaatttatctgataatgtgtctcacaagaatctgttagatcgtttattcttcagttgtactttgaatggtggggtggaagtttcaggtgaacaatggataacaaaaagcaagttatggaagattgtgaagaggatggaaaaactgaatacaagataccaaaaatgaaaaaaagtgtcccatttttaataactatattctattattttataaatgtgtaataaaggggtccctctttattggttgttctccacttaatctttggtctttttcagtaattttaagttttctgggattttttttggtttataaaacttgtgtttagactttatcttgctatggagttttcacacttctatagcacatatcctagtatctagtcatttctgttttaatatgaatttcagtaatttaattttaatctggtgacatattaatcgaaaataaggagtaatgtatacctccacatgtcctttctttttgtcttctcttaaattcacaatatccagtaggagtggttattcaatttcttcgtggttttaatcatcaaatgaagttagagaagtatactaatcccagcaactatgactcatctaggcatgttaagaccataaagtaattcaggaaactattttcctgatttttaaataacttttagtgttatgtaacatctatccttctgttttagacatgcatttcacatatagttgaattctagattctaagataattcattttgggtaatacttcagagtactggatctagaatcaggcttcctgaatttaaactcaggctccccattaactgtgtgtctgtgagcccagtttctcatctgtaaaatggggcaacagtggcactcatcttaaagggttggataataaaataatgcatgtaaggccctcagcatagtgcctggcacagaattactgctcaaatgttagctgtcgtattaatattgtcacttttgcacactgatgtacatttcctgttgaccaggctcattctttaagcattctccatgcttaaaccagttccataatccctaggcctgtactccagggattgagactgaaaggatcatttatgccatgtttctctaaaagcatcattgctggaagacttttgataagtctgatgtgtctcaagctattctcaggccttttttgtagagtttagaaatgaagtatttgaatcaatttagtatctcctttactatgtttctccttttaatctcagccaaccccctacctgcaggtaaacccagcattcattaagagctgggttggggtactctattctgtatgcatcataatagcttaacattatttagtagctgtaacttacaggtttaatgctagatgaggatgtctcaagccgtgagtgtgcttgtgtaaaaatggtggcaacatcatctcgttggtaggaattttttacttgaattgttattttgggaaaatgttaacagatttcttctggataaagaaaataaattggatgatgtatattttatgtttctttttagcttctcttaaaatcagaatattgaacagaattctgatatgctgaatatatatagtgcatggctgaaactccagcaccaactgggtgcttcaaatgaagtcatagaataattccatctagagctgacagaaatctttcagagccttcattattaaatttgttatagatttagttatcaaagatagagttctctaatcttttttttaaagctaaagttctctttatttacatgtataggaaaacattctgcctaaatcatgatgttaatgaaaatcatattgaggagaacttgaaccttattaaatatgagcttctaacataa

SEQ ID NO: 109605 - DNA, 2939 bp, Homo sapiens; identical to SEQ ID NO: 109603
  Payload ID: 1524
  Gene Symbol: ATAD1
  Gene Name: ATPase family, AAA domain containing 1
  ENST ID: ENST00000634773
  CDS Start-End: 284-1369

SEQ ID NO: 109606 - DNA, 4640 bp, Homo sapiens; identical to SEQ ID NO: 109604
  Payload ID: 1524
  Gene Symbol: ATAD1
  Gene Name: ATPase family, AAA domain containing 1
  ENST ID: ENST00000634970
  CDS Start-End: 380-1465

SEQ ID NO: 109607 - DNA, 5565 bp, Homo sapiens
  Payload ID: 1525
  Gene Symbol: ATAD2
  Gene Name: ATPase family, AAA domain containing 2
  Uniprot ID: Q6PL18
  ENST ID: ENST00000287394
  CDS Start-End: 109-4281
cgcggagcttgtggcgccagaattcggagcgcggaagagccagagctgcgagcgcctggagctggatctctctccggtcgcgcacgccgaggccagtagggagagaagatggtggttctccgcagcagcttggagctgcacaaccactccgcggcctcggccacgggctccttggacctgtccagtgacttcctcagtctggagcacatcggccggaggcggctccgctcggccggcgcggcgcagaagaaacccgcggcgaccacagccaaagcgggcgatgggtcatcagttaaggaagttgaaacctaccaccggacacgtgctttaagatctttgagaaaagatgcacagaattcttcagattctagttttgagaagaatgtggaaataacggagcaacttgctaatggcaggcattttacaaggcagttggccagacagcaggctgataaaaaaaaagaagagcacagagaagacaaagtgattccagttactcggtcattgagggctagaaacatcgttcaaagtacagaacacttacatgaagataatggtgatgttgaagtgcgtcgaagttgtaggattagaagtcgttatagtggtgtaaaccagtccatgctgtttgacaaacttataactaacactgctgaagctgtacttcaaaaaatggatgacatgaagaagatgcgtagacagcgaatgagagaacttgaagacttgggagtgtttaatgaaacagaagaaagcaatcttaatatgtacacaagaggaaaacagaaagatattcaaagaactgatgaagaaacaactgataatcaagaaggcagtgtggagtcatctgaagagggtgaagaccaagaacatgaagatgatggtgaagatgaagatgatgaagatgatgatgatgatgacgatgatgatgatgatgatgatgatgaagatgatgaagatgaagaagatggagaagaagagaatcagaagcgatattatcttagacagagaaaagctactgtttactatcaggctccattggaaaaacctcgtcaccagagaaagcccaacatattttatagtggcccagcttctcctgcaagaccaagataccgattatcttccgcaggaccaagaagtccttactgtaaacgaatgaacaggcgaaggcatgcaatccacagtagtgactcgacttcatcttcctcctctgaagatgaacagcactttgagaggcggaggaaaaggagtcgtaatagggctatcaataggtgcctcccactaaattttcggaaagatgaattaaaaggcatttataaagatcgaatgaaaattggagcaagccttgccgatgttgatccaatgcaactagattcttcagtacgatttgatagtgttggtggcctgtctaatcatatagcagctctaaaagagatggtggtgtttccattactttatccagaagtctttgaaaaatttaaaattcaacccccaagaggttgtttgttttatgggccacctggaactggaaagactctggttgccagagcacttgccaatgagtgcagtcaaggggataaaagagtagcatttttcatgaggaaaggtgctgattgtctaagtaaatgggtaggagaatctgaaagacagctacgattgctgtttgatcaggcctatcagatgcgcccatcaattattttttttgacgaaattgatggtctggctccagtacggtcaagcaggcaagatcagattcacagttctattgtttccaccctgctagctcttatggatggattggacagcagaggggaaattgtggtcattggtgctacgaacaggctagattctatagatcctgctttacgaaggcctggtcgctttgatagagaattcctctttagcctgcctgataaagaggctcgaaaagagattctaaagattcacaccagggattggaatcccaaaccactggacacatttttagaagagctagcagaaaactgtgttggatactgtggagcagatattaaatcaatatgtgctgaagctgctttatgtgctttacgacgacgctacccacagatctataccactagtgagaaactgcagttggatctctcttcaattaatatctcagctaaggatttcgaggtagctatgcaaaagatgataccagcctcccaaagagctgtgacatcacctgggcaggcactgtccaccgttgtgaaaccactcctgcaaaacactgttgacaagattttagaagccctgcagagagtatttccacatgcagaattcagaacaaataaaacattagactcagatatttcttgtcctctgctagaaagtgacttggcttacagtgatgatgatgttccatcagtttatgaaaatggactttctcagaaatcttctcataaggcaaaagacaattttaattttcttcatttgaatagaaatgcttgttaccaacctatgtcttttcgaccaagaatattgatagtaggagaaccaggatttgggcaaggttctcacttggcaccagctgtcattcatgctttggaaaagtttactgtatatacattagacattcctgttctttttggagttagtactacatcccctgaagaaacatgtgcccaggtgattcgtgaagctaagagaacagcaccaagtatagtgtatgttcctcatatccacgtgtggtgggaaatagttggaccgacacttaaagccacatttaccacattattacagaatattccttcatttgctccagttttactacttgcaacttctgacaaaccccattccgctttgccagaagaggtgcaagaattgtttatccgtgattatggagagatttttaatgtccagttaccggataaagaagaacggacaaaattttttgaagatttaattctaaaacaagctgctaagcctcctatatcaaaaaagaaagcagttttgcaggctttggaggtactcccagtagcaccaccacctgagccaagatcactgacagcagaagaagtgaaacgactagaagaacaagaagaagatacatttagagaactgaggattttcttaagaaatgttacacataggcttgctattgacaagcgattccgagtgtttactaagcctgttgaccctgatgaggttcctgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattcaggaatctagaaagaaaagaggttgtagctcctccaaatatgccccgtcttactaccatgtgatgccaaagcaaaattccactcttgttggtgataaaagatcagacccagagcagaatgaaaagctaaagacaccgagtactcctgtggcttgcagcactcctgctcagttgaagaggaaaattcgcaaaaagtcaaactggtacttaggcaccataaaaaagcgaaggaagatttcacaggcaaaggatgatagccagaatgccatagatcacaaaattgagagtgatacagaggaaactcaagacacaagtgtagatcataatgagaccggaaacacaggagagtcttcggtggaagaaaatgaaaaacagcaaaatgcctctgaaagcaaactggaattgagaaataattcaaatacttgtaatatagagaatgagcttgaagactctaggaagactacagcatgtacagaattgagagacaagattgcttgtaatggagatgcttctagctctcagataatacatatttctgatgaaaatgaaggaaaagaaatgtgtgttctgcgaatgactcgagctagacgttcccaggtagaacagcagcagctcatcactgttgaaaaggctttggcaattctttctcagcctacaccctcacttgttgtggatcatgagcgattaaaaaatcttttgaagactgttgttaaaaaaagtcaaaactacaacatatttcagttggaaaatttgtatgcagtaatcagccaatgtatttatcggcatcgcaaggaccatgataaaacatcacttattcagaaaatggagcaagaggtagaaaacttcagttgttccagatgatgatgtcatggtatcgagtattctttatattcagttcctatttaagtcatttttgtcatgtccgcctaattgatgtagtatgaaaccctgcatctttaaggaaaagattaaaatagtaaaataaaagtatttaaactttcctgatatttatgtacatattaagataaatgtcatgtgtaagataactgataaatattggaactttgctagaacaagaccctgtagtaatagtaataatagttgaagtttggccaactcttaataaagttattttggtaactaatgttttatggcacttaagaataattagcagcgttaaattttgtttgtattaagcacttttaattttatccttcctaaaaatagtttattgtatctgacaagaaacttacttaaccattgtgtccttcccatcttttttgtcatctttgttttcttcaaatgccctcctcccatctgccttgagattccctcgtcttcacttaaaagccagagtgcaagtcatgatttgcgggagggctcttgaaccacttctggctgcaccacaattctgtacttgagtatcacagtcattgtttttgagacaaacatttttataattctaatttgggttaataaagattttaaatatttcttggtttacttttgtaattatatacacaacaaatgtattaataactaccttgttaaacaccttttaatagcacaaggtttttatatttgcaagctgttgatatctttctaaaactgtttaggttatagtctattgatactttttatatacaattttataaatataaatattataattttatattaatggtaccaaaaatacatttcttaaggttaaaagcatgcacttccatgcatacttgcttttggggagagtggggagaagacattctaataatcagtttgtgaaatagcttctgttggaaaccttttgaggggaataaggaatggtcatctaaaatgagagattctggattttaatgcagttcaaagttgagctgtatttttgttgttgatttatctggattttttttaaagccttctaaaacccagtgaattcaataccttaattagtacatactatcttatgtaatgcataaagcaatgccagtcactgagaacatttaaatatatttatattcctggagatacacattctcatttttgttggtttattataaattattcttctagatgcatcttttataactaggatttcattttgtgtgtatagcttatgtaataaattttaaaggtgaaaactctcttaaa

SEQ ID NO: 109608 - DNA, 5143 bp, Homo sapiens
  Payload ID: 1525
  Gene Symbol: ATAD2
  Gene Name: ATPase family, AAA domain containing 2
  ENST ID: ENST00000521903
  CDS Start-End: 2385-4511
aggtttgggcttggagttgggccctgaatggcgctttgctgtgaatctccgcggggaggctcttccaaccaggggctgagcttctgcgctgtggagaagccaggatctcatttgcctctttcaacatcactcctgctggagccaccaccagctcaatccttggcatcatcacctcactgaggagggtggtgtggtccttctcagcaagaaagtcgatgtctcgggaagtgacgatgcccaccggcttgctgcccatggtgcctgtctcagtgatggggataccagagaagccatgccgcatcgtggcctccagcacatcacccacagggtgcgaggggctcagcaccatggggtccgtgatgaagccatgttcaaacttcttgaccttccgcacctccttggcctggaactctggggtgcagttgtggtgaatgaaaccaatacctcccaccagagccatcgtgatggccatgttgccctctgtcacagtgtccatggaggaggagatcagcggcgtcttcagcgtgatcttccaggatgggtcatcagttaaggaagttgaaacctaccaccggacacgtgctttaagatctttgagaaaagatgcacagaattcttcagattctagttttgagaagaatgtggaaataacggagcaacttgctaatggcaggcattttacaaggcagttggccagacagcaggctgataaaaaaaaagaagagcacagagaagacaaagtgattccagttactcggtcattgagggctagaaacatcgttcaaagtacagaacacttacatgaagataatggtgatgttgaagtgcgtcgaagttgtaggattagaagtcgttatagtggtgtaaaccagtccatgctgtttgacaaacttataactaacactgctgaagctgtacttcaaaaaatggatgacatgaagaagatgcgtagacagcgaatgagagaacttgaagacttgggagtgtttaatgaaacagaagaaagcaatcttaatatgtacacaagaggaaaacagaaagatattcaaagaactgatgaagaaacaactgataatcaagaaggcagtgtggagtcatctgaagagggtgaagaccaagaacatgaagatgatggtgaagatgaagatgatgaagatgatgatgatgatgacgatgatgatgatgatgatgatgatgaagatgatgaagatgaagaagatggagaagaagagaatcagaagcgatattatcttagacagagaaaagctactgtttactatcaggctccattggaaaaacctcgtcaccagagaaagcccaacatattttatagtggcccagcttctcctgcaagaccaagataccgattatcttccgcaggaccaagaagtccttactgtaaacgaatgaacaggcgaaggcatgcaatccacagtagtgactcgacttcatcttcctcctctgaagatgaacagcactttgagaggcggaggaaaaggagtcgtaatagggctatcaataggtgcctcccactaaattttcggaaagatgaattaaaaggcatttataaagatcgaatgaaaattggagcaagccttgccgatgttgatccaatgcaactagattcttcagtacgatttgatagtgttggtggcctgtctaatcatatagcagctctaaaagagatggtggtgtttccattactttatccagaagtctttgaaaaatttaaaattcaacccccaagaggttgtttgttttatgggccacctggaactggaaagactctggttgccagagcacttgccaatgagtgcagtcaaggggataaaagagtagcatttttcatgaggaaaggtgctgattgtctaagtaaatgggtaggagaatctgaaagacagctacgattgctgtttgatcaggcctatcagatgcgcccatcaattattttttttgacgaaattgatggtctggctccagtacggtcaagcaggcaagatcagattcacagctcttatggatggattggacagcagaggggaaattgtggtcattggtgctacgaacaggctagattctatagatcctgctttacgaaggcctggtcgctttgatagagaattcctctttagcctgcctgataaagaggctcgaaaagagattctaaagattcacaccagggattggaatcccaaaccactggacacatttttagaagagctagcagaaaactgtgatactgtggagcagatattaaatcaatatgtgctgaagctgctttatgtgctttacgacgacgctacccacagatctataccactagtgagaaactgcagttggatctctcttcaattaatatctcagctaaggatttcgaggtagctatgcaaaagatgataccagcctcccaaagagctgtgacatcacctgggcaggcactgtccaccgttgtgaaaccactcctgcaaaacactgttgacaagattttagaagccctgcagagagtatttccacatgcagaattcagaacaaataaaacattagactcagatatttcttgtcctctgctagaaagtgacttggcttacagtgatgatgatgttccatcagtttatgaaaatggactttctcagaaatcttctcataaggcaaaagacaattttaattttcttcatttgaatagaaatgcttgttaccaacctatgtcttttcgaccaagaatattgatagtaggagaaccaggatttgggcaaggttctcacttggcaccagctgtcattcatgctttggaaaagtttactgtatatacattagacattcctgttctttttggagttagtactacatcccctgaagaaacatgtgcccaggtgattcgtgaagctaagagaacagcaccaagtatagtgtatgttcctcatatccacgtgtggtgggaaatagttggaccgacacttaaagccacatttaccacattattacagaatattccttcatttgctccagttttactacttgcaacttctgacaaaccccattccgctttgccagaagaggtgcaagaattgtttatccgtgattatggagagatttttaatgtccagttaccggataaagaagaacggacaaaattttttgaagatttaattctaaaacaagctgctaagcctcctatatcaaaaaagaaagcagttttgcaggctttggaggtactcccagtagcaccaccacctgagccaagatcactgacagcagaagaagtgaaacgactagaagaacaagaagaagatacatttagagaactgaggattttcttaagaaatgttacacataggcttgctattgacaagcgattccgagtgtttactaagcctgttgaccctgatgaggttcctgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattcaggaatctagaaagaaaagaggttgtagctcctccaaatatgccccgtcttactaccatgtgatgccaaagcaaaattccactcttgttggtgataaaagatcagacccagagcagaatgaaaagctaaagacaccgagtactcctgtggcttgcagcactcctgctcagttgaagaggaaaattcgcaaaaagtcaaactggtacttaggcaccataaaaaagcgaaggaagatttcacaggcaaaggatgatagccagaatgccatagatcacaaaattgagagtgatacagaggaaactcaagacacaagtgtagatcataatgagaccggaaacacaggagagtcttcggtggaagaaaatgaaaaacagcaaaatgcctctgaaagcaaactggaattgagaaataattcaaatacttgtaatatagagaatgagcttgaagactctaggaagactacagcatgtacagaattgagagacaagattgcttgtaatggagatgcttctagctctcagataatacatatttctgatgaaaatgaaggaaaagaaatgtgtgttctgcgaatgactcgagctagacgttcccaggtagaacagcagcagctcatcactgttgaaaaggctttggcaattctttctcagcctacaccctcacttgttgtggatcatgagcgattaaaaaatcttttgaagactgttgttaaaaaaagtcaaaactacaacatatttcagttggaaaatttgtatgcagtaatcagccaatgtatttatcggcatcgcaaggaccatgataaaacatcacttattcagaaaatggagcaagaggtagaaaacttcagttgttccagatgatgatgtcatggtatcgagtattctttatattcagttcctatttaagtcatttttgtcatgtccgcctaattgatgtagtatgaaaccctgcatctttaaggaaaagattaaaatagtaaaataaaagtatttaaactttcctgatatttatgtacatattaagataaatgtcatgtgtaagataactgataaatattggaactttgctagaacaagaccctgtagtaatagtaataatagttgaagtttggccaactcttaataaagttattttggtaactaatgttttatggcacttaagaataattagcagcgttaaattttgtttgtattaagcacttttaattttatccttcctaaaaatagtttattgtatctgacaagaaacttacttaaccattgtgtccttcccatcttttttgtcatctttgttttcttcaaatgccctcctcccatctgccttgagattccctcgtcttcacttaaaagccagagtgcaagtcatgatttgcgggagggctcttgaaccacttctggctgcaccacaattctgtacttgagtatcacagtcattgtttttgagacaaacatttttataattctaatttgggttaataaagattttaaatatt

SEQ ID NO: 109609 - DNA, 4995 bp, Homo sapiens
  Payload ID: 1525
  Gene Symbol: ATAD2
  Gene Name: ATPase family, AAA domain containing 2
  ENST ID: ENST00000517666
  CDS Start-End: 78-272
cggaagagccagagctgcgagcgcctggagctggatctctctccggtcgcgcacgccgaggccagtagggagagaagatggtggttctccgcagcagcttggagctgcacaaccactccgcggcctcggccacgggctccttggacctgtccagtgacttcctcagtctggagcacatcggccggaggcggctccgctcggccggcgcggcgcagaagaaacccgcggcgaccacagccaaagcgggcgcagttggccagacagcaggctgataaaaaaaaagaagagcacagagaagacaaagtgattccagttactcggtcattgagggctagaaacatcgttcaaagtacagaacacttacatgaagataatggtgatgttgaagtgcgtcgaagttgtaggattagaagtcgttatagtggtgtaaaccagtccatgctgtttgacaaacttataactaacactgctgaagctgtacttcaaaaaatggatgacatgaagaagatgcgtagacagcgaatgagagaacttgaagacttgggagtgtttaatgaaacagaagaaagcaatcttaatatgtacacaagaggaaaacagaaagatattcaaagaactgatgaagaaacaactgataatcaagaaggcagtgtggagtcatctgaagagggtgaagaccaagaacatgaagatgatggtgaagatgaagatgatgaagatgatgatgatgatgacgatgatgatgatgatgatgatgatgaagatgatgaagatgaagaagatggagaagaagagaatcagaagcgatattatcttagacagagaaaagctactgtttactatcaggctccattggaaaaacctcgtcaccagagaaagcccaacatattttatagtggcccagcttctcctgcaagaccaagataccgattatcttccgcaggaccaagaagtccttactgtaaacgaatgaacaggcgaaggcatgcaatccacagtagtgactcgacttcatcttcctcctctgaagatgaacagcactttgagaggcggaggaaaaggagtcgtaatagggctatcaataggtgcctcccactaaattttcggaaagatgaattaaaaggcatttataaagatcgaatgaaaattggagcaagccttgccgatgttgatccaatgcaactagattcttcagtacgatttgatagtgttggtggcctgtctaatcatatagcagctctaaaagagatggtggtgtttccattactttatccagaagtctttgaaaaatttaaaattcaacccccaagaggttgtttgttttatgggccacctggaactggaaagactctggttgccagagcacttgccaatgagtgcagtcaaggggataaaagagtagcatttttcatgaggaaaggtgctgattgtctaagtaaatgggtaggagaatctgaaagacagctacgattgctgtttgatcaggcctatcagatgcgcccatcaattattttttttgacgaaattgatggtctggctccagtacggtcaagcaggcaagatcagattcacagttctattgtttccaccctgctagctcttatggatggattggacagcagaggggaaattgtggtcattggtgctacgaacaggctagattctatagatcctgctttacgaaggcctggtcgctttgatagagaattcctctttagcctgcctgataaagaggctcgaaaagagattctaaagattcacaccagggattggaatcccaaaccactggacacatttttagaagagctagcagaaaactgtgttggatactgtggagcagatattaaatcaatatgtgctgaagctgctttatgtgctttacgacgacgctacccacagatctataccactagtgagaaactgcagttggatctctcttcaattaatatctcagctaaggatttcgaggtagctatgcaaaagatgataccagcctcccaaagagctgtgacatcacctgggcaggcactgtccaccgttgtgaaaccactcctgcaaaacactgttgacaagattttagaagccctgcagagagtatttccacatgcagaattcagaacaaataaaacattagactcagatatttcttgtcctctgctagaaagtgacttggcttacagtgatgatgatgttccatcagtttatgaaaatggactttctcagaaatcttctcataaggcaaaagacaattttaattttcttcatttgaatagaaatgcttgttaccaacctatgtcttttcgaccaagaatattgatagtaggagaaccaggatttgggcaaggttctcacttggcaccagctgtcattcatgctttggaaaagtttactgtatatacattagacattcctgttctttttggagttagtactacatcccctgaagaaacatgtgcccaggtgattcgtgaagctaagagaacagcaccaagtatagtgtatgttcctcatatccacgtgtggtgggaaatagttggaccgacacttaaagccacatttaccacattattacagaatattccttcatttgctccagttttactacttgcaacttctgacaaaccccattccgctttgccagaagaggtgcaagaattgtttatccgtgattatggagagatttttaatgtccagttaccggataaagaagaacggacaaaattttttgaagatttaattctaaaacaagctgctaagcctcctatatcaaaaaagaaagcagttttgcaggctttggaggtactcccagtagcaccaccacctgagccaagatcactgacagcagaagaagtgaaacgactagaagaacaagaagaagatacatttagagaactgaggattttcttaagaaatgttacacataggcttgctattgacaagcgattccgagtgtttactaagcctgttgaccctgatgaggttcctgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattcaggaatctagaaagaaaagaggttgtagctcctccaaatatgccccgtcttactaccatgtgatgccaaagcaaaattccactcttgttggtgataaaagatcagacccagagcagaatgaaaagctaaagacaccgagtactcctgtggcttgcagcactcctgaaatgtgtgttctgcgaatgactcgagctagacgttcccaggtagaacagcagcagctcatcactgttgaaaaggctttggcaattctttctcagcctacaccctcacttgttgtggatcatgagcgattaaaaaatcttttgaagactgttgttaaaaaaagtcaaaactacaacatatttcagttggaaaatttgtatgcagtaatcagccaatgtatttatcggcatcgcaaggaccatgataaaacatcacttattcagaaaatggagcaagaggtagaaaacttcagttgttccagatgatgatgtcatggtatcgagtattctttatattcagttcctatttaagtcatttttgtcatgtccgcctaattgatgtagtatgaaaccctgcatctttaaggaaaagattaaaatagtaaaataaaagtatttaaactttcctgatatttatgtacatattaagataaatgtcatgtgtaagataactgataaatattggaactttgctagaacaagaccctgtagtaatagtaataatagttgaagtttggccaactcttaataaagttattttggtaactaatgttttatggcacttaagaataattagcagcgttaaattttgtttgtattaagcacttttaattttatccttcctaaaaatagtttattgtatctgacaagaaacttacttaaccattgtgtccttcccatcttttttgtcatctttgttttcttcaaatgccctcctcccatctgccttgagattccctcgtcttcacttaaaagccagagtgcaagtcatgatttgcgggagggctcttgaaccacttctggctgcaccacaattctgtacttgagtatcacagtcattgtttttgagacaaacatttttataattctaatttgggttaataaagattttaaatatttcttggtttacttttgtaattatatacacaacaaatgtattaataactaccttgttaaacaccttttaatagcacaaggtttttatatttgcaagctgttgatatctttctaaaactgtttaggttatagtctattgatactttttatatacaattttataaatataaatattataattttatattaatggtaccaaaaatacatttcttaaggttaaaagcatgcacttccatgcatacttgcttttggggagagtggggagaagacattctaataatcagtttgtgaaatagcttctgttggaaaccttttgaggggaataaggaatggtcatctaaaatgagagattctggattttaatgcagttcaaagttgagctgtatttttgttgttgatttatctggattttttttaaagccttctaaaacccagtgaattcaataccttaattagtacatactatcttatgtaatgcataaagcaatgccagtcactgagaacatttaaatatatttatattcctggagatacacattctcatttttgttggtttattataaattattcttctagatgcatcttttataactaggatttcattttgtgtgtatagcttatgtaataaattttaaaggtgaaaactctcttaaa

SEQ ID NO: 109610 - DNA, 4650 bp, Homo sapiens
  Payload ID: 1525
  Gene Symbol: ATAD2
  Gene Name: ATPase family, AAA domain containing 2
  ENST ID: ENST00000519124
  CDS Start-End: 23-214
ccgaggccagtagggagagaagatggtggttctccgcagcagcttggagctgcacaaccactccgcggcctcggccacgggctccttggacctgtccagtgacttcctcagtctggagcacatcggccggaggcggctccgctcggccggcgcggcgcagaagaaacccgcggcgaccacagccaaagcgggcgtgagatgggtcatcagttaaggaagttgaaacctaccaccggacacgtgctttaagatctttgagaaaagatgcacagaattcttcagattctagttttgagaagaatgtggaaataacggagcaacttgctaatggcaggcattttacaaggcagttggccagacagcaggctgataaaaaaaaagaagagcacagagaagacaaagtgattccagttactcggtcattgagggctagaaacatcgttcaaagtacagaacacttacatgaagataatggtgatgttgaagtgcgtcgaagttgtaggattagaagtcgttatagtggtgtaaaccagtccatgctgtttgacaaacttataactaacactgctgaagctgtacttcaaaaaatggatgacatgaagaagatgcgtagacagcgaatgagagaacttgaagacttgggagtgtttaatgaaacagaagaaagcaatcttaatatgtacacaagaggaaaacagaaagatattcaaagaactgatgaagaaacaactgataatcaagaaggcagtgtggtcatctgaagagggtgaagaccaagaacatgaagatgatggtgaagatgaagatgatgaagatgatgatgatgatgacgatgatgatgatgatgatgatgatgaagatgatgaagatgaagaagatggagaagaagagaatcagaagcgatattatcttagacagagaaaagctactgtttactatcaggctccattggaaaaacctcgtcaccagagaaagcccaacatattttatagtggcccagcttctcctgcaagaccaagataccgattatcttccgcaggaccaagaagtccttactgtaaacgaatgaacaggcgaaggcatgcaatccacagtagtgactcgacttcatcttcctcctctgaagatgaacagcactttgagaggcggaggaaaaggagtcgtaatagggctatcaataggtgcctcccactaaattttcggaaagatgaattaaaaggcatttataaagatcgaatgaaaattggagcaagccttgccgatgttgatccaatgcaactagattcttcagtacgatttgatagtgttggtggcctgtctaatcatatagcagctctaaaagagatggtggtgtttccattactttatccagaagtctttgaaaaatttaaaattcaacccccaagaggttgtttgttttatgggccacctggaactggaaagactctggttgccagagcacttgccaatgagtgcagtcaaggggataaaagagtagcatttttcatgaggaaaggtgctgattgtctaagtaaatgggtaggagaatctgaaagacagctacgattgctgtttgatcaggcctatcagatgcgcccatcaattattttttttgacgaaattgatggtctggctccagtacggtcaagcaggcaagatcagattcacagttctattgtttccaccctgctagctcttatggatggattggacagcagaggggaaattgtggtcattggtgctacgaacaggctagattctatagatcctgctttacgaaggcctggtcgctttgatagagaattcctctttagcctgcctgataaagaggctcgaaaagagattctaaagattcacaccagggattggaatcccaaaccactggacacatttttagaagagctagcagaaaactgtgttggatactgtggagcagatattaaatcaatatgtgctgaagctgctttatgtgctttacgacgacgctacccacagatctataccactagtgagaaactgcagttggatctctcttcaattaatatctcagctaaggatttcgaggtagctatgcaaaagatgataccagcctcccaaagagctgtgacatcacctgggcaggcactgtccaccgttgtgaaaccactcctgcaaaacactgttgacaagattttagaagccctgcagagagtatttccacatgcagaattcagaacaaataaaacattagactcagatatttcttgtcctctgctagaaagtgacttggcttacagtgatgatgatgttccatcagtttatgaaaatggactttctcagaaatcttctcataaggcaaaagacaattttaattttcttcatttgaatagaaatgcttgttaccaacctatgtcttttcgaccaagaatattgatagtaggagaaccaggatttgggcaaggttctcacttggcaccagctgtcattcatgctttggaaaagtttactgtatatacattagacattcctgttctttttggagttagtactacatcccctgaagaaacatgtgcccaggtgattcgtgaagctaagagaacagcaccaagtatagtgtatgttcctcatatccacgtgtggtgggaaatagttggaccgacacttaaagccacatttaccacattattacagaatattccttcatttgctccagttttactacttgcaacttctgacaaaccccattccgctttgccagaagaggtgcaagaattgtttatccgtgattatggagagatttttaatgtccagttaccggataaagaagaacggacaaaattttttgaagatttaattctaaaacaagctgctaagcctcctatatcaaaaaagaaagcagttttgcaggctttggaggtactcccagtagcaccaccacctgagccaagatcactgacagcagaagaagtgaaacgactagaagaacaagaagaagatacatttagagaactgaggattttcttaagaaatgttacacataggcttgctattgacaagcgattccgagtgtttactaagcctgttgaccctgatgaggttcctgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattcaggaatctagaaagaaaagaggttgtagctcctccaaatatgccccgtcttactaccatgtgatgccaaagcaaaattccactcttgttggtgataaaagatcagacccagagcagaatgaaaagctaaagacaccgagtactcctgtggcttgcagcactcctgctcagttgaagaggaaaattcgcaaaaagtcaaactggtacttaggcaccataaaaaagcgaaggaagatttcacaggcaaaggatgatagccagaatgccatagatcacaaaattgagagtgatacagaggaaactcaagacacaagtgtagatcataatgagaccggaaacacaggagagtcttcggtggaagaaaatgaaaaacagcaaaatgcctctgaaagcaaactggaattgagaaataattcaaatacttgtaatatagagaatgagcttgaagactctaggaagactacagcatgtacagaattgagagacaagattgcttgtaatggagatgcttctagctctcagataatacatatttctgatgaaaatgaaggaaaagaaatgtgtgttctgcgaatgactcgagctagacgttcccaggtagaacagcagcagctcatcactgttgaaaaggctttggcaattctttctcagcctacaccctcacttgttgtggatcatgagcgattaaaaaatcttttgaagactgttgttaaaaaaagtcaaaactacaacatatttcagttggaaaatttgtatgcagtaatcagccaatgtatttatcggcatcgcaaggaccatgataaaacatcacttattcagaaaatggagcaagaggtagaaaacttcagttgttccagatgatgatgtcatggtatcgagtattctttatattcagttcctatttaagtcatttttgtcatgtccgcctaattgatgtagtatgaaaccctgcatctttaaggaaaagattaaaatagtaaaataaaagtatttaaactttcctgatatttatgtacatattaagataaatgtcatgtgtaagataactgataaatattggaactttgctagaacaagaccctgtagtaatagtaataatagttgaagtttggccaactcttaataaagttattttggtaactaatgttttatggcacttaagaataattagcagcgttaaattttgtttgtattaagcacttttaattttatccttcctaaaaatagtttattgtatctgacaagaaacttacttaaccattgtgtccttcccatcttttttgtcatctttgttttcttcaaatgccctcctcc

SEQ ID NO: 109611 - DNA, 8103 bp, Homo sapiens
  Payload ID: 1526
  Gene Symbol: ATAD2B
  Gene Name: ATPase family, AAA domain containing 2B
  Uniprot ID: Q9ULI0
  ENST ID: ENST00000238789
  CDS Start-End: 345-4721
cctgcggcgctggagccttgacgcacggagctcgagagcgagaacgggagagaaaggggtagaaatggcggctccgctcggctcccgctgaggagggcgaagccggcggagtgtctgtgctgccggtctgcagcaccgcccccgcttcccgcacgccgcctgctcacgccgacttcccttcctctgcccggctctctcttgtgctcgtctgcgctccgcacgctccgggccggctcgtctctcattgcccggctcggctccgctggccctgactgaccggccggcgggccggccttgctcggctctcccgggcgcggcgtggactccgtccccctggctggaccatggtgaacacccggaagagctctctccgccttctcgggtccaagtctcctggtcccgggcctgggcctggggccggagcagagcctggggcgaccggaggcagcagccatttcatctcctctcggacccgctcctccaagacccgcgccgccagctgccccgccgccaaagccgggggaagcggtggcgccggcgtcactctggatgaggccaggaaagttgaagttgatggtagtttaagtgatagccacgtatctcctccagccaaacgcactttgaaacaacctgattctgtttgcaaagacaaatcaaaatcacgaagtactggtcagcgagaggaatggaacttatcaactggacaggccaggttaacttctcagcctggtgctacattaccaaatggacatagtggcttatcccttcgaagccatccccttcgaggggaaaagaagggagatggggacctttcttgtataaatggtgacatggaagtcagaaaaagttgtcgttccaggaaaaacagatttgaaagtgtgaaccagagtttgttatttgatcaactagtaaatagcactgctgaagctgtactacaggaaatggacaacattaacatccgacggaatcgtcgatcaggagaagtagaacgacttcgaatgtggacagatacagaatttgaaaacatggatatgtattcaagagtgaaaaggcgaagaaagtcactaagaagaaatagttatgggatacaaaatcatcatgaagtttctactgagggtgaagaagaagaatctcaagaggaggatggagatatagaagttgaagaggcagaaggagaagaaaatgatagaccatataatttgagacagagaaaaacagtggatcgataccaagcacctccaatagtaccagctcatcaaaaaaagagggaaaacacgctgtttgatattcatagatctccagcaagaagaagccatattaggagaaagaagcatgccattcatagtagtgacacaacttcttctgatgaggaacgctttgaaagaaggaaatcaaagagcatggcaagagcaagaaatagatgtttgcctatgaacttcagagcagaggacttagctagcggtattctccgagaacgagtgaaagtgggtgcaagcttggctgatgttgatccaatgaacattgataaatcagtacggtttgatagcataggtggattgagccatcatattcatgcgctaaaggaaatggtagtattcccacttttatatccagaaatttttgaaaagtttaaaattcagcctccaaggggctgtttgttttatggccctcctggcacaggtaaaaccttggttgccagagcattagctaatgaatgcagccaaggagacaaaaaagtggctttttttatgcgaaaaggagcagattgtttgagcaagtgggttggtgaatctgaaaggcaacttaggcttctttttgatcaggcatatttgatgagaccttctataatattttttgatgaaatagatggattagctccagttcgctctagcagacaagatcagatccacagctctatagtatcaaccctccttgctcttatggatggattagataataggggtgaaattgttgttattggtgctacaaacagacttgactctatagatcctgcactcaggagacctggtcgttttgacagagaattcctcttcaacctgcctgatcaaaaggcaagaaaacacatcttacagatccataccagggactggaatccaaaattgtcagatgcatttttaggtgaattggctgaaaaatgtgttggctactgtggagccgatatcaaggccctgtgcactgaagccgccctgattgcactgcggaggcgttatccccagatctatgctagcagtcataaactgcagctggatgtttcctcaatagtgcttagtgcccaagatttttaccatgcaatgcagaatatcgtgcctgcttcccaacgtgctgtgatgtcttcagggcatgcactatcccccatcataagaccactgctggaaagaagcttcaacaacatcctagcagtcttgcaaaaagtgtttcctcatgctgaaattagccagagtgacaaaaaagaagatatagaaactttaattttagaggatagtgaagatgaaaatgctttatcaatttttgagaccaattgtcactcaggatcaccaaagaaacagtcatcatctgctgctatacataaaccctaccttcattttacaatgtcaccatatcatcagccaacctcttacaggccacgcttattgctctctggagaacggggctcaggtcaaacttctcaccttgctccagcacttttgcacactctagaaagattctctgtgcatagactagatctcccagcactttattcagttagtgccaaaacacctgaggaatcatgtgcacagatttttcgtgaagctcgaagaacagtacctagtattgtttacatgcctcacattggggattggtgggaagctgtcagtgaaactgtgagagcaacttttctgacattgctacaagatataccatcattttcacctatatttttattgtctacctctgaaaccatgtacagtgaactgcctgaagaggttaaatgtatctttagaatacagtatgaagaggtcttgtatattcaaaggcctattgaagaagacagaagaaaattttttcaagaattgattctcaatcaggcatcaatggctccaccacgaaggaaacatgctgctctttgtgctatggaagtgcttcctcttgcactaccttctccacctcgtcaattatcagaatcagaaaaaagtcgaatggaggaccaggaggaaaatactttaagagagttgcggttgtttctcagggatgtaaccaagaggctggccacagataaacgctttaacatcttcagcaaaccggtggatattgaagaggtttcagattatcttgaagtaatcaaggaaccaatggacttatcaacagtaataactaaaattgataaacataattacctgactgcaaaggatttcctgaaagatattgacctcatctgtagcaatgctttagagtataatccagataaggacccaggagataaaataattaggcacagggcttgtaccctgaaggacactgcacatgctatcattgcagctgaattagatccagaatttaataaactttgtgaggaaattaaggaagcaagaataaaaagaggcttatcagtaacatcagaacaaataaatcctcatagtactggagctcggaagacagaaactagagtcgaagaggcatttcggcacaaacaaagaaatccaatggatgtgtggcacaactctgcaaataaatgtgcatttcgggttcggagaaaatcaaggcggagatcacagtggggtaaaggaattattaagaaaaggaaagttaataatttaaaaaaagatgaagaagacaccaaatttgcagactatgagaaccatacggaggacaggaaattattagagaatggagagtttgaggtaagcactgactgccatgaggaaaatggagaagagactggagacttatctatgaccaatgatgaatcatcctgtgacatcatggacttggaccaggggcagaggcttaacaatggagcaggcacaaaagagaactttgcatctactgaggaggaaagttcaaatgaatctctactggtcaacagcagcagttccttaaacccggagcagacctccaggaaagagactttccttaaaggaaattgtctaaatggtgaggcttccactgacagttttgaaggaataccagttctggaatgtcagaatggcaagcttgaagtagtttctttctgtgatagtggagataaatgtagttctgaacaaaagattcttctggaggaccagtcaaaagaaaaaccagaaacttcgactgaaaatcatggagatgatcttgagaaactagaggcactggaatgtagcaataatgagaagttagaacctggctctgatgtggaggttaaagatgcagaactggataaagaaggtgcttctaaagtaaagaaataccgtaaattaattttagagcaggcaaaaacgacaagcctggaactggttccagaagagccatctgagcctgtgcctcctcttatagttgatcgtgagagattgaagaaattgcttgatttgttggtggataaaagcaacaatctggcagttgatcagcttgagagattatattctcttcttagtcagtgtatctaccgtcatcgtaaagattatgacaaatcacaacttgtagaggagatggaaagaacagttcatatgtttgagacattcctatgaacttttcaagatgagtggtttatcctctccaatctgctcctcacagagcagtcttctgagccattcaatttcaaattgcaccaattatgtgcagagccttggtgtaaagtgctctctcactcattctttctctctgttgaatttggtgctattgtctcaggtacctgaaaccaaccagcctacaagaaccaaacagaacttcagaaacatgttgtattttccacaaataaaaaatacaaccccacagcttggagattttggtgctacagaaactgctctcgcttctgctcctctttttgtgcactctcttttggagactcctctcttagggagcagaccagcaaacaggaggaaactggatgggggcagttctaactgtgttgaattgtttaaacagtgggcaacttgttatttttttttcctccattttacccctttaatcatatttttcccccatctgggtaatggactgaaacctgttttagagttggctatggtctgttctggtgggaagctgaagaaactggatgaaattaggtcaggctctttagaactgcctttaacgtgcctttttattcatttgaggaagataaggctaaaaggatgggctgtttgaagcaaataaattagaaatatttctttggtcacaaccttgaaaataagttttgatactctatgtcattaagagacaaccagtgtttgggtatgaaatgcctgtcttattctcaaagctcaatcaagacacccagtaagccacataatatactaaaatggtaagttttcttgtaaggtctgttttggtttaagaaacatgaataacaacaaagaataatacacagtccacacacaaaaaaacaaaaaacaaaactgcacacgttttggtattgccaacaatgatgactagaaaataaatagatagtggccattttttcttctgtcagtggcaatttaatagttattcatgtttgagttcccagagaaaaatggttttcatatgtagtaaattgttgttttgttttaaagccaggacttgccaaatggacagaaaagagaggaattcatcagaagctccataaaattcattttctgtatgcttaattgcaaacgagctctggtatggtccttgaataacagtattaatgtttaaatcccatctcctaagcttaccttcacaactcttctttttgattggaaaccattttgaatcttgttgagtgatttctgtgaattgtatgtatctgaaattaattatgggttactagttttacaaaaactttctacaaatttggagacacagtctaggcagttgcaatgaggcaaaggatgcagtgactttttttatcagatgatttttaaacaaaaagaaaattttgccagcaagttggcttggtatcttcattcattgtagccgttagctgcaggtgtgtctttccaatatatgcaacacatgtagtttgggttttaattagggcgaatggtcttggactactgcagagattctgagctacctcagctttttgtattttagttaccaacagtgtttacagagtcttgtaatcactttgccaccgtttacatcctgaagctaaggtacttgtctccttgtctttggctctttgtagtgtgcagaaagcatactttggccatagcctactgcagtaatccaaagtgcttctttgcatttacatttacatctaacgccttctaattctagcttaatttttttttaaatgccacgtgttttctttgtacctagtctgtgaagtttctgtaatatccagttagtcatacaagtcaagatgctacccatgtagacacactgtatttttaaggtgggcaagtgcgattaacgatgaaccattttaaaggggaggttatttgaaacctctaatttgattattgggaggattttcatgctttctttagtatttattaccatcataccgattcaaactattttattgtctaatacattagcattttgtattttgatggaaattgttacagaatttaaagatttgatgaaataagatgtagcagattttttgtagcaagtttctggtaaaagggttttttgcaagtctcaggttcttgctgcactatttttttttaaatatttattccagttattctaattcagaagcattcttttcaagtaacagcagcacttgtgaaaggaaaaaaaaatgcacatgtttcttagtaggttactaaatttgtacaattaattaagattttagccatcagtgagtttgaaaagggaaatgtatttattttcagcattaaaatgcttccaaaagatcaagttgcttttgtttgtttgtttttttaaccgtaatgtagatggagaaattggaggcaacctcagtataggaactgccactttgaacagtttaggtcttaaagagaaagtcaatctaatgccaaggggagaacaatgagctgaaattgtaccaactcctctggccctccttccctcaattaaaaaaacacacttaccagttttgcttattttacagatatctggtggttctatagtttaaagcagcttgtgaaattaaaaaagtggactcaattttgtttacctttctgtaagtttttcatttttgctgtatagcattggcaaaaatatgtacaaattgacctctgttcttatttcctattgtgagcattataaagataagctcctatgtaaaaccttgctctcagatgagtaaaatatgtatcacagcatagctcagcaataattcatgctcagctgtggggaccctgggggctttttgaagatgatggaaccgcactagggttgaaactgatggctgtggagttaattgtgttttcgagcttgaatctcacctgtgattttttttttttaatgttgtttcatgacttgatttttctcataagccaatgtatttgtaggtttactggattttatttttagggagtgggtaatttcttcccttttttgattaagttggttcagctatggtgctattcagtaggtatcttcagtgtcaggtcccgtagctgaatgccattgttattataattattatttgtaatcacattgtaagcttgaatttgggcttgtacctgcatcttttgtattctgtacatctggttacttagactttgggagtccaatttggtttcagtcatgtatgtctactttgtagtttaagtagacttcatcaactatggtctattttgggtttgtagttttaatttagaattgtgttaaattgatgttttgcatttgacttcatttgacattagttgaagtaaattatttaatttttgaattctggaatttgaacatttactgtaatttgtaatataactgctgtgaaatacttgaataaagatgacaagaaaaaca

SEQ ID NO: 109612 - DNA, 5579 bp, Homo sapiens
  Payload ID: 1526
  Gene Symbol: ATAD2B
  Gene Name: ATPase family, AAA domain containing 2B
  ENST ID: ENST00000381024
  CDS Start-End: 1-2204
gtgaagatgaaaatgctttatcaatttttgagaccaattgtcactcaggatcaccaaagaaacagtcatcatctgctgctatacataaaccctaccttcattttacaatgtcaccatatcatcagccaacctcttacaggccacgcttattgctctctggagaacggggctcaggtcaaacttctcaccttgctccagcacttttgcacactctagaaagattctctgtgcatagactagatctcccagcactttattcagttagtgccaaaacacctgaggaatcatgtgcacagatttttcgtgaagctcgaagaacagtacctagtattgtttacatgcctcacattggggattggtgggaagctgtcagtgaaactgtgagagcaacttttctgacattgctacaagatataccatcattttcacctatatttttattgtctacctctgaaaccatgtacagtgaactgcctgaagaggttaaatgtatctttagaatacagtatgaagaggtcttgtatattcaaaggcctattgaagaagacagaagaaaattttttcaagaattgattctcaatcaggcatcaatggctccaccacgaaggaaacatgctgctctttgtgctatggaagtgcttcctcttgcactaccttctccacctcgtcaattatcagaatcagaaaaaagtcgaatggaggaccaggaggaaaatactttaagagagttgcggttgtttctcagggatgtaaccaagaggctggccacagataaacgctttaacatcttcagcaaaccggtttcagattatcttgaagtaatcaaggaaccaatggacttatcaacagtaataactaaaattgataaacataattacctgactgcaaaggatttcctgaaagatattgacctcatctgtagcaatgctttagagtataatccagataaggacccaggagataaaataattaggcacagggcttgtaccctgaaggacactgcacatgctatcattgcagctgaattagatccagaatttaataaactttgtgaggaaattaaggaagcaagaataaaaagaggcttatcagtaacatcagaacaaataaatcctcatagtactggagctcggaagacagaaactagagtcgaagaggcatttcggcacaaacaaagaaatccaatggatgtgtggcacaactctgcaaataaatgtgcatttcgggttcggagaaaatcaaggcggagatcacagtggggtaaaggaattattaagaaaaggaaagttaataatttaaaaaaagatgaagaagacaccaaatttgcagactatgagaaccatacggaggacaggaaattattagagaatggagagtttgaggtaagcactgactgccatgaggaaaatggagaagagactggagacttatctatgaccaatgatgaatcatcctgtgacatcatggacttggaccaggggcagaggcttaacaatggagcaggcacaaaagagaactttgcatctactgaggaggaaagttcaaatgaatctctactggtcaacagcagcagttccttaaacccggagcagacctccaggaaagagactttccttaaaggaaattgtctaaatggtgaggcttccactgacagttttgaaggaataccagttctggaatgtcagaatggcaagcttgaagtagtttctttctgtgatagtggagataaatgtagttctgaacaaaagattcttctggaggaccagtcaaaagaaaaaccagaaacttcgactgaaaatcatggagatgatcttgagaaactagaggcactggaatgtagcaataatgagaagttagaacctggctctgatgtggaggttaaagatgcagaactggataaagaaggtgcttctaaagtaaagaaataccgtaaattaattttagagcaggcaaaaacgacaagcctggaactggttccagaagagccatctgagcctgtgcctcctcttatagttgatcgtgagagattgaagaaattgcttgatttgttggtggataaaagcaacaatctggcagttgatcagcttgagagattatattctcttcttagtcagtgtatctaccgtcatcgtaaagattatgacaaatcacaacttgtagaggagatggaaagaacagttcatatgtttgagacattcctatgaacttttcaagatgagtggtttatcctctccaatctgctcctcacagagcagtcttctgagccattcaatttcaaattgcaccaattatgtgcagagccttggtgtaaagtgctctctcactcattctttctctctgttgaatttggtgctattgtctcaggtacctgaaaccaaccagcctacaagaaccaaacagaacttcagaaacatgttgtattttccacaaataaaaaatacaaccccacagcttggagattttggtgctacagaaactgctctcgcttctgctcctctttttgtgcactctcttttggagactcctctcttagggagcagaccagcaaacaggaggaaactggatgggggcagttctaactgtgttgaattgtttaaacagtgggcaacttgttatttttttttcctccattttacccctttaatcatatttttcccccatctgggtaatggactgaaacctgttttagagttggctatggtctgttctggtgggaagctgaagaaactggatgaaattaggtcaggctctttagaactgcctttaacgtgcctttttattcatttgaggaagataaggctaaaaggatgggctgtttgaagcaaataaattagaaatatttctttggtcacaaccttgaaaataagttttgatactctatgtcattaagagacaaccagtgtttgggtatgaaatgcctgtcttattctcaaagctcaatcaagacacccagtaagccacataatatactaaaatggtaagttttcttgtaaggtctgttttggtttaagaaacatgaataacaacaaagaataatacacagtccacacacaaaaaaacaaaaaacaaaactgcacacgttttggtattgccaacaatgatgactagaaaataaatagatagtggccattttttcttctgtcagtggcaatttaatagttattcatgtttgagttcccagagaaaaatggttttcatatgtagtaaattgttgttttgttttaaagccaggacttgccaaatggacagaaaagagaggaattcatcagaagctccataaaattcattttctgtatgcttaattgcaaacgagctctggtatggtccttgaataacagtattaatgtttaaatcccatctcctaagcttaccttcacaactcttctttttgattggaaaccattttgaatcttgttgagtgatttctgtgaattgtatgtatctgaaattaattatgggttactagttttacaaaaactttctacaaatttggagacacagtctaggcagttgcaatgaggcaaaggatgcagtgactttttttatcagatgatttttaaacaaaaagaaaattttgccagcaagttggcttggtatcttcattcattgtagccgttagctgcaggtgtgtctttccaatatatgcaacacatgtagtttgggttttaattagggcgaatggtcttggactactgcagagattctgagctacctcagctttttgtattttagttaccaacagtgtttacagagtcttgtaatcactttgccaccgtttacatcctgaagctaaggtacttgtctccttgtctttggctctttgtagtgtgcagaaagcatactttggccatagcctactgcagtaatccaaagtgcttctttgcatttacatttacatctaacgccttctaattctagcttaatttttttttaaatgccacgtgttttctttgtacctagtctgtgaagtttctgtaatatccagttagtcatacaagtcaagatgctacccatgtagacacactgtatttttaaggtgggcaagtgcgattaacgatgaaccattttaaaggggaggttatttgaaacctctaatttgattattgggaggattttcatgctttctttagtatttattaccatcataccgattcaaactattttattgtctaatacattagcattttgtattttgatggaaattgttacagaatttaaagatttgatgaaataagatgtagcagattttttgtagcaagtttctggtaaaagggttttttgcaagtctcaggttcttgctgcactatttttttttaaatatttattccagttattctaattcagaagcattcttttcaagtaacagcagcacttgtgaaaggaaaaaaaaatgcacatgtttcttagtaggttactaaatttgtacaattaattaagattttagccatcagtgagtttgaaaagggaaatgtatttattttcagcattaaaatgcttccaaaagatcaagttgcttttgtttgtttgtttttttaaccgtaatgtagatggagaaattggaggcaacctcagtataggaactgccactttgaacagtttaggtcttaaagagaaagtcaatctaatgccaaggggagaacaatgagctgaaattgtaccaactcctctggccctccttccctcaattaaaaaaacacacttaccagttttgcttattttacagatatctggtggttctatagtttaaagcagcttgtgaaattaaaaaagtggactcaattttgtttacctttctgtaagtttttcatttttgctgtatagcattggcaaaaatatgtacaaattgacctctgttcttatttcctattgtgagcattataaagataagctcctatgtaaaaccttgctctcagatgagtaaaatatgtatcacagcatagctcagcaataattcatgctcagctgtggggaccctgggggctttttgaagatgatggaaccgcactagggttgaaactgatggctgtggagttaattgtgttttcgagcttgaatctcacctgtgattttttttttttaatgttgtttcatgacttgatttttctcataagccaatgtatttgtaggtttactggattttatttttagggagtgggtaatttcttcccttttttgattaagttggttcagctatggtgctattcagtaggtatcttcagtgtcaggtcccgtagctgaatgccattgttattataattattatttgtaatcacattgtaagcttgaatttgggcttgtacctgcatcttttgtattctgtacatctggttacttagactttgggagtccaatttggtttcagtcatgtatgtctactttgtagtttaagtagacttcatcaactatggtctattttgggtttgtagttttaatttagaattgtgttaaattgatgttttgcatttgacttcatttgacattagttgaagtaaattatttaatttttgaattctggaatttgaacatttactgtaatttgtaatataactgctgtgaaatacttgaataaagatgacaag

SEQ ID NO: 109613 - DNA, 554 bp, Homo sapiens
  Payload ID: 1526
  Gene Symbol: ATAD2B
  Gene Name: ATPase family, AAA domain containing 2B
  ENST ID: ENST00000458510
  CDS Start-End: 363-554
aaacgttctattttggcattgttcttcgagcagcgtgcattttggtagacactagccgtatgtggctattgagcacttaaaatgtggctagtgtaactaaagaactgcattttaaattttatttagtcttagttaatttaaaatttaaataaaatggcattatgtggctcatggcttactatattgcacagcatggatcttgaacatcgttttccacattaactttccctttctaacatttcgaggaaacagttttgtgagactgaaatctaagtcattcttctcaagcctgggtctgtggaaaggcctatgctggctgtttacctttttcccttaaatagtttttaaggtcccgagactagatgagattaccaagtcttctctcttacagagcagtcagtaaggcaagaaaacacatcttacagatccataccagggactggaatccaaaattgtcagatgcatttttaggtgaattggctgaaaaatgtgttggctactgtggagccgatatcaaggccctgtgcactgaagccgccctgattgcactgcgg

SEQ ID NO: 109614 - DNA, 1406 bp, Homo sapiens
  Payload ID: 1526
  Gene Symbol: ATAD2B
  Gene Name: ATPase family, AAA domain containing 2B
  ENST ID: ENST00000439915
  CDS Start-End: 296-1406
gagaaaggggtagaaatggcggctccgctcggctcccgctgaggagggcgaagccggcggagtgtctgtgctgccggtctgcagcaccgcccccgcttcccgcacgccgcctgctcacgccgacttcccttcctctgcccggctctctcttgtgctcgtctgcgctccgcacgctccgggccggctcgtctctcattgcccggctcggctccgctggccctgactgaccggccggcgggccggccttgctcggctctcccgggcgcggcgtggactccgtccccctggctggaccatggtgaacacccggaagagctctctccgccttctcgggtccaagtctcctggtcccgggcctgggcctggggccggagcagagcctggggcgaccggaggcagcagccatttcatctcctctcggacccgctcctccaagacccgcgccgccagctgccccgccgccaaagccgggggaagcggtggcgccggcgtcactctggatgaggccaggaaagttgaagttgatggtagtttaagtgatagccacgtatctcctccagccaaacgcactttgaaacaacctgattctgtttgcaaagacaaatcaaaatcacgaagtactggtcagcgagaggaatggaacttatcaactggacaggccaggttaacttctcagcctggtgctacattaccaaatggacatagtggcttatcccttcgaagccatccccttcgaggggaaaagaagggagatggggacctttcttgtataaatggtgacatggaagtcagaaaaagttgtcgttccaggaaaaacagatttgaaagtgtgaaccagagtttgttatttgatcaactagtaaatagcactgctgaagctgtactacaggaaatggacaacattaacatccgacggaatcgtcgatcaggagaagtagaacgacttcgaatgtggacagatacagaatttgaaaacatggatatgtattcaagagtgaaaaggcgaagaaagtcactaagaagaaatagttatgggatacaaaatcatcatgaagtttctactgagggtgaagaagaagctagaacctctaaattgcttcctttggagaaaatcagtatagaatctcaagaggaggatggagatatagaagttgaagaggcagaaggagaagaaaatgatagaccatataatttgagacagagaaaaacagtggatcgataccaagcacctccaatagtaccagctcatcaaaaaaagagggaaaacacgctgtttgatattcatagatctccagcaagaagaagccatattaggagaaagaagcatgccattcatagtagtgacacaacttcttctgatgaggaacgctttgaaagaaggaaatcaaagagcatggcaagagcaa

SEQ ID NO: 109615 - DNA, 2330 bp, Homo sapiens
  Payload ID: 1527
  Gene Symbol: ATAD3A
  Gene Name: ATPase family, AAA domain containing 3A
  ENST ID: ENST00000339113
  CDS Start-End: 1-1717
gggagccctggcccttgccgctcctcgccgctgtcggcagccacttcccgggcgagactgcgcccccggagcacccccggccggagccgtgtcgcgtgccgggaggatcggactctttccgtcacccgtttgcacctctgcagctgtcaggagcgggtcaggttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcggccgagcaccgtcagaccgtcttggagtccatcaggacggctggcaccttgtttggggaaggattccgtgcctttgtgacagactgggacaaagtgacagccacggtggctgggctgacgctgctggctgttggggtctactcagccaagaatgccacgcttgtcgccggccgcttcatcgaggctcggctggggaagccgtccctagtgagggagacgtcccgcatcacggtgcttgaggcgctgcggcaccccatccaggtcagccggcggctcctcagtcgaccccaggacgcgctggagggtgttgtgctcagtcccagcctggaagcacgggtgcgcgacatcgccatagcaacaaggaacaccaagaagaaccgcagcctgtacaggaacatcctgatgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccaccgagaagataagcgaggacctcagggccacactgaacgccttcctgtaccgcacgggccagcacagcaacaagttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcctccgaggacggggtcctgaccgaggccatgatggacacccgcgtgcaagatgctgtccagcagcaccagcagaagatgtgctggctgaaggcggaagggcctgggcgtggggacgagccctccccatcctgagtccacagggagatccacagctcacggagcctggccgcggacccctcccacccctgccttgccggcccctgcacatttaggatatgctcctgggtggggactgggctgtgcccagggcctctgtcccccaggatgtcttgtggtgcgggtcggccgttctgccccccagggcaccccctgttgtaggcactggctagggaggggcaggcctccttcctgcccctcgagacactcttgggagatgcattttccgtctggctcacagggggagggtgaggctttgcaccccagcccctgcccaggccactgtgagggtgggtgctggctgagcccccggggcagcaggagccaggcaggtgatgtctttgttctcggctcccacagcagagccaggtgagggggcgcctgccagggccagacccaggtggggcagcctgaaccctgcttccccctgtggccggcatgccccgatctttcacacactggtgaccctgagagaggagggaggagggaacctggcgggggtgtctgaggccgcactgtcagctggccggtccaagcctgtggctggagctggggtctgtttacctaataaagtcccacaggtgcctca

SEQ ID NO: 109616 - DNA, 2612 bp, Homo sapiens
  Payload ID: 1527
  Gene Symbol: ATAD3A
  Gene Name: ATPase family, AAA domain containing 3A
  Uniprot ID: Q9NVI7
  ENST ID: ENST00000378755
  CDS Start-End: 95-1999
accggctcgcggcgcgtggaggctgctcccagccgcgcgcgagtcagactcgggtgggggtcccggcggcggtagcggcggcggcggtgcgagcatgtcgtggctcttcggcattaacaagggccccaagggtgaaggcgcggggccgccgccgcctttgccgcccgcgcagcccggggccgagggcggcggggaccgcgggttgggagaccggccggcgcccaaggacaaatggagcaacttcgaccccaccggcctggagcgcgccgccaaggcggcgcgcgagctggagcactcgcgttatgccaaggacgccctgaatctggcacagatgcaggagcagacgctgcagttggagcaacagtccaagctcaaaatgcggctggaagccctgagcctgctgcacacactagtctgggcatggagtctctgccgtgccggagccgtgcagacacaggagcggctgtcaggcagtgccagccctgagcaagtgccagctggtgagtgctgtgctctgcaggagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcggccgagcaccgtcagaccgtcttggagtccatcaggacggctggcaccttgtttggggaaggattccgtgcctttgtgacagactgggacaaagtgacagccacggtggctgggctgacgctgctggctgttggggtctactcagccaagaatgccacgcttgtcgccggccgcttcatcgaggctcggctggggaagccgtccctagtgagggagacgtcccgcatcacggtgcttgaggcgctgcggcaccccatccaggtcagccggcggctcctcagtcgaccccaggacgcgctggagggtgttgtgctcagtcccagcctggaagcacgggtgcgcgacatcgccatagcaacaaggaacaccaagaagaaccgcagcctgtacaggaacatcctgatgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccaccgagaagataagcgaggacctcagggccacactgaacgccttcctgtaccgcacgggccagcacagcaacaagttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcctccgaggacggggtcctgaccgaggccatgatggacacccgcgtgcaagatgctgtccagcagcaccagcagaagatgtgctggctgaaggcggaagggcctgggcgtggggacgagccctccccatcctgagtccacagggagatccacagctcacggagcctggccgcggacccctcccacccctgccttgccggcccctgcacatttaggatatgctcctgggtggggactgggctgtgcccagggcctctgtcccccaggatgtcttgtggtgcgggtcggccgttctgccccccagggcaccccctgttgtaggcactggctagggaggggcaggcctccttcctgcccctcgagacactcttgggagatgcattttccgtctggctcacagggggagggtgaggctttgcaccccagcccctgcccaggccactgtgagggtgggtgctggctgagcccccggggcagcaggagccaggcaggtgatgtctttgttctcggctcccacagcagagccaggtgagggggcgcctgccagggccagacccaggtggggcagcctgaaccctgcttccccctgtggccggcatgccccgatctttcacacactggtgaccctgagagaggagggaggagggaacctggcgggggtgtctgaggccgcactgtcagctggccggtccaagcctgtggctggagctggggtctgtttacctaataaagtcccacaggtgcctca

SEQ ID NO: 109617 - DNA, 2492 bp, Homo sapiens
  Payload ID: 1527
  Gene Symbol: ATAD3A
  Gene Name: ATPase family, AAA domain containing 3A
  Uniprot ID: Q9NVI7
  ENST ID: ENST00000378756
  CDS Start-End: 119-1879
ggcgcctgcgcagtggcggtgaccaccggctcgcggcgcgtggaggctgctcccagccgcgcgcgagtcagactcgggtgggggtcccggcggcggtagcggcggcggcggtgcgagcatgtcgtggctcttcggcattaacaagggccccaagggtgaaggcgcggggccgccgccgcctttgccgcccgcgcagcccggggccgagggcggcggggaccgcgggttgggagaccggccggcgcccaaggacaaatggagcaacttcgaccccaccggcctggagcgcgccgccaaggcggcgcgcgagctggagcactcgcgttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcggccgagcaccgtcagaccgtcttggagtccatcaggacggctggcaccttgtttggggaaggattccgtgcctttgtgacagactgggacaaagtgacagccacggtggctgggctgacgctgctggctgttggggtctactcagccaagaatgccacgcttgtcgccggccgcttcatcgaggctcggctggggaagccgtccctagtgagggagacgtcccgcatcacggtgcttgaggcgctgcggcaccccatccaggtcagccggcggctcctcagtcgaccccaggacgcgctggagggtgttgtgctcagtcccagcctggaagcacgggtgcgcgacatcgccatagcaacaaggaacaccaagaagaaccgcagcctgtacaggaacatcctgatgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccaccgagaagataagcgaggacctcagggccacactgaacgccttcctgtaccgcacgggccagcacagcaacaagttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcctccgaggacggggtcctgaccgaggccatgatggacacccgcgtgcaagatgctgtccagcagcaccagcagaagatgtgctggctgaaggcggaagggcctgggcgtggggacgagccctccccatcctgagtccacagggagatccacagctcacggagcctggccgcggacccctcccacccctgccttgccggcccctgcacatttaggatatgctcctgggtggggactgggctgtgcccagggcctctgtcccccaggatgtcttgtggtgcgggtcggccgttctgccccccagggcaccccctgttgtaggcactggctagggaggggcaggcctccttcctgcccctcgagacactcttgggagatgcattttccgtctggctcacagggggagggtgaggctttgcaccccagcccctgcccaggccactgtgagggtgggtgctggctgagcccccggggcagcaggagccaggcaggtgatgtctttgttctcggctcccacagcagagccaggtgagggggcgcctgccagggccagacccaggtggggcagcctgaaccctgcttccccctgtggccggcatgccccgatctttcacacactggtgaccctgagagaggagggaggagggaacctggcgggggtgtctgaggccgcactgtcagctggccggtccaagcctgtggctggagctggggtctgtttacctaataaagtcccacaggtgcctca

SEQ ID NO: 109618 - DNA, 603 bp, Homo sapiens
  Payload ID: 1527
  Gene Symbol: ATAD3A
  Gene Name: ATPase family, AAA domain containing 3A
  ENST ID: ENST00000400830
  CDS Start-End: 1-603
aaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccaccgagaagataagcgaggacctcagggccacactgaacgccttcctgtaccgcacgggccagcacagcaacaaccccagtcacgtgtcacacggaggatcaagtcctgctggtcggccgtggctgactcctcaggcacgttgggctcccaggttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcag

SEQ ID NO: 109619 - DNA, 2332 bp, Homo sapiens
  Payload ID: 1527
  Gene Symbol: ATAD3A
  Gene Name: ATPase family, AAA domain containing 3A
  Uniprot ID: Q9NVI7
  ENST ID: ENST00000536055
  CDS Start-End: 194-1717
gggagccctggcccttgccgctcctcgccgctgtcggcagccacttcccgggcgagactgcgcccccggagcacccccggccggagccgtgtcgcgtgccgggaggatcggactctttccgtcacccgtttgcacctctgcagctgtcaggagcgggtcaggttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcggccgagcaccgtcagaccgtcttggagtccatcaggacggctggcaccttgtttggggaaggattccgtgcctttgtgacagactgggacaaagtgacagccacggtggctgggctgacgctgctggctgttggggtctactcagccaagaatgccacgcttgtcgccggccgcttcatcgaggctcggctggggaagccgtccctagtgagggagacgtcccgcatcacggtgcttgaggcgctgcggcaccccatccaggtcagccggcggctcctcagtcgaccccaggacgcgctggagggtgttgtgctcagtcccagcctggaagcacgggtgcgcgacatcgccatagcaacaaggaacaccaagaagaaccgcagcctgtacaggaacatcctgatgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccaccgagaagataagcgaggacctcagggccacactgaacgccttcctgtaccgcacgggccagcacagcaacaagttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcctccgaggacggggtcctgaccgaggccatgatggacacccgcgtgcaagatgctgtccagcagcaccagcagaagatgtgctggctgaaggcggaagggcctgggcgtggggacgagccctccccatcctgagtccacagggagatccacagctcacggagcctggccgcggacccctcccacccctgccttgccggcccctgcacatttaggatatgctcctgggtggggactgggctgtgcccagggcctctgtcccccaggatgtcttgtggtgcgggtcggccgttctgccccccagggcaccccctgttgtaggcactggctagggaggggcaggcctccttcctgcccctcgagacactcttgggagatgcattttccgtctggctcacagggggagggtgaggctttgcaccccagcccctgcccaggccactgtgagggtgggtgctggctgagcccccggggcagcaggagccaggcaggtgatgtctttgttctcggctcccacagcagagccaggtgagggggcgcctgccagggccagacccaggtggggcagcctgaaccctgcttccccctgtggccggcatgccccgatctttcacacactggtgaccctgagagaggagggaggagggaacctggcgggggtgtctgaggccgcactgtcagctggccggtccaagcctgtggctggagctggggtctgtttacctaataaagtcccacaggtgcctcatt

SEQ ID NO: 109620 - DNA, 2448 bp, Homo sapiens
  Payload ID: 1528
  Gene Symbol: ATAD3B
  Gene Name: ATPase family, AAA domain containing 3B
  Uniprot ID: Q5T9A4
  ENST ID: ENST00000308647
  CDS Start-End: 117-2063
cgcctgcgcagtggtcctggccaccggctcgcggcgcgtggaggctgctcccagccgcgcccgagtcagactcgggtgggggtcccggcggcggtagcggcggcggcggtgcgagcatgtcgtggctcttcggcgttaacaagggccccaagggtgaaggcgcggggccgccgccgcctttgccgcccgcgcagcccggggccgagggcggcggggaccgcggtttgggagaccggccggcgcccaaggacaaatggagcaacttcgaccccaccggcctggagcgcgccgccaaggcggcgcgcgagctggagcactcgcgttacgccaaggaggccctgaatctggcgcagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggagaccgaggcccgggcgcgcgccaaggccgagcgggagaatgcagacatcatccgcgagcagatccgcctgaaggcgtccgagcaccgtcagaccgtcttggagtccatcaggacggctggcaccttgtttggggaaggattccgtgcctttgtgacagaccgggacaaagtgacagccacggtggctgggctgacgctgctggctgtcggggtctactcagccaagaatgcgacagccgtcactggccgcttcatcgaggctcggctggggaagccgtccctagtgagggagacgtcccgcatcacggtgctggaggcgctgcggcaccccatccaggtcagccggcggctcctcagtcgaccccaggacgtgctggagggtgttgtgcttagtcccagcctggaagcacgggtgcgcgacatcgccatagcaaccaggaacaccaagaagaaccggggcctgtacaggcacatcctgctgtatgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctcttcatggatgaagcagacgccttccttcggaagcgagccactgaggagataagcaaggacctcagagccacactgaacgccttcctgtaccacatgggccaacacagcaacaaattcatgctggtcctggccagcaatctgcctgagcagttcgactgtgccatcaacagccgcattgacgtgatggtccacttcgacctgccgcagcaggaggagcgggagcgcctggtgagactgcattttgacaactgtgttcttaagccggccacagaaggaaaacggcgcctgaagctggcccagtttgactacgggaggaagtgctcggaggtcgctcggctgacggagggcatgtcgggccgggagatcgctcagctggccgtgtcctggcaggccacggcatatgcctccaaggacggggtcctcactgaggccatgatggacgcctgtgtgcaagatgctgtccagcagtaccgacagaagatgcgctggctgaaggcggaggggcctgggcgcggggtcgagcaccccctatccggagtccaaggcgagaccctcacctcatggagcctggccacggacccctcctacccctgccttgccggcccctgcacatttaggatatgctcctggatggggactgggctgtgcccagggcctctgtcccccaggatgtcttgtggtggcggtcggccgttctgccccccagggcaccccctgttgtaggcactggctagggaggggcaggcctccttcctgcccctcgagacactcttgggagatgcattttccgtctggctcacagggggagggtgaggctttgtaccccagcccctgcccaggccactgtgagggtgggtgctggctgagcccctggggcagaaggagtggggcaggcggggtctttgttctcggctcccacagcagagccaggtgagggggggcctgccaggactagacagaagtggggcggcctgaaccctgcttccagccatggccaggggccacggaacccggcaggggtgtctgaggccgccctgtcagctggccggtccaagcctgtggctggagctggtgtgtgtttatctaataaagtcccacaggtgcctca

SEQ ID NO: 109621 - DNA, 3859 bp, Homo sapiens
  Payload ID: 1529
  Gene Symbol: ATAD3C
  Gene Name: ATPase family, AAA domain containing 3C
  Uniprot ID: Q5T2N8
  ENST ID: ENST00000378785
  CDS Start-End: 996-2231
cttcatgattaactccccaaggtcctgcatattttctcaatgggccaccgcgcccggccagaagatttttatggtaaaattttgtgatgggaaaactcatcccggaaaatgttgagacctgatgctgagtcctcagcagctcagagaatacgtacttctgtcccaggtcacccaaacattgacctgtgtcggttccccactaggaacaaaatgtaactgaggacgttgtcagatgcttgtcctcgtcaccctgagcttgttggctgctatctaattcttattctttcattttcttgcccgcacgttcttgatagcagatcactgacaacagccattggaagcttaggaaaagggtatgtgccgggcgcggtggctcacacctgtaatcccagcactttgggaggctgaggtgggcggatcacgaggtcaggagatcgagaccatcctggctaacacggtgaaaccgtctctactaaaactacaaaaattagccgggtgtggtggcggtcgcctgtagtcccagctactcgggaggctgaggcaggagagtgacgtgaacccgagaggtagagcttgcagtaagcagagatcatgccactgcactccagcctgggccagaatgagactccgtctcaaaaaaaaaaaaaaaaaaagcatgtgtaacgtgaaaaaatggacactttagccatcgcctgactttctgttgaattgggaaagagcctcctcccgtccacatgggatggccttcctgatgtggctctccaagaccatccctggagggcataaaacctcacaaatgcatcaggccgtgtgctggggatggggcatcgtcacgccaggtctgactaggaaggaggatggggaggcagggctgggggctttgaggtcgaggcgtggccgtggattccagaaagccccttggctggtgtgcgtgcctgcccagcggcatccgtgtatcctaacacctgccctccgtgtccctgcatctgcaggccatgtcaaaggacgccctgaatctggcgcagatgcaggagcagacgctgcagttggagcaacagtccaagctcaaacaacttgtcaatgaggatttacggaagcaggaggagtccgtgcagaagcaccatcagaccttcttggagtccatcagggcggctggcaccttgtttggggaaggattccgtgcctttgtgacagaccgggacaaagtgacagccacggtggctgggctgacgctgctggctgtcggggtctactcagccaagaatgcgacagccgtcactggccgctacatcgaggctcggctggggaagccgtccctagtgagggagacgtcccgcatcacggtgcttgaggcgctgcggcaccccatccagcaggtcagccggcggctcctcagtcgaccccaggacgtgctggagggtgttgtgcttagtcccagcctggaagcacgggtgcgcgacatcgccataatgacaaggaacatcaagaagaaccggggcctgtacaggcacatcctgctgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccactgagaagataagcgaggacctcagggccacactgaacgccttcctgtaccgcacgggccagcacagcaacaaattcatgctgatcctggccagctgccaccccgagcagttcgactgggccatcaatgcctgcatcgacgtgatggtccacttcgacctgccagggcaggaggagcgggcgcgcctggtgagaatgtatcttaacgagtatgttcttaagccggccacagaaggaaagcggcgtctgaagctggcccagtttgactacgggaggaagtgcttagagatcgctcggctgacagagggcatgtcatgccggaagatcgcacagctggccgtgtcctggcaggccacggcgtatgcctccaaggacggggtcctgaccgaggccatgatggacgcctgcgtgcaagactttgtccagcagcaccagcagatgatgcgctggctgaagggggagaggcctgggcccgaggacgagcaaccctcatcctgagtccatggggagaccacacctcacggagcctggccgcggacccctcccacccctgcctttgcggccccgcacatttaggaaatactccccgtaataaagtcccacgggggccgcaccgctgtgtctattggctgacacggggcggggtttggggccccctaacgtccccctggggtcaaaggtgacagaaaaggcagaagctggggctttctggaggatttaaccacagaggggtgggcttcacaggaggtggctgccacggcggggccgggtgcccgtgccccatcctgaggccgtgcatacgcgggtgccccttcgcctccctcccctccgccagagctgcctgtggccagacacacggtggagggaagtgcacgcgaaacagacacagcggcttcaaatagatgccgcccctgcccgcgctttgcagctagtccctgcaaaccttgatgatggggctgggcgcggtggctcacgcctggaatctcagcgaggccaaggagagtggatcacctgaggtcgggagttccagaccagcctggccaacatggtgaaactccatctctcctaaaaaaaaaaaaaaaaaaaaaaaaaaaaaaaaaaaaattagccggccgtggtggcaagtgcctgaaatcccaggtactcaggaggctgaggcaggagaatcacttgagcccgggaagtggaggttgcactgagctgagaccatggaattgcactgcagcatgggcaacaagagtcaaactccctctaaaaaaaaaaaaaaaaaaagggccaggtggcacatgccggtggtcccagcttcttggcttggaggctgaggtaggaggatcgcctgagcatgggaggcagaggttgcagtgagccaagatcgcaccattgcactccagcctggatgatagagtgagactgtacctctaaataaccaaaaccttgattacagccatggggtgggggtgggggtcaggggcgtctgactatggctggggaactcatttggtttttctcctctcttatttttttgggtagagacagggtccctttgttgcccaggctggtctccaactcctgggctcaagcaatcctcctgcctcggcttcctaaagtgttgggattacaggcttgagccaccgtgcctggtctgttttttttttttttttggcaatagagtcttgctcgcccagggtggagtgcagtggtgtgatctcggctcactgcaacctccaccttcagggtgtcaggcctctgggcccaagctaagccatcatatctcctgtgacctgcacttatacatccagatggcctgaagcaactgaagatccacaaaataagtgaaaagagccttaactgatgacattccaccattgtgatttgtttctgccccaccctagctgatcaatgtactttgcaatctcccccacccttaagaaggttctttgtcattctccccacccttgagaatgtactttgtgagatccatcccctgcccgcaaaacattgtccctaactccaccgcctatcccaaaacctgtaagaactagtgataatcccaccaccctttgctgactctctttttgaactcagcccgcctgcacccaggtgaaataaacagccttgttgctcac

SEQ ID NO: 109622 - DNA, 525 bp, Homo sapiens
  Payload ID: 1529
  Gene Symbol: ATAD3C
  Gene Name: ATPase family, AAA domain containing 3C
  ENST ID: ENST00000475091
  CDS Start-End: 132-525
ttgtcagatgcttgtcctcgtcaccctgagcttgttggctgctatctaattcttattctttcattttcttgcccgcacgttcttgatagcagatcactgacaacagccattggaagcttaggaaaagggccatgtcaaaggacgccctgaatctggcgcagatgcaggagcagacgctgcagttggagcaacagtccaagctcaaacaacttgtcaatgaggatttacggaagcaggaggagtccgtgcagaagcaccatcagaccttcttggagtccatcagggcggctggcaccttgtttggggaaggattccgtgcctttgtgacagaccgggacaaagtgacagccacgcaggtcagccggcggctcctcagtcgaccccaggacgtgctggagggtgttgtgcttagtcccagcctggaagcacgggtgcgcgacatcgccataatgacaaggaacatcaagaagaaccggggcctgtacaggcacatcctgctgtacgggccaccaggcaccgggaaga

SEQ ID NO: 109623 - DNA, 6869 bp, Homo sapiens
  Payload ID: 1530
  Gene Symbol: ATAD5
  Gene Name: ATPase family, AAA domain containing 5
  Uniprot ID: Q96QE3
  ENST ID: ENST00000321990
  CDS Start-End: 379-5913
gcaggacggcgcgaaaacccaattgacaagaattccctccgaagctctgtggtccgatctgcggtccgcttgctttccctgcccggtcccgagcgctcagcctgaagcgccgctttcgagggcaccctgcatacactggccgcgcctcagggatctcattgcccgcgctttctcattgcctctttccgtgttcgattcggctgatctgggcccagcctccgctcccgctctctgtcggtgggcgcgggggaatccgaaacggctcagcagaatcccagcagcttgctgctactggagcgggccgcctccatggcctccaggcaggccgggctggaccgcgtgaggtcctaggagacgggattccgggaagcggggagtatggtgggggtcctggccatggcggctgcagctgctccgcctcccgtgaaggactgcgagattgagccatgcaaaaagcgaaagaaagatgatgacacatctacctgcaaaacaattacaaaatatttatcaccactagggaagactagagacagggtttttgctccaccaaaacctagtaatattctggattattttagaaagacttcacccacaaatgagaagacacaattagggaaagagtgcaagataaagtcacctgaatcagtacctgttgacagcaacaaagactgtacgacacctttggaaatgttctcaaatgtagagtttaagaagaaaagaaagagggttaatttatctcatcaactaaataatattaaaactgaaaatgaagctccaattgaaattagtagcgacgatagcaaagaagactatagtttaaataatgattttgtggaaagtagtacttctgttttacgttacaagaaacaagtagaggtacttgcagaaaacattcaagatacaaaaagtcaaccaaatactatgacctccctgcaaaattctaaaaaagtaaatcctaaacaagggaccacaaaaaatgacttcaaaaagttgagaaaaaggaaatgcagagatgtagtagatctatctgaaagcttacccttggcagaggaactaaatttgcttaaaaaagatggtaaagatactaaacagatggagaatactacaagccatgcaaactctagagataacgtaactgaagcagcccagttaaatgatagtataataactgtctcatatgaggaatttttaaaaagtcacaaggaaaataaagtggaagagataccagactctacaatgtcaatttgtgttccttctgaaactgtcgacgaaatagtcaaaagtggttatataagtgaatcagaaaactccgaaatttcccagcaggtacgctttaagacagttactgttcttgcacaggttcaccctattccgcccaaaaagacagggaaaataccccgaattttcttgaaacaaaagcaatttgaaatggaaaatagtttatctgatcctgagaatgaacagacagttcagaaaagaaaatctaatgttgttatacaggaggaagaattagaattggctgttttggaagctggaagttctgaagctgtgaaaccaaaatgcactctagaagaaagacagcaatttatgaaagcatttaggcagccagcatcagatgcacttaaaaatggagttaaaaagtcttctgataagcagaaagaccttaatgaaaaatgtctatatgaagtaggaagagatgataattctaaaaaaatcatggaaaattctggtatccaaatggtttcaaaaaatggcaatttacagttacacactgataaaggaagttttctgaaggagaaaaataaaaagctaaagaagaagaataagaaaacattagatactggggctattccaggcaaaaacagagagggaaacactcaaaagaaagaaacaacctttttcttaaaagagaaacaatatcaaaatagaatgagtttaagacaaaggaaaacagagtttttcaaaagcagcactttatttaacaatgaaagtcttgtttatgaagatatagcaaatgatgaccttctaaaggtttcctctctgtgtaacaataataaattgtcaagaaaaaccagcataccagttaaagatattaagcttacacagtctaaagctgaatctgaagccagcttgctaaatgtttccacgcccaagtcaactagaagatctggaagaattagcagcacacctactacagaaaccattagaggtattgattctgacgatgtacaagataatagtcaactaaaggcttccactcaaaaagcagccaacttatcggaaaagcacagcttatatacagcagaattaataacagtaccctttgattcagagagccctattagaatgaaattcaccagaattagtactcccaaaaaatctaagaaaaaatctaacaaaagatctgagaaatctgaagcaactgatggaggttttacttctcagattagaaaggcaagcaatacttcaaaaaacatatcaaaagcaaaacaattgattgaaaaagcaaaagctttacacatcagtaggtcaaaggtgactgaagaaatagcgatacccttaaggcgctcctctagacatcagacacttcctgaaaggaagaaattgtcagaaacagaagattctgttataataatagattcaagtcctactgctttaaagcatccagagaaaaatcagaagaaacttcagtgtttgaatgatgtgctaggaaaaaaacttaacacatccactaaaaatgtacctggaaaaatgaaagtcgctcctttatttcttgtcagaaaagcacaaaaagcagctgatcctgtccctagttttgatgaaagcagtcaagatacatctgaaaaatctcaggattgtgatgttcaatgtaaagcaaagcgtgacttcctaatgagtggtttgccagatttgttgaaacggcaaattgcaaagaaagctgctgcgctggatgtgtacaatgcagtgagtaccagtttccagagagtcgtacatgtgcaacaaaaggatgatgggtgttgtttgtggcatttgaaaccaccctcttgtcctctcttaactaaatttaaagaactgaacactaaagtaatagatctctcaaaatgtggtattgctcttggtgaattttcaacattgaattcaaagttgaaaagcggtaactctgctgctgtgttcatgaggacaaggaaggaatttactgaagaagtaagaaatcttttgcttgaggaaattaggtggtcaaatcctgaattttcattgaaaaaatattttcccttactcctaaaaaaacaaattgagcaccaagtactttcttccgagtgtcatagtaaacaagaactggaggctgatgtcagccataaagaaaccaaaaggaaactcgtagaagcagaaaattctaagtcaaaaagaaagaaaccaaatgagtattcaaaaaatctggagaagaccaataggaagtcagaagaacttagcaaaagaaacaactcttctgggataaagctagattcttccaaagattctggaactgaagacatgctttggacagaaaagtatcaacctcagactgccagtgaacttataggaaatgagttagctataaaaaagttacatagttggttgaaagactggaaaagaagagctgaattggaagaaaggcagaatctgaagggaaaaagagatgagaaacatgaagatttctcgggtggcatagactttaaaggcagttcagatgatgaagaagagagtcgtctttgcaatactgtccttataacagggccaacaggagtgggaaaaactgctgcagtgtatgcttgtgcccaggagcttggatttaagatatttgaagtgaatgcctcttcccagcgcagtggtagacaaattctatctcagttgaaggaagctactcagtcccatcaagtagacaaacaaggtgtaaactcacaaaaaccctgtttttttaatagctactacataggcaagtcaccaaaaaaaataagctcccctaagaaagttgttacatcaccaagaaaagttcctccaccatcaccaaaaagtagtggaccaaagcgagcacttcctcccaaaaccttggcaaattattttaaagtatctcccaaacctaaaaataatgaagaaataggaatgcttctggaaaataataaaggaataaaaaattcttttgaacagaaacaaattactcagactaaatctacaaatgcaactaattcaaatgtcaaagacgttggagctgaagaacccagcagaaaaaatgcaacatctcttattctttttgaggaggttgatgtaatttttgatgaagatgctgggtttttgaatgcaatcaaaacattcatggcaacaactaaacgacctgtaatccttactacaagtgacccaacatttagtttaatgtttgatggctgctttgaagaaatcaagttcagtactccttccctgctaaatgttgccagctacctacaaatgatttgcttaactgagaattttagaactgatgtaaaagactttgtaaccttgttaactgcaaatacttgtgatatcagaaaaagtatcctttacttacaattctggattagaagtggaggtggagttttagaagaacgaccattaaccctttatcgtggaaatagcagaaatgtacaactagtttgctctgaacatggccttgataacaaaatttaccctaaaaatactaaaaagaaacgtgtagaccttccaaaatgtgacagtggctgtgctgagaccttgtttggccttaagaacattttttccccatctgaagacttattttcatttttaaagcacaaaatcacaatgaaggaagaatggcataaattcatccagcttcttacagaattccaaatgcggaatgtagattttttatatagtaatcttgagtttattctaccattaccagttgataccattccagaaactaaaaacttttgtggcccatcagtaactgtggatgccagtgcagcaacaaaaagtatgaattgtcttgctaggaaacactctgaaagagaacagccattgaaaaagtcccagaaaaagaaacaaaagaaaacattggtaatattagatgatagtgatctatttgacactgacttggactttcctgatcaatctattagcctgtcctctgtatcatcttcctcaaatgcagaagaaagcaaaaccggagacgaagaaagcaaagccagagacaaaggaaacaatccagagacaaagaaatctattccttgtcctcctaaaacaactgcaggaaaaaaatgttctgcccttgtttctcattgtttaaattctctctctgagttcatggataacatgtccttcttagatgcacttttaactgatgtaagggaacaaaacaaatacggtagaaatgactttagttggacaaatggaaaggttacaagtggactttgtgatgagtttagtcttgagagtaatgatggatggacttctcaaagctctggagaattaaaggcagctgcagaagctctcagctttactaaatgttcttctgctatttcaaaagcattggaaaccttgaattcttgcaagaaattaggaagagatccaaccaacgatcttactttttatgtttcacaaaagcgcaataatgtatactttagtcagtcagcagctaatttagacaatgcttggaagaggatatcagtcattaaaagtgtattttcgagtcgatctcttctctatgtgggtaatagacaagctagtataattgaatacctgccaacccttcgaaacatctgtaagactgagaagctaaaagaacaaggaaaaagtaaaagaagattcctgcactattttgaaggaattcatcttgacattccaaaagagactgtgaatactttggcagctgacttcccttaatgttccatactaacaatgctttgtatagattatcatgtggtccttaagatacatttttatattatgtggatcttcatggaaaagtatatttctcgatgtacattttaaacaaacaatttgtatatttttttattggcgggtaaatatttaaaatatttgagttacaaattttatatatgattgtaattttttttctgaattttttgtattatctgatttagctttgttggagtattttttgtatgtgagtgaactgtttctggaaggtagagttcattaagatgaactccctatttcaagtgtttatattatatattagcttaatattcagatacattatcttggctgctaacattagtgtcactaaagttggtatacaatctcccactgctaaatttgactggctttacaaaaacaaaaacattatctggtgaattatatttttaacctaaaagttaaggatcctcatattgtacagttttttttgtgtgctttttttttttttttttgagacggaatcttgctctgtcacccaggctggagtgcagtggcctggtatcggctcagtgcaacttttgcctcccgggttcaagcgattatcctgcctcagcctcctgaatagctgggattacaggcatgtgccaccttgcccagctaatttttgtatttttagaagagacagggttttaccatgttggttaggctggtctcttaactcctgacctcaagtgatccatctgcctcggcctcccaaagtgctgggatcacaggcgtgagccacctcacctggcctatattgtacagttttgaacagtatagatgcatacctgtttacaaatgtgtatgaagatagatatttttacctcttatttgttcaatttactttttcttgtattaattagtatattgatctaattaaaggttaaagctaaaggctttatgaaatgtttaaaaaa

SEQ ID NO: 109624 - DNA, 4051 bp, Homo sapiens
  Payload ID: 1530
  Gene Symbol: ATAD5
  Gene Name: ATPase family, AAA domain containing 5
  ENST ID: ENST00000578295
  CDS Start-End: 379-4051
gcaggacggcgcgaaaacccaattgacaagaattccctccgaagctctgtggtccgatctgcggtccgcttgctttccctgcccggtcccgagcgctcagcctgaagcgccgctttcgagggcaccctgcatacactggccgcgcctcagggatctcattgcccgcgctttctcattgcctctttccgtgttcgattcggctgatctgggcccagcctccgctcccgctctctgtcggtgggcgcgggggaatccgaaacggctcagcagaatcccagcagcttgctgctactggagcgggccgcctccatggcctccaggcaggccgggctggaccgcgtgaggtcctaggagacgggattccgggaagcggggagtatggtgggggtcctggccatggcggctgcagctgctccgcctcccgtgaaggactgcgagattgagccatgcaaaaagcgaaagaaagatgatgacacatctacctgcaaaacaattacaaaatatttatcaccactagggaagactagagacagggtttttgctccaccaaaacctagtaatattctggattattttagaaagacttcacccacaaatgagaagacacaattagggaaagagtgcaagataaagtcacctgaatcagtacctgttgacagcaacaaagactgtacgacacctttggaaatgttctcaaatgtagagtttaagaagaaaagaaagagggttaatttatctcatcaactaaataatattaaaactgaaaatgaagctccaattgaaattagtagcgacgatagcaaagaagactatagtttaaataatgattttgtggaaagtagtacttctgttttacgttacaagaaacaagtagaggtacttgcagaaaacattcaagatacaaaaagtcaaccaaatactatgacctccctgcaaaattctaaaaaagtaaatcctaaacaagggaccacaaaaaatgacttcaaaaagttgagaaaaaggaaatgcagagatgtagtagatctatctgaaagcttacccttggcagaggaactaaatttgcttaaaaaagatggtaaagatactaaacagatggagaatactacaagccatgcaaactctagagataacgtaactgaagcagcccagttaaatgatagtataataactgtctcatatgaggaatttttaaaaagtcacaaggaaaataaagtggaagagataccagactctacaatgtcaatttgtgttccttctgaaactgtcgacgaaatagtcaaaagtggttatataagtgaatcagaaaactccgaaatttcccagcaggtacgctttaagacagttactgttcttgcacaggttcaccctattccgcccaaaaagacagggaaaataccccgaattttcttgaaacaaaagcaatttgaaatggaaaatagtttatctgatcctgagaatgaacagacagttcagaaaagaaaatctaatgttgttatacaggaggaagaattagaattggctgttttggaagctggaagttctgaagctgtgaaaccaaaatgcactctagaagaaagacagcaatttatgaaagcatttaggcagccagcatcagatgcacttaaaaatggagttaaaaagtcttctgataagcagaaagaccttaatgaaaaatgtctatatgaagtaggaagagatgataattctaaaaaaatcatggaaaattctggtatccaaatggtttcaaaaaatggcaatttacagttacacactgataaaggaagttttctgaaggagaaaaataaaaagctaaagaagaagaataagaaaacattagatactggggctattccaggcaaaaacagagagggaaacactcaaaagaaagaaacaacctttttcttaaaagagaaacaatatcaaaatagaatgagtttaagacaaaggaaaacagagtttttcaaaagcagcactttatttaacaatgaaagtcttgtttatgaagatatagcaaatgatgaccttctaaaggtttcctctctgtgtaacaataataaattgtcaagaaaaaccagcataccagttaaagatattaagcttacacagtctaaagctgaatctgaagccagcttgctaaatgtttccacgcccaagtcaactagaagatctggaagaattagcagcacacctactacagaaaccattagaggtattgattctgacgatgtacaagataatagtcaactaaaggcttccactcaaaaagcagccaacttatcggaaaagcacagcttatatacagcagaattaataacagtaccctttgattcagagagccctattagaatgaaattcaccagaattagtactcccaaaaaatctaagaaaaaatctaacaaaagatctgagaaatctgaagcaactgatggaggttttacttctcagattagaaaggcaagcaatacttcaaaaaacatatcaaaagcaaaacaattgattgaaaaagcaaaagctttacacatcagtaggtcaaaggtgactgaagaaatagcgatacccttaaggcgctcctctagacatcagacacttcctgaaaggaagaaattgtcagaaacagaagattctgttataataatagattcaagtcctactgctttaaagcatccagagaaaaatcagaagaaacttcagtgtttgaatgatgtgctaggaaaaaaacttaacacatccactaaaaatgtacctggaaaaatgaaagtcgctcctttatttcttgtcagaaaagcacaaaaagcagctgatcctgtccctagttttgatgaaagcagtcaagatacatctgaaaaatctcaggattgtgatgttcaatgtaaagcaaagcgtgacttcctaatgagtggtttgccagatttgttgaaacggcaaattgcaaagaaagctgctgcgctggatgtgtacaatgcagtgagtaccagtttccagagagtcgtacatgtgcaacaaaaggatgatgggtgttgtttgtggcatttgaaaccaccctcttgtcctctcttaactaaatttaaagaactgaacactaaagtaatagatctctcaaaatgtggtattgctcttggtgaattttcaacattgaattcaaagttgaaaagcggtaactctgctgctgtgttcatgaggacaaggaaggaatttactgaagaagtaagaaatcttttgcttgaggaaattaggtggtcaaatcctgaattttcattgaaaaaatattttcccttactcctaaaaaaacaaattgagcaccaagtactttcttccgagtgtcatagtaaacaagaactggaggctgatgtcagccataaagaaaccaaaaggaaactcgtagaagcagaaaattctaagtcaaaaagaaagaaaccaaatgagtattcaaaaaatctggagaagaccaataggaagtcagaagaacttagcaaaagaaacaactcttctgggataaagctagattcttccaaagattctggaactgaagacatgctttggacagaaaagtatcaacctcagactgccagtgaacttataggaaatgagttagctataaaaaagttacatagttggttgaaagactggaaaagaagagctgaattggaagaaaggcagaatctgaagggaaaaagagatgagaaacatgaagatttctcgggtggcatagactttaaaggcagttcagatgatgaagaagagagtcgtctttgcaatactgtccttataacagggccaacaggagtgggaaaaactgctgcagtgtatgcttgtgcccaggagcttggatttaagatatttgaagtgaatgcctcttcccagcgcagtggtagacaaattctatctcagttgaaggaagctactcagtcccatcaagtagacaaacaaggtgtaaactcacaaaaaccctgtttttttaatagctactacataggcaagtcaccaaaaaaaataagctcccctaagaaagttgttacatcaccaagaaaagttcctccaccatcaccaaaaa

SEQ ID NO: 109625 - DNA, 494 bp, Homo sapiens
  Payload ID: 1531
  Gene Symbol: ATPIF1
  Gene Name: ATPase inhibitory factor 1
  Uniprot ID: Q9UII2
  ENST ID: ENST00000335514
  CDS Start-End: 52-372
cgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccgagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtgaa

SEQ ID NO: 109626 - DNA, 539 bp, Homo sapiens
  Payload ID: 1531
  Gene Symbol: ATPIF1
  Gene Name: ATPase inhibitory factor 1
  ENST ID: ENST00000468425
  CDS Start-End: 43-270
gcttgctgcggcagagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccgagcacttggagctaccttctgtttctttgctgtagaagccgttgtgtgaacaaatccgtttatttctctcatcagtctcctttgatagacatttgggtcacgtccggttttacgcttttacaatacatcagtgaacagcagtaatacgagctcaagacagaaggcctgaaaaacattgaaaaacacagagacggaaaaaaaaaaaccacagagggggaaatataatttcgggttatttcagtttcacctttacactttgttatattccacattttttgcaataaatataaatttggaagtaaaagcataaaacgaaaa

SEQ ID NO: 109627 - DNA, 599 bp, Homo sapiens
  Payload ID: 1531
  Gene Symbol: ATPIF1
  Gene Name: ATPase inhibitory factor 1
  Uniprot ID: Q9UII2
  ENST ID: ENST00000497986
  CDS Start-End: 76-291
gccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccgacattacaggttatgctttgagatctctttggggtgaaggattgaaattaaaccctgagccaccgtgtccttgtagagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtgaactgtg

SEQ ID NO: 109628 - DNA, 1855 bp, Homo sapiens
  Payload ID: 1531
  Gene Symbol: ATPIF1
  Gene Name: ATPase inhibitory factor 1
  Uniprot ID: Q9UII2
  ENST ID: ENST00000465645
  CDS Start-End: 31-213
agagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccggtgaggctcaccgggtcccaagtccagccctggatctcccaatggccttccaatccttaaactgccaatcgccccacccgttcctacctggtgccttgggcgccccatcccccaacagaactcccgggccccaatccagtataccctaacccttgatgtcccgaccgttgccacgtatagggcactcccagttacctgcacaacagtttcaggcccccaaaccgtttccaccggcgggtctccaaaacaacccacggctcaactcctcctttatcattaccatctcccgcgtggagttctcctcaggtcgtgcgaaacacccccagattcttcgcacagtgtctagatccgaccgcccaacgtttgcctcccagcctgactccctcggcccttacccacctgtcaccccctctacgctctccttcctcgccagcacgccttagctttgcaagcctgcatgcattcaggcttctcaggtgtttctagacccccgactccgcaagagtgaggatgatgggagctggtcatgggagctacttatggttggacaccatcttctaaaggcttttgccctactcagcccaacctagacctgtagatttccctctcctgcttaggagtatggagtgggctgggcctccctttgccagccttgagttatctttaactgacttctgtccactctggagagcagtgaggaattaatcttgcttttgcttgtcctttggcctttcacttctgccttctgttgagaattatcaccatgacacctgccataccgtatagagagccaaggtacagccgttagagactatctaattgagcccctacattttgtagttaaggaaaactgaggcctaaatgtgaccaaaccaacattgtaatccagtcccttcttggaacctaaattgaactgccaagtactgcgcatgcaagagaccctttattggccttacagtgggccattcatttctataggcaaagaaagctctagacagattggaataggaaatggatatttgccttttagctacacccctttgtctgtcttcctcattttgttcctttttttttccctaaaggggagtcaagttccctgggttgttcccctcataaggtattagggacttgtgtcacatctctctggagttttctattttaaagaggaatctgaaagcaataagctctttggtcttcttaagatggctacacctcaatttaagatggggtattctttcactagttgaggagtagaagaggatgaccagctagactcccatggaattggaactcctattccttgcttagacattacaggttatgctttgagatctctttggggtgaaggattgaaattaaaccctgagccaccgtgtccttgtagagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtg

SEQ ID NO: 109629 - DNA, 3483 bp, Homo sapiens
  Payload ID: 1532
  Gene Symbol: ATP13A1
  Gene Name: ATPase type 13A1
  Uniprot ID: Q9HD20
  ENST ID: ENST00000291503
  CDS Start-End: 1-3261
atggagaagtgggaggagctgaacagccatcagccaggagaggagtacgaccccagcaaagcgacctttgtgaaggtggtgccaacccccaacaatggctccacggagctcgtggccctgcaccgcaatgagggcgaagacgggcttgaggtgctgtccttcgaattccagaagatcaagtattcctacgatgccctggagaagaagcagtttctccccgtggcctttcctgtgggaaacgccttctcatactatcagagcaacagaggcttccaggaagactcagagatccgagcagctgagaagaaatttgggagcaacaaggccgagatggtggtgcctgacttctcggagcttttcaaggagagagccacagcccccttctttgtatttcaggtgttctgtgtggggctctggtgcctggatgagtactggtactacagcgtctttacgctatccatgctggtggcgttcgaggcctcgctggtgcagcagcagatgcggaacatgtcggagatccggaagatgggcaacaagccccacatgatccaggtctaccgaagccgcaagtggaggcccattgccagtgatgagatcgtaccaggggacatcgtctccatcggccgctccccacaggagaacctggtgccatgtgacgtgcttctgctgcgaggccgctgcatcgtagacgaggccatgctcacgggggagtccgtgccacagatgaaggagcccatcgaagacctcagcccagaccgggtgctggacctccaggctgattcccggctgcacgtcatcttcgggggcaccaaggtggtgcagcacatccccccacagaaagccaccacgggcctgaagccggttgacagcgggtgcgtggcctacgtcctgcggaccggattcaacacatcccagggcaagctgctgcgcaccatcctcttcggggtcaagagggtgactgcgaacaacctggagaccttcatcttcatcctcttcctcctggtgtttgccatcgctgcagctgcctatgtatggattgaaggtaccaaggaccccagccggaaccgctacaagctgtttctggagtgcaccctgatcctcacctcggtcgtgcctcctgagctgcccatcgagctgtccctggccgtcaacacctccctcatcgccctggccaagctctacatgtactgcacagagcccttccggatcccctttgctggcaaggtcgaggtgtgctgctttgacaagacggggacgttgaccagtgacagcctggtggtgcgcggtgtggccgggctgagagacgggaaggaggtgaccccagtgtccagcatccctgtagaaacacaccgggccctggcctcgtgccactcgctcatgcagctggacgacggcaccctcgtgggtgaccctctagagaaggccatgctgacggccgtggactggacgctgaccaaagatgagaaagtattcccccgaagtattaaaactcaggggctgaaaattcaccagcgctttcattttgccagtgccctgaagcgaatgtccgtgcttgcctcgtatgagaagctgggctccaccgacctctgctacatcgcggccgtgaagggggcccccgaaactctgcactccatgttctcccagtgcccgcccgactaccaccacatccacaccgagatctcccgggaaggagcccgcgtcctggcgctggggtacaaggagctgggacacctcactcaccagcaggcccgggaggtcaagcgggaggccctggagtgcagcctcaagttcgtcggcttcattgtggtctcctgcccgctcaaggctgactccaaggccgtgatccgggagatccagaatgcgtcccaccgggtggtcatgatcacgggagacaacccgctcactgcatgccacgtggcccaggagctgcacttcattgaaaaggcccacacgctgatcctgcagcctccctccgagaaaggccggcagtgcgagtggcgctccattgacggcagcatcgtgctgcccctggcccggggctccccaaaggcactggccctggagtacgcactgtgcctcacaggcgacggcttggcccacctgcaggccaccgacccccagcagctgctccgcctcatcccccatgtgcaggtgttcgcccgtgtggctcccaagcagaaggagtttgtcatcaccagcctgaaggagctgggctacgtgaccctcatgtgtggggatggcaccaacgacgtgggcgccctgaagcatgctgacgtgggtgtggcgctcttggccaatgcccctgagcgggttgtcgagcggcgacggcggccccgggacagcccaaccctgagcaacagtggcatcagagccacctccaggacagccaagcagcggtcggggctccctccctccgaggagcagccaacctcccagagggaccgcctgagccaggtgctgcgagacctcgaggacgagagtacgcccattgtgaaactgggggatgccagcatcgcagcacccttcacctccaagctctcatccatccagtgcatctgccacgtgatcaagcagggccgctgcacgctggtgaccacgctacagatgttcaagatcctggcgctcaatgccctcatcctggcctacagccagagcgtcctctacctggagggagtcaagttcagtgacttccaggccaccctacaggggctgctgctggccggctgcttcctcttcatctcccgttccaagcccctcaagaccctctcccgagaacggcccctgcccaacatcttcaacctgtacaccatcctcaccgtcatgctccagttctttgtgcacttcctgagccttgtctacctgtaccgtgaggcccaggcccggagccccgagaagcaggagcagttcgtggacttgtacaaggagtttgagccaagcctggtcaacagcaccgtctacatcatggccatggccatgcagatggccaccttcgccatcaattacaaaggcccgcccttcatggagagcctgcccgagaacaagcccctggtgtggagtctggcagtttcactcctggccatcattggcctgctcctcggctcctcgcccgacttcaacagccagtttggcctcgtggacatccctgtggagttcaagctggtcattgcccaggtcctgctcctggacttctgcctggcgctcctggccgaccgcgtcctgcagttcttcctggggaccccgaagctgaaagtgccttcctgagatggcagtgctggtacccactgcccaccctggctgccgctgggcgggaaccccaacagggccccgggagggaaccctgcccccaaccccccacagcaaggctgtacagtctcgcccttggaagactgagctgggacccccacagccatccgctggcttggccagcagaaccagccccaagccagcacctttggtaaataaagcagcatctgagattttaaa

SEQ ID NO: 109630 - DNA, 3861 bp, Homo sapiens
  Payload ID: 1532
  Gene Symbol: ATP13A1
  Gene Name: ATPase type 13A1
  Uniprot ID: Q9HD20
  ENST ID: ENST00000357324
  CDS Start-End: 28-3642
ccggaagtgagcgcggcgctaggaaagatggcggcagcggcggcggtgggcaacgcggtgccctgcggggcccggccttgcggggtccggcctgacgggcagcccaagcccgggccgcagccgcgcgcgctccttgccgccgggccggcgctcatagcgaacggtgacgagctggtggctgccgtgtggccgtaccggcggttggcgctgttgcggcgcctcacggtgctgccattcgccgggctgctttacccggcctggttgggtgccgcagccgctggctgctggggctggggcagcagttgggtgcagatccccgaagctgcgctgctcgtgcttgccaccatctgcctcgcgcacgcgctcactgtcctctcggggcattggtctgtgcacgcgcattgcgcgctcacctgcaccccggagtacgaccccagcaaagcgacctttgtgaaggtggtgccaacccccaacaatggctccacggagctcgtggccctgcaccgcaatgagggcgaagacgggcttgaggtgctgtccttcgaattccagaagatcaagtattcctacgatgccctggagaagaagcagtttctccccgtggcctttcctgtgggaaacgccttctcatactatcagagcaacagaggcttccaggaagactcagagatccgagcagctgagaagaaatttgggagcaacaaggccgagatggtggtgcctgacttctcggagcttttcaaggagagagccacagcccccttctttgtatttcaggtgttctgtgtggggctctggtgcctggatgagtactggtactacagcgtctttacgctatccatgctggtggcgttcgaggcctcgctggtgcagcagcagatgcggaacatgtcggagatccggaagatgggcaacaagccccacatgatccaggtctaccgaagccgcaagtggaggcccattgccagtgatgagatcgtaccaggggacatcgtctccatcggccgctccccacaggagaacctggtgccatgtgacgtgcttctgctgcgaggccgctgcatcgtagacgaggccatgctcacgggggagtccgtgccacagatgaaggagcccatcgaagacctcagcccagaccgggtgctggacctccaggctgattcccggctgcacgtcatcttcgggggcaccaaggtggtgcagcacatccccccacagaaagccaccacgggcctgaagccggttgacagcgggtgcgtggcctacgtcctgcggaccggattcaacacatcccagggcaagctgctgcgcaccatcctcttcggggtcaagagggtgactgcgaacaacctggagaccttcatcttcatcctcttcctcctggtgtttgccatcgctgcagctgcctatgtatggattgaaggtaccaaggaccccagccggaaccgctacaagctgtttctggagtgcaccctgatcctcacctcggtcgtgcctcctgagctgcccatcgagctgtccctggccgtcaacacctccctcatcgccctggccaagctctacatgtactgcacagagcccttccggatcccctttgctggcaaggtcgaggtgtgctgctttgacaagacggggacgttgaccagtgacagcctggtggtgcgcggtgtggccgggctgagagacgggaaggaggtgaccccagtgtccagcatccctgtagaaacacaccgggccctggcctcgtgccactcgctcatgcagctggacgacggcaccctcgtgggtgaccctctagagaaggccatgctgacggccgtggactggacgctgaccaaagatgagaaagtattcccccgaagtattaaaactcaggggctgaaaattcaccagcgctttcattttgccagtgccctgaagcgaatgtccgtgcttgcctcgtatgagaagctgggctccaccgacctctgctacatcgcggccgtgaagggggcccccgaaactctgcactccatgttctcccagtgcccgcccgactaccaccacatccacaccgagatctcccgggaaggagcccgcgtcctggcgctggggtacaaggagctgggacacctcactcaccagcaggcccgggaggtcaagcgggaggccctggagtgcagcctcaagttcgtcggcttcattgtggtctcctgcccgctcaaggctgactccaaggccgtgatccgggagatccagaatgcgtcccaccgggtggtcatgatcacgggagacaacccgctcactgcatgccacgtggcccaggagctgcacttcattgaaaaggcccacacgctgatcctgcagcctccctccgagaaaggccggcagtgcgagtggcgctccattgacggcagcatcgtgctgcccctggcccggggctccccaaaggcactggccctggagtacgcactgtgcctcacaggcgacggcttggcccacctgcaggccaccgacccccagcagctgctccgcctcatcccccatgtgcaggtgttcgcccgtgtggctcccaagcagaaggagtttgtcatcaccagcctgaaggagctgggctacgtgaccctcatgtgtggggatggcaccaacgacgtgggcgccctgaagcatgctgacgtgggtgtggcgctcttggccaatgcccctgagcgggttgtcgagcggcgacggcggccccgggacagcccaaccctgagcaacagtggcatcagagccacctccaggacagccaagcagcggtcggggctccctccctccgaggagcagccaacctcccagagggaccgcctgagccaggtgctgcgagacctcgaggacgagagtacgcccattgtgaaactgggggatgccagcatcgcagcacccttcacctccaagctctcatccatccagtgcatctgccacgtgatcaagcagggccgctgcacgctggtgaccacgctacagatgttcaagatcctggcgctcaatgccctcatcctggcctacagccagagcgtcctctacctggagggagtcaagttcagtgacttccaggccaccctacaggggctgctgctggccggctgcttcctcttcatctcccgttccaagcccctcaagaccctctcccgagaacggcccctgcccaacatcttcaacctgtacaccatcctcaccgtcatgctccagttctttgtgcacttcctgagccttgtctacctgtaccgtgaggcccaggcccggagccccgagaagcaggagcagttcgtggacttgtacaaggagtttgagccaagcctggtcaacagcaccgtctacatcatggccatggccatgcagatggccaccttcgccatcaattacaaaggcccgcccttcatggagagcctgcccgagaacaagcccctggtgtggagtctggcagtttcactcctggccatcattggcctgctcctcggctcctcgcccgacttcaacagccagtttggcctcgtggacatccctgtggagttcaagctggtcattgcccaggtcctgctcctggacttctgcctggcgctcctggccgaccgcgtcctgcagttcttcctggggaccccgaagctgaaagtgccttcctgagatggcagtgctggtacccactgcccaccctggctgccgctgggcgggaaccccaacagggccccgggagggaaccctgcccccaaccccccacagcaaggctgtacagtctcgcccttggaagactgagctgggacccccacagccatccgctggcttggccagcagaaccagccccaagccagcacctttggtaaataaagcagcatctgagatttt

SEQ ID NO: 109631 - DNA, 554 bp, Homo sapiens
  Payload ID: 1532
  Gene Symbol: ATP13A1
  Gene Name: ATPase type 13A1
  ENST ID: ENST00000455627
  CDS Start-End: 1-554
gagcctcgccgtgggtcccagctgcggccttcctgtcggtcaccatcgcgacctgggccactcatctgcctggcctggattcccaggggcaccctctacactttggcgcaggcttaatcatgaccccactgctgacttgctgtgcatgcctggagtacgaccccagcaaagcgacctttgtgaaggtggtgccaacccccaacaatggctccacggagctcgtggccctgcaccgcaatgagggcgaagacgggcttgaggtgctgtccttcgaattccagaagatcaagtattcctacgatgccctggagaagaagcagtttctccccgtggcctttcctgtgggaaacgccttctcatactatcagagcaacagaggcttccaggaagactcagagatccgagcagctgagaagaaatttgggagcaacaaggccgagatggtggtgcctgacttctcggagcttttcaaggagagagccacagcccccttctttgtatttcaggtgttctgtgtggggctctggtgcctggatgagtactggtactacagc

SEQ ID NO: 109632 - DNA, 3840 bp, Homo sapiens
  Payload ID: 1533
  Gene Symbol: ATP13A2
  Gene Name: ATPase type 13A2
  Uniprot ID: Q9NQ11
  ENST ID: ENST00000326735
  CDS Start-End: 35-3577
gcgccggggccggcgatgagcgcgaggagccggcatgagcgcagacagcagccctctcgtgggcagcacgcccaccggttatgggaccctgacgatagggacatcaatagatcccctcagctcctcagtttcatccgtgaggctcagcggctactgtggcagtccatggagggtcatcggctatcacgtcgtggtctggatgatggctgggatccctttgctgctcttccgttggaagcccctgtggggggtgcggctgcggctccggccctgcaacctggcccacgccgaaacactcgttatcgaaataagagacaaagaggatagttcctggcagctcttcactgtccaggtgcagactgaggccatcggcgagggcagcctggagccgtccccacagtcccaggcagaggatggccggagccaggcggcagttggggcggtaccagagggtgcctggaaggatacggcccagctccacaagagcgaggaggcggtgagtgtcggacagaagcgggtgctgcggtattacctcttccagggccagcgctatatctggatcgagacccagcaagccttctaccaggtcagcctcctggaccatggccgctcttgtgacgacgtccaccgctcccgccatggcctcagcctccaggaccaaatggtgaggaaggccatttacggccccaacgtgatcagcataccggtcaagtcctacccccagctgctggtggacgaggcactgaacccctactatgggttccaggccttcagcatcgcgctgtggctggctgaccactactactggtacgccctgtgcatcttcctcatttcctccatctccatctgcctgtcgctgtacaagaccagaaagcaaagccagactctaagggacatggtcaagttgtccatgcgggtgtgcgtgtgccggccagggggagaggaagagtgggtggactccagtgagctagtgcccggagactgcctggtgctgccccaggagggtgggctgatgccctgtgatgccgccctggtggccggcgagtgcatggtgaatgagagctctctgacaggagagagcattccagtgctgaagacggcactgccggaggggctggggccctactgtgcagagacacaccggcggcacacactcttctgcgggaccctcatcttgcaggcccgggcctatgtgggaccgcacgtcctggcagtggtgacccgcacagggttctgcacggcaaaagggggcctggtgagctccatcttgcacccccggcccatcaacttcaagttctataaacacagcatgaagtttgtggctgccctctctgtcctggctctcctcggcaccatctacagcatcttcatcctctaccgaaaccgggtgcctctgaatgagattgtaatccgggctctcgacctggtgaccgtggtggtgccacctgccctgcctgctgccatgactgtgtgcacgctctacgcccagagccgactgcggagacagggcattttctgcatccacccactgcgcatcaacctggggggcaagctgcagctggtgtgtttcgacaagacgggcaccctcactgaggacggcttagacgtgatgggggtggtgcccctgaaggggcaggcattcctgcccctggtcccagagcctcgccgcctgcctgtggggcccctgctccgagcactggccacctgccatgccctcagccggctccaggacacccccgtgggcgaccccatggacttgaagatggtggagtctactggctgggtcctggaggaagagccggctgcagactcagcatttgggacccaggtcttggcagtgatgagacccccactttgggagccccagctgcaggcaatggaggagcccccggtgccagtcagcgtcctccaccgcttccccttctcttcggctctgcagcgcatgagtgtggtggtggcgtggccaggggccactcagcccgaggcctacgtcaaaggctccccggagctggtggcagggctctgcaaccccgagacagtgcccaccgacttcgcccagatgctgcagagctatacagctgctggctaccgtgtcgtggccctggccagcaagccactgcccactgtgcccagcctggaggcagcccagcaactgacgagggacactgtggaaggagacctgagcctcctggggctgctggtcatgaggaacctactgaagccgcagacaacgccagttatccaggctctgcgaaggacccgcatccgcgccgtcatggtgacaggggacaacctgcagacagcggtgactgtggcccggggctgtggcatggtggccccccaggagcatctgatcatcgtccacgccacccaccctgagcggggtcagcctgcctctctcgagttcctgccgatggagtcccccacagccgtgaatggcgttaaggatcctgaccaggctgcaagctacaccgtggagccagacccccgatccaggcacctggccctcagcgggcccacctttggtatcattgtgaagcacttccccaagctgctgcccaaggtcctggtccagggcactgtctttgcccgcatggcccctgagcagaagacagagctggtgtgcgagctacagaagcttcagtactgcgtgggcatgtgcggagacggcgccaatgactgtggggccctgaaggcggctgatgtcggcatctcgctgtcccaggcagaagcctcagtggtctcacccttcacctcgagcatggccagtattgagtgcgtgcccatggtcatcagggaggggcgctgttcccttgacacttcgttcagcgtcttcaagtacatggctctgtacagcctgacccagttcatctccgtcctgatcctctacacgatcaacaccaacctgggtgacctgcagttcctggccatcgacctggtcatcaccaccacagtggcagtgctcatgagccgcacggggccagcgctggtcctgggacgggtgcggccaccgggggcgctgctcagcgtgcccgtgctcagcagcctgctgctgcagatggtcctggtgaccggcgtgcagctagggggctacttcctgaccctggcccagccatggttcgtgcctctgaacaggacagtggccgcaccagacaacctgcccaactacgagaacaccgtggtcttctctctgtccagcttccagtacctcatcctggctgcagccgtgtccaagggggcgcccttccgccggccgctctacaccaatgtgcccttcctggtggccctggcgctcctgagctccgtcctggtgggccttgtcctggtccccggcctcctgcaggggccgctggcgctgaggaacatcactgacaccggcttcaagctgctgctgctgggtctggtcaccctcaacttcgtgggggccttcatgctggagagcgtgctagaccagtgcctccccgcctgcctgcgccgcctccggcccaagcgggcctccaagaagcgcttcaagcagctggaacgagagctggccgagcagccctggccgccgctgcccgccggccccctgaggtagtgcaggcccacgggcaccccagacactggaactccctgcctctgagccaccaactggacccctctccagcaacaccaccgccaccacctcccacatccctgaggttggcgactgtctacactcctcccccgagaccacccccaccctggggaagcgttgactactgtcccctaccttggaccatcccgcgtaggggtggcagcccccagctcccctcagtgctgctgtcagtgtagcaaataaagtcatgatattttcctggc

SEQ ID NO: 109633 - DNA, 3681 bp, Homo sapiens
  Payload ID: 1533
  Gene Symbol: ATP13A2
  Gene Name: ATPase type 13A2
  Uniprot ID: Q9NQ11
  ENST ID: ENST00000341676
  CDS Start-End: 178-3654
cgccgagcctggtggcccaggtgccccgcccgcgtcagccctgctccagccccgcgctagcccagcgcccctcgccccgggccgtccggaccgcgcccccgcccagggccttgcgcacgccggggcccaggccgagggccgcagcgccggggccggcgatgagcgcgaggagccggcatgagcgcagacagcagccctctcgtgggcagcacgcccaccggttatgggaccctgacgatagggacatcaatagatcccctcagctcctcagtttcatccgtgaggctcagcggctactgtggcagtccatggagggtcatcggctatcacgtcgtggtctggatgatggctgggatccctttgctgctcttccgttggaagcccctgtggggggtgcggctgcggctccggccctgcaacctggcccacgccgaaacactcgttatcgaaataagagacaaagaggatagttcctggcagctcttcactgtccaggtgcagactgaggccatcggcgagggcagcctggagccgtccccacagtcccaggcagaggatggccggagccaggcggcagttggggcggtaccagagggtgcctggaaggatacggcccagctccacaagagcgaggaggcgaagcgggtgctgcggtattacctcttccagggccagcgctatatctggatcgagacccagcaagccttctaccaggtcagcctcctggaccatggccgctcttgtgacgacgtccaccgctcccgccatggcctcagcctccaggaccaaatggtgaggaaggccatttacggccccaacgtgatcagcataccggtcaagtcctacccccagctgctggtggacgaggcactgaacccctactatgggttccaggccttcagcatcgcgctgtggctggctgaccactactactggtacgccctgtgcatcttcctcatttcctccatctccatctgcctgtcgctgtacaagaccagaaagcaaagccagactctaagggacatggtcaagttgtccatgcgggtgtgcgtgtgccggccagggggagaggaagagtgggtggactccagtgagctagtgcccggagactgcctggtgctgccccaggagggtgggctgatgccctgtgatgccgccctggtggccggcgagtgcatggtgaatgagagctctctgacaggagagagcattccagtgctgaagacggcactgccggaggggctggggccctactgtgcagagacacaccggcggcacacactcttctgcgggaccctcatcttgcaggcccgggcctatgtgggaccgcacgtcctggcagtggtgacccgcacagggttctgcacggcaaaagggggcctggtgagctccatcttgcacccccggcccatcaacttcaagttctataaacacagcatgaagtttgtggctgccctctctgtcctggctctcctcggcaccatctacagcatcttcatcctctaccgaaaccgggtgcctctgaatgagattgtaatccgggctctcgacctggtgaccgtggtggtgccacctgccctgcctgctgccatgactgtgtgcacgctctacgcccagagccgactgcggagacagggcattttctgcatccacccactgcgcatcaacctggggggcaagctgcagctggtgtgtttcgacaagacgggcaccctcactgaggacggcttagacgtgatgggggtggtgcccctgaaggggcaggcattcctgcccctggtcccagagcctcgccgcctgcctgtggggcccctgctccgagcactggccacctgccatgccctcagccggctccaggacacccccgtgggcgaccccatggacttgaagatggtggagtctactggctgggtcctggaggaagagccggctgcagactcagcatttgggacccaggtcttggcagtgatgagacccccactttgggagccccagctgcaggcaatggaggagcccccggtgccagtcagcgtcctccaccgcttccccttctcttcggctctgcagcgcatgagtgtggtggtggcgtggccaggggccactcagcccgaggcctacgtcaaaggctccccggagctggtggcagggctctgcaaccccgagacagtgcccaccgacttcgcccagatgctgcagagctatacagctgctggctaccgtgtcgtggccctggccagcaagccactgcccactgtgcccagcctggaggcagcccagcaactgacgagggacactgtggaaggagacctgagcctcctggggctgctggtcatgaggaacctactgaagccgcagacaacgccagttatccaggctctgcgaaggacccgcatccgcgccgtcatggtgacaggggacaacctgcagacagcggtgactgtggcccggggctgtggcatggtggccccccaggagcatctgatcatcgtccacgccacccaccctgagcggggtcagcctgcctctctcgagttcctgccgatggagtcccccacagccgtgaatggcgttaaggtcctggtccagggcactgtctttgcccgcatggcccctgagcagaagacagagctggtgtgcgagctacagaagcttcagtactgcgtgggcatgtgcggagacggcgccaatgactgtggggccctgaaggcggctgatgtcggcatctcgctgtcccaggcagaagcctcagtggtctcacccttcacctcgagcatggccagtattgagtgcgtgcccatggtcatcagggaggggcgctgttcccttgacacttcgttcagcgtcttcaagtacatggctctgtacagcctgacccagttcatctccgtcctgatcctctacacgatcaacaccaacctgggtgacctgcagttcctggccatcgacctggtcatcaccaccacagtggcagtgctcatgagccgcacggggccagcgctggtcctgggacgggtgcggccaccgggggcgctgctcagcgtgcccgtgctcagcagcctgctgctgcagatggtcctggtgaccggcgtgcagctagggggctacttcctgaccctggcccagccatggttcgtgcctctgaacaggacagtggccgcaccagacaacctgcccaactacgagaacaccgtggtcttctctctgtccagcttccagtacctcatcctggctgcagccgtgtccaagggggcgcccttccgccggccgctctacaccaatgagcgtgctagaccagtgcctccccgcctgcctgcgccgcctccggcccaagcgggcctccaagaagcgcttcaagcagctggaacgagagctggccgagcagccctggccgccgctgcccgccggccccctgaggtagtgcaggcccacgggcaccccagacactggaactccctgcctctgagccaccaactggacccctctccagcaacaccaccgccaccacctcccacatccctgaggttggcgactgtctacactcctcccccgagaccacccccaccctggggaagcgttgactactgtcccctaccttggaccatcccgcgtaggggtggcagcccccagctcccctcagtgctgctgtcagtgtagcaaataaagtcatgatattttcctggc

SEQ ID NO: 109634 - DNA, 3981 bp, Homo sapiens
  Payload ID: 1533
  Gene Symbol: ATP13A2
  Gene Name: ATPase type 13A2
  Uniprot ID: Q9NQ11
  ENST ID: ENST00000452699
  CDS Start-End: 191-3718
agtgtcggagccgcgccgagcctggtggcccaggtgccccgcccgcgtcagccctgctccagccccgcgctagcccagcgcccctcgccccgggccgtccggaccgcgcccccgcccagggccttgcgcacgccggggcccaggccgagggccgcagcgccggggccggcgatgagcgcgaggagccggcatgagcgcagacagcagccctctcgtgggcagcacgcccaccggttatgggaccctgacgatagggacatcaatagatcccctcagctcctcagtttcatccgtgaggctcagcggctactgtggcagtccatggagggtcatcggctatcacgtcgtggtctggatgatggctgggatccctttgctgctcttccgttggaagcccctgtggggggtgcggctgcggctccggccctgcaacctggcccacgccgaaacactcgttatcgaaataagagacaaagaggatagttcctggcagctcttcactgtccaggtgcagactgaggccatcggcgagggcagcctggagccgtccccacagtcccaggcagaggatggccggagccaggcggcagttggggcggtaccagagggtgcctggaaggatacggcccagctccacaagagcgaggaggcgaagcgggtgctgcggtattacctcttccagggccagcgctatatctggatcgagacccagcaagccttctaccaggtcagcctcctggaccatggccgctcttgtgacgacgtccaccgctcccgccatggcctcagcctccaggaccaaatggtgaggaaggccatttacggccccaacgtgatcagcataccggtcaagtcctacccccagctgctggtggacgaggcactgaacccctactatgggttccaggccttcagcatcgcgctgtggctggctgaccactactactggtacgccctgtgcatcttcctcatttcctccatctccatctgcctgtcgctgtacaagaccagaaagcaaagccagactctaagggacatggtcaagttgtccatgcgggtgtgcgtgtgccggccagggggagaggaagagtgggtggactccagtgagctagtgcccggagactgcctggtgctgccccaggagggtgggctgatgccctgtgatgccgccctggtggccggcgagtgcatggtgaatgagagctctctgacaggagagagcattccagtgctgaagacggcactgccggaggggctggggccctactgtgcagagacacaccggcggcacacactcttctgcgggaccctcatcttgcaggcccgggcctatgtgggaccgcacgtcctggcagtggtgacccgcacagggttctgcacggcaaaagggggcctggtgagctccatcttgcacccccggcccatcaacttcaagttctataaacacagcatgaagtttgtggctgccctctctgtcctggctctcctcggcaccatctacagcatcttcatcctctaccgaaaccgggtgcctctgaatgagattgtaatccgggctctcgacctggtgaccgtggtggtgccacctgccctgcctgctgccatgactgtgtgcacgctctacgcccagagccgactgcggagacagggcattttctgcatccacccactgcgcatcaacctggggggcaagctgcagctggtgtgtttcgacaagacgggcaccctcactgaggacggcttagacgtgatgggggtggtgcccctgaaggggcaggcattcctgcccctggtcccagagcctcgccgcctgcctgtggggcccctgctccgagcactggccacctgccatgccctcagccggctccaggacacccccgtgggcgaccccatggacttgaagatggtggagtctactggctgggtcctggaggaagagccggctgcagactcagcatttgggacccaggtcttggcagtgatgagacccccactttgggagccccagctgcaggcaatggaggagcccccggtgccagtcagcgtcctccaccgcttccccttctcttcggctctgcagcgcatgagtgtggtggtggcgtggccaggggccactcagcccgaggcctacgtcaaaggctccccggagctggtggcagggctctgcaaccccgagacagtgcccaccgacttcgcccagatgctgcagagctatacagctgctggctaccgtgtcgtggccctggccagcaagccactgcccactgtgcccagcctggaggcagcccagcaactgacgagggacactgtggaaggagacctgagcctcctggggctgctggtcatgaggaacctactgaagccgcagacaacgccagttatccaggctctgcgaaggacccgcatccgcgccgtcatggtgacaggggacaacctgcagacagcggtgactgtggcccggggctgtggcatggtggccccccaggagcatctgatcatcgtccacgccacccaccctgagcggggtcagcctgcctctctcgagttcctgccgatggagtcccccacagccgtgaatggcgttaaggatcctgaccaggctgcaagctacaccgtggagccagacccccgatccaggcacctggccctcagcgggcccacctttggtatcattgtgaagcacttccccaagctgctgcccaaggtcctggtccagggcactgtctttgcccgcatggcccctgagcagaagacagagctggtgtgcgagctacagaagcttcagtactgcgtgggcatgtgcggagacggcgccaatgactgtggggccctgaaggcggctgatgtcggcatctcgctgtcccaggcagaagcctcagtggtctcacccttcacctcgagcatggccagtattgagtgcgtgcccatggtcatcagggaggggcgctgttcccttgacacttcgttcagcgtcttcaagtacatggctctgtacagcctgacccagttcatctccgtcctgatcctctacacgatcaacaccaacctgggtgacctgcagttcctggccatcgacctggtcatcaccaccacagtggcagtgctcatgagccgcacggggccagcgctggtcctgggacgggtgcggccaccgggggcgctgctcagcgtgcccgtgctcagcagcctgctgctgcagatggtcctggtgaccggcgtgcagctagggggctacttcctgaccctggcccagccatggttcgtgcctctgaacaggacagtggccgcaccagacaacctgcccaactacgagaacaccgtggtcttctctctgtccagcttccagtacctcatcctggctgcagccgtgtccaagggggcgcccttccgccggccgctctacaccaatgtgcccttcctggtggccctggcgctcctgagctccgtcctggtgggccttgtcctggtccccggcctcctgcaggggccgctggcgctgaggaacatcactgacaccggcttcaagctgctgctgctgggtctggtcaccctcaacttcgtgggggccttcatgctggagagcgtgctagaccagtgcctccccgcctgcctgcgccgcctccggcccaagcgggcctccaagaagcgcttcaagcagctggaacgagagctggccgagcagccctggccgccgctgcccgccggccccctgaggtagtgcaggcccacgggcaccccagacactggaactccctgcctctgagccaccaactggacccctctccagcaacaccaccgccaccacctcccacatccctgaggttggcgactgtctacactcctcccccgagaccacccccaccctggggaagcgttgactactgtcccctaccttggaccatcccgcgtaggggtggcagcccccagctcccctcagtgctgctgtcagtgtagcaaataaagtcatgatattttcctggc

SEQ ID NO: 109635 - DNA, 774 bp, Homo sapiens
  Payload ID: 1533
  Gene Symbol: ATP13A2
  Gene Name: ATPase type 13A2
  ENST ID: ENST00000503552
  CDS Start-End: 1-774
tacagcatcttcatcctctaccgaaaccgggtgcctctgaatgagattgtaatccgggctctcgacctggtgaccgtggtggtgccacctgccctgcctgctgccatgactgtgtgcacgctctacgcccagagccgactgcggagacagggcattttctgcatccacccactgcgcatcaacctggggggcaagctgcagctggtgtgtttcgacaaggtcctggaggaagagccggctgcagactcagcatttgggacccaggtcttggcagtgatgagacccccactttgggagccccagctgcaggcaatgcgcatgagtgtggtggtggcgtggccaggggccactcagcccgaggcctacgtcaaaggctccccggagctggtggcagggctctgcaaccccgagacagtgcccaccgacttcgcccagatgctgcagagctatacagctgctggctaccgtgtcgtggccctggccagcaagccactgcccactgtgcccagcctggaggcagcccagcaactgacgagggacactgtggaaggagacctgagcctcctggggctgctggtcatgaggaacctactgaagccgcagacaacgccagttatccaggctctgcgaaggacccgcatccgcgccgtcatggtgacaggggacaacctgcagacagcggtgactgtggcccggggctgtggcatggtggccccccaggagcatctgatcatcgtccacgccacccaccctgagcggggtcagcctgcctct

SEQ ID NO: 109636 - DNA, 562 bp, Homo sapiens
  Payload ID: 1533
  Gene Symbol: ATP13A2
  Gene Name: ATPase type 13A2
  ENST ID: ENST00000508222
  CDS Start-End: 1-562
tatcgaaataagagacaaagaggatagttcctggcagctcttcactgtccaggtgcagactgaggccatcggcgagggcagcctggagccgtccccacagtcccaggcagaggatggccggagccaggcggcagttggggcggtaccagagggtgcctggaaggatacggcccagctccacaagagcgaggaggcgaagcgggtgctgcggtattacctcttccagggccagcgctatatctggatcgagacccagcaagccttctaccaggtcagcctcctggaccatggccgctcttgtgacgacgtccaccgctcccgccatggcctcagcctccaggaccaaatggtgaggaaggccatttacggccccaacgtgatcagcataccggtcaagtcctacccccagctgctggtggacgaggccttcagcatcgcgctgtggctggctgaccactactactggtacgccctgtgcatcttcctcatttcctccatctccatctgcctgtcgctgtacaagaccagaaagcaaagccagactctaagggacatggtcaag

SEQ ID NO: 109637 - DNA, 570 bp, Homo sapiens
  Payload ID: 1533
  Gene Symbol: ATP13A2
  Gene Name: ATPase type 13A2
  ENST ID: ENST00000509619
  CDS Start-End: 1-570
cgtgggcagcacgcccaccggttatgggaccctgacgatagggacatcaatagatcccctcagctcctcagtttcatccgtgaggctcagcggctactgtggcagtccatggagggtcatcggctatcacgtcgtggtctggatgatggctgggatccctttgctgctcttccgttggaagcccctgtggggggtgcggctgcggctccggccctgcaacctggcccacgccgaaacactcgttatcgaaataagagacaaagaggatagttcctggcagctcttcactgtccaggtgcagactgaggccatcggcgagggcagcctggagccgtccccacagtcccaggcagaggatggccggagccaggcggcagttggggcggtaccagagggtgcctggaaggatacggcccagctccacaagagcgaggaggcgcgggtgctgcggtattacctcttccagggccagcgctatatctggatcgagacccagcaagccttctaccaggtcagcctcctggaccatggccgctcttgtgacgacgtccaccgctcccgccatggcct

SEQ ID NO: 109638 - DNA, 1201 bp, Homo sapiens
  Payload ID: 1533
  Gene Symbol: ATP13A2
  Gene Name: ATPase type 13A2
  ENST ID: ENST00000502418
  CDS Start-End: 1-1197
gatcctgaccaggctgcaagctacaccgtggagccagacccccgatccaggcacctggccctcagcgggcccacctttggtatcattgtgaagcacttccccaagctgctgcccaaggtcctggtccagggcactgtctttgcccgcatggcccctgagcagaagacagagctggtgtgcgagctacagaagcttcagtactgcgtgggcatgtgcggagacggcgccaatgactgtggggccctgaaggcggctgatgtcggcatctcgctgtcccaggcagaagcctcagtggtctcacccttcacctcgagcatggccagtattgagtgcgtgcccatggtcatcagggaggggcgctgttcccttgacacttcgttcagcgtcttcaagtacatggctctgtacagcctgacccagttcatctccgtcctgatcctctacacgatcaacaccaacctgggtgacctgcagttcctggccatcgacctggtcatcaccaccacagtggcagtgctcatgagccgcacggggccagcgctggtcctgggacgggtgcggccaccgggggcgctgctcagcgtgcccgtgctcagcagcctgctgctgcagatggtcctggtgaccggcgtgcagctagggggctacttcctgaccctggcccagccatggttcgtgcctctgaacaggacagtggccgcaccagacaacctgcccaactacgagaacaccgtggtcttctctctgtccagcttccagtacctcatcctggctgcagccgtgtccaagggggcgcccttccgccggccgctctacaccaatgagcgtgctagaccagtgcctccccgcctgcctgcgccgcctccggcccaagcgggcctccaagaagcgcttcaagcagctggaacgagagctggccgagcagccctggccgccgctgcccgccggccccctgaggtagtgcaggcccacgggcaccccagacactggaactccctgcctctgagccaccaactggacccctctccagcaacaccaccgccaccacctcccacatccctgaggttggcgactgtctacactcctcccccgagaccacccccaccctggggaagcgttgactactgtcccctaccttggaccatcccgcgtaggggtggcagcccccagctcccctcagtgctgctgtcagtgtagcaaa

SEQ ID NO: 109639 - DNA, 962 bp, Homo sapiens
  Payload ID: 1533
  Gene Symbol: ATP13A2
  Gene Name: ATPase type 13A2
  ENST ID: ENST00000510069
  CDS Start-End: 1-962
agatcccctcagctcctcagtttcatccgtgaggctcagcggctactgtggcagtccatggagggtcatcggctatcacgtcgtggtctggatgatggctgggatccctttgctgctcttccgttggaagcccctgtggggggtgcggctgcggctccggccctgcaacctggcccacgccgaaacactcgttatcgaaataagagacaaagaggatagttcctggcagctcttcactgtccaggtgcagactgaggccatcggcgagggcagcctggagccgtccccacagtcccaggcagaggatggccggagccaggcggcagttggggcggtaccagagggtgcctggaaggatacggcccagctccacaagagcgaggaggcggtgagtgtcggacagcgggtgctgcggtattacctcttccagggccagcgctatatctggatcgagacccagcaagccttctaccaggtcagcctcctggaccatggccgctcttgtgacgacgtccaccgctcccgccatggcctcagcctccaggaccaaatggtgaggaaggccatttacggccccaacgtgatcagcataccggtcaagtcctacccccagctgctggtggacgaggcactgaacccctactatgggttccaggccttcagcatcgcgctgtggctggctgaccactactactggtacgccctgtgcatcttcctcatttcctccatctccatctgcctgtcgctgtacaagaccagaaagcaaagccagactctaagggacatggtcaagttgtccatgcgggtgtgcgtgtgccggccagggggagaggaagagtgggtggactccagtgagctagtgcccggagactgcctggtgctgccccaggagggtgggctgatgccctgtgatgccgccctggtggccggcgagtgcatggtgaatgagagctctctgacag

SEQ ID NO: 109640 - DNA, 573 bp, Homo sapiens
  Payload ID: 1533
  Gene Symbol: ATP13A2
  Gene Name: ATPase type 13A2
  ENST ID: ENST00000506174
  CDS Start-End: 1-573
caaagccagactctaagggacatggtcaagttgtccatgcgggtgtgcgtgtgccggccagggggagaggaagagtgggtggactccagtgagctagtgcccggagactgcctggtgctgccccaggagggtgggctgatgccctgtgatgccgccctggtggccggcgagtgcatggtgaatgagagctctctgacaggagagagcattccagtgctgaagacggcactgccggaggggctggggccctactgtgcagagacacaccggcggcacacactcttctgcgggaccctcatcttgcaggcccgggcctatgtgggaccgcacgtcctggcagtggtgacccgcacagggggcctggtgagctccatcttgcacccccggcccatcaacttcaagttctataaacacagcatgaagtttgtggctgccctctctgtcctggctctcctcggcaccatctacagcatcttcatcctctaccgaaaccgggtgcctctgaatgagattgtaatccgggctctcgacctggtgaccgtggtggtgccacctgccctgcctgctgccatg

SEQ ID NO: 109641 - DNA, 569 bp, Homo sapiens
  Payload ID: 1533
  Gene Symbol: ATP13A2
  Gene Name: ATPase type 13A2
  ENST ID: ENST00000511957
  CDS Start-End: 1-569
gatagttcctggcagctcttcactgtccaggtgcagactgaggccatcggcgagggcagcctggagccgtccccacagtcccaggcagaggatggccggagccaggcggcagttggggcggtaccagagggtgcctggaaggatacggcccagctccacaagagcgaggaggcggtgagtgtcggacagaagcgggtgctgcggtattacctcttccagggccagcgctatatctggatcgagacccagcaagccttctaccaggtcagcctcctggaccatggccgctcttgtgacgacgtccaccgctcccgccatggcctcagcctccaggaccaaatggtgaggaaggccatttacggccccaacgtgatcagcataccggtcaagtcctacccccagctgctggtggacgaggccttcagcatcgcgctgtggctggctgaccactactactggtacgccctgtgcatcttcctcatttcctccatctccatctgcctgtcgctgtacaagaccagaaagcaaagccagactctaagggacatggtcaagttgtccatgcgggt

SEQ ID NO: 109642 - DNA, 1723 bp, Homo sapiens
  Payload ID: 1533
  Gene Symbol: ATP13A2
  Gene Name: ATPase type 13A2
  ENST ID: ENST00000617114
  CDS Start-End: 1037-1723
agtgtcggagccgcgccgagcctggtggcccaggtgccccgcccgcgtcagccctgctccagccccgcgctagcccagcgcccctcgccccgggccgtccggaccgcgcccccgcccagggccttgcgcacgccggggcccaggccgagggccgcagcgccggggccggcgatgagcgcgaggagccggcatgagcgcagacagcagccctctcgtgggcagcacgcccaccggttatgggaccctgacgatagggacatcaatagatcccctcagctcctcagtttcatccgtgaggctcagcggctactgtggcagtccatggagggtcatcggctatcacgtcgtggtctggatgatggctgggatccctttgctgctcttccgttggaagcccctgtggggggtgcggctgcggctccggccctgcaacctggcccacgccgaaacactcgttatcgaaataagagacaaagaggatagttcctggcagctcttcactgtccaggtgcagactgaggccatcggcgagggcagcctggagccgtccccacagtcccaggcagaggatggccggagccaggcggcagttggggcggtaccagagggtgcctggaaggatacggcccagctccacaagagcgaggaggcgaagcgggtgctgcggtattacctcttccagggccagcgctatatctggatcgagacccagcaagccttctaccaggtcagcctcctggaccatggccgctcttgtgacgacgtccaccgctcccgccatggcctcagcctccaggaccaaatggtgaggaaggccatttacggccccaacgtgatcagcataccggtcaagtcctacccccagctgctggtggacgaggcactgaacccctactatgggttccaggccttcagcatcgcgctgtggctggctgaccactactactggtacgccctgtgcatcttcctcatttcctccatctccatctgcctgtcgctgtacaagaccagaaagcaaagccagactctaagggacatggtcaagttgtccatgcgggtgtgcgtgtgccggccagggggagaggaagagtgggtggactccagtgagctagtgcccggagactgcctggtgctgccccaggagggtgggctgatgccctgtgatgccgccctggtggccggcgagtgcatggtgaatgagagctctctgacaggagagagcattccagtgctgaagacggcactgccggaggggctggggccctactgtgcagagacacaccggcggcacacactcttctgcgggaccctcatcttgcaggcccgggcctatgtgggaccgcacgtcctggcagtggtgacccgcacagctctcctcggcaccatctacagcatcttcatcctctaccgaaaccgggtgcctctgaatgagattgtaatccgggctctcgacctggtgaccgtggtggtgccacctgccctgcctgctgccatgactgtgtgcacgctctacgcccagagccgactgcggagacagggcattttctgcatccacccactgcgcatcaacctggggggcaagctgcagctggtgtgtttcgacaaggtggggccgcaggtggggttggtgcaggggagcgggacagccacaggcgccccagtgaggcctccacacccgcgttattctctcagcagcacccacaggatgccaggtcctgtctag

SEQ ID NO: 109643 - DNA, 7322 bp, Homo sapiens
  Payload ID: 1534
  Gene Symbol: ATP13A3
  Gene Name: ATPase type 13A3
  Uniprot ID: Q9H7F0
  ENST ID: ENST00000256031
  CDS Start-End: 403-4083
tttattcaaataataggagctctacgagtgacagatggcagaagggcacatcttctgaaaacttactaaaaattggtgaattacaaaattctaaattttaataccttaatcattttgaaagcagttcagacagaaccgaaacagaaatatttggcataaaattccaaatttttatgcttagttttatttttattattaaaagccagcttttgaaagctgtgcaaatatcaggaattgggaagaatgatgatatagtgctactggtaagaaaaatttcttcaatttgttttctctgatatcgaatttgacttggttaaaaaacgtgtgctccagcagtccagaaaagttatatttcttgatcttccattgtttgaagcactggacctttaatccactgtaggtatggacagggaagaaaggaagaccatcaatcagggtcaagaagatgaaatggagatttatggttacaatttgagtcgctggaagcttgccatagtttctttaggagtgatttgctctggtgggtttctcctcctcctcctctattggatgcctgagtggcgggtgaaagcgacctgtgtcagagctgcaattaaagactgtgaagtagtgctgctgaggactactgatgaattcaaaatgtggttttgtgcaaaaattcgcgttctttctttggaaacttacccagtttcaagtccaaaatctatgtctaataagctttcaaatggccatgcagtttgtttaattgagaatcccactgaagaaaataggcacaggatcagtaaatattcacagactgaatcacaacagattcgttatttcacccaccatagtgtaaaatatttctggaatgataccattcacaattttgatttcttaaagggactggatgaaggtgtttcttgtacgtcaatttatgaaaagcatagtgcaggactgacaaaggggatgcatgcctacagaaaactgctttatggagtaaatgaaattgctgtaaaagtgccttctgtttttaagcttctaattaaagaggttctcaacccattttacattttccagctgttcagtgttatactgtggagcactgatgaatactattactatgctctagctattgtggttatgtccatagtatcaatcgtaagctcactatattccattagaaagcaatatgttatgttgcatgacatggtggcaactcatagtaccgtaagagtttcagtttgtagagtaaatgaagaaatagaagaaatcttttctaccgaccttgtgccaggagatgtcatggtcattccattaaatgggacaataatgccttgtgatgctgtgcttattaatggtacctgcattgtaaacgaaagcatgttaacaggagaaagtgttccagtgacaaagactaatttgccaaatccttcagtggatgtgaaaggaataggagatgaattatataatccagaaacacataaacgacatactttgttttgtgggacaactgttattcagactcgtttctacactggagaactcgtcaaagccatagttgttagaacaggatttagtacttccaaaggacagcttgttcgttccatattgtatcccaaaccaactgattttaaactctacagagatgcctacttgtttctactatgtcttgtggcagttgctggcattgggtttatctacactattattaatagcattttaaatgaggtacaagttggggtcataattatcgagtctcttgatattatcacaattactgtgccccctgcacttcctgctgcaatgactgctggtattgtgtatgctcagagaagactgaaaaaaatcggtattttctgtatcagtcctcaaagaataaatatttgtggacagctcaatcttgtttgctttgacaagactggaactctaactgaagatggtttagatctttgggggattcaacgagtggaaaatgcacgatttctttcaccagaagaaaatgtgtgcaatgagatgttggtaaaatcccagtttgttgcttgtatggctacttgtcattcacttacaaaaattgaaggagtgctctctggtgatccacttgatctgaaaatgtttgaggctattggatggattctggaagaagcaactgaagaagaaacagcacttcataatcgaattatgcccacagtggttcgtcctcccaaacaactgcttcctgaatctacccctgcaggaaaccaagaaatggagctgtttgaacttccagctacttatgagataggaattgttcgccagttcccattttcttctgctttgcaacgtatgagtgtggttgccagggtgctgggggataggaaaatggacgcctacatgaaaggagcgcccgaggccattgccggtctctgtaaacctgaaacagttcctgtcgattttcaaaacgttttggaagacttcactaaacagggcttccgtgtgattgctcttgcacacagaaaattggagtcaaaactgacatggcataaagtacagaatattagcagagatgcaattgagaacaacatggattttatgggattaattataatgcagaacaaattaaagcaagaaacccctgcagtacttgaagatttgcataaagccaacattcgcaccgtcatggtcacaggtgacagtatgttgactgctgtctctgtggccagagattgtggaatgattctacctcaggataaagtgattattgctgaagcattacctccaaaggatgggaaagttgccaaaataaattggcattatgcagactccctcacgcagtgcagtcatccatcagcaattgacccagaggctattccggttaaattggtccatgatagcttagaggatcttcaaatgactcgttatcattttgcaatgaatggaaaatcattctcagtgatactggagcattttcaagaccttgttcctaagttgatgttgcatggcaccgtgtttgcccgtatggcacctgatcagaagacacagttgatagaagcattgcaaaatgttgattattttgttgggatgtgtggtgatggcgcaaatgattgtggtgctttgaagagggcacacggaggcatttccttatcggagctcgaagcttcagtggcatctccctttacctctaagactcctagtatttcctgtgtgccaaaccttatcagggaaggccgtgctgctttaataacttccttctgtgtgtttaaattcatggcattgtacagcattatccagtacttcagtgttactctgctgtattctatcttaagtaacctaggagacttccagtttctcttcattgatctggcaatcattttggtagtggtatttacaatgagtttaaatcctgcctggaaagaacttgtggcacaaagaccaccttcgggtcttatatctggggcccttctcttctccgttttgtctcagattatcatctgcattggatttcaatctttgggttttttttgggtcaaacagcaaccttggtatgaagtgtggcatccaaaatcagatgcttgtaatacaacaggaagcgggttttggaattcttcacacgtagacaatgaaaccgaacttgatgaacataatatacaaaattatgaaaataccacagtgttttttatttccagttttcagtacctcatagtggcaattgccttttcaaaaggaaaacccttcaggcaaccttgctacaaaaattatttttttgttttttctgtgatttttttatatatttttatattattcatcatgttgtatccagttgcctctgttgaccaggttcttcagatagtgtgtgtaccatatcagtggcgtgtaactatgctcatcattgttcttgtcaatgcctttgtgtctatcacagtggaggagtcagtggatcggtggggaaaatgctgcttaccctgggccctgggctgtagaaagaagacaccaaaggcaaagtacatgtatctggcgcaggagctcttggttgatccagaatggccaccaaaacctcagacaaccacagaagctaaagctttagttaaggagaatggatcatgtcaaatcatcaccataacatagcagtgaatcagtctcagtggtattgctgatagcagtattcaggaatatgtgattttaggagtttctgatcctgtgtgtcagaatggcactagttcagtttatgtcccttctgatatagtagcttatttgacagctttgctcttccttaaaataaaaacagaaaaatatatcgtcctaacagttaaattaacaatcaatccataaagtcctatatcttcattcagcaacccaaatattacatacatttccagaattttcttgattgttactttcagtgatattctttatattgggtacaggagaagtttggtgtttggtaggtttttcaacattagtttttgagactagtttacctcttcacatttatgctcacaaccctcttgttagaaaagtctgtgtttatatacaggctgtaagtttgtgattgataaaaagaagatgagtgttaattagcctccagtgaaaatatactgaaagcctgttttcatttgattccaatgtttcttccaaagaattctgtataaacatatgccaattccctatgatggtctagagttaggaatgagtgtttatggtgttgcttatagaacaactcaggtaatctccatttctggttttatattttctgtacaaactgcctgggttttatttttctaatcagcaaggtgcttcactgccttcttgagacgcctctcaaagctcttaaatggctcctgtgctatgtgtggtgttggcagtctaatttgcttctgttaaatgttgtagaacctttttcactaggaaataagattcatttctttcggcagtagatgtagattcatcttttaacgtttcttcaaatttgtttctgtcaggctttgtgttattttaaatggttttttaaaattttcttctatgttttcaattacctaaagacataggataatagttttttttaagttagaattttacctcataaaattttttgaggtttgatgtatgtctctgtcttatcaataatgaggcttaaaaaatactggatttgaatggctgccgttttttcaaagcaatatgaatttgatgagtttgttttatgccattaggtggcgccagaggtcagaacatgtctattttgaattggatcgttacaaatgagcatatttgatgcggaaatttctgggagaaaaaaaattgaggaaataaagttaaaaaattgacattcattgagccaaaagagatgtggagaaacatttttcacctttctgtttggcctgattaacatttaaattcttgccaaaattaaggtaacttttaaaaaacaccttttataggtggatccagcagtctggcaacgcccacagttaccacaacacagaaaactgatcgtgctataaaatggacgctaaactatgaaaacagtgtgacattgttctctgttcttccagagccagtaacatgcttgctcgtgctttctacttctagctgatcattcttttcccaacatatatttacaaatttaccaaattttacctagaattttaggaccaaatggttctcactctttatgctgcaaagacctggatgatgtttggtaactatagaaaaatagaaattacactcaggatcactgttactgctattgccactgatgattcctgcaaaaatataatcgaagttttccatcaaatgtataatatgctattaatacacattagatgataacagttgttccatgaatgattctatgaagctatgcatcttagacctcttgagctgtgaattagcactattttctatagttacttattctctggatcattttataatttccatattaatttcaaatatgctcgtgttattcttcagtgatttccacaattgtgcattttattctttggtttaagtactgaagcatataatgaaagtaattgctaagtagcagcttaaaaattcaattatccgattgtatttaacatctttaagagcatgatcataaagagctatttttgacaccccccccccacttttttaacatttagagttagtaagggttttatatctcttctgtccatattgttttcaaaggaatgaggtgtttaggtggctggaaaagcatttgtaggaagttagatttgaatatagacaaggtgggttattcacgttgagaatgttatttgaagaatgcctgtgaagccaggtgtgggttctactcagtgccatagatagactgagtcttctctcgtaggttaccattacatagtaattttgattctgaatttcacattaaattatttgagtttatacagacctaaattttaaaatctgtacatatattattttgatgtattaagatgaatattgctgatttaaattttatttatgcacatacttaaaggacagaaatgtctgggaaagtaattgttaaataatgatatgtaactttttaactttttaaataaataacaagatttttaatgtgtgtctccctcagggttgtttaaagttttttttctccctcaagtataaatagtggtaactatatgttttgtatcttctagcaccaactgctgtaaagcaatgctgcaaataatgcttgaatacaagtggctaagccaacaacagaataaatacttttatagtagttttataatcctgaaattcgaaagctttcccaattgcacttgcatctaaacaaaactgttgcagtttttactctatttattttgttccccatgtttatgaaagtcctgcacagtttcaaaggcatggtaaataatatatcaatgtttatgtagtctgttacagaaacagctatagataacattatccagtgaagagcaaaattcaagctttagaaaatattcatgcatgcaattttgacatatctaaaaataggtttttgtatatttatggtgggaggtggttgggaacttttaacaaaatggggtgttaatttttgtacagtctgtgggcatttacacatttttaatgtattaaaatttggtaattatgtgtacattaaattaataaaagttacttctagttatgatttgtgaattccctaagaccttggatttttttaagtaactttatatcagaaatgatactgcatctttatatttttaaaattgtattgctgctcaagaatggtaccctcttgtcaaaaaggcatacattcataattgtacattcagcattgtaaataatcttatgaaaccttttttgattgaagctattcaaaataaaaattttaatgaatg

SEQ ID NO: 109644 - DNA, 3729 bp, Homo sapiens
  Payload ID: 1534
  Gene Symbol: ATP13A3
  Gene Name: ATPase type 13A3
  ENST ID: ENST00000429136
  CDS Start-End: 1-487
acccttcaggcaaccttgctacaaaaattatttttttgttttttctgtgatttttttatatatttttatattattcatcatgttgtatccagttgcctctgttgaccaggttcttcagatagtgtgtgtaccatatcagtggcgtgtaactatgctcatcattgttcttgtcaatgcctttgtgtctatcacagtggagaacttcttccttgacatggtcctttggaaagttgtgttcaaccgagacaaacaaggagagtatcggttcagcaccacacagccaccgcaggagtcagtggatcggtggggaaaatgctgcttaccctgggccctgggctgtagaaagaagacaccaaaggcaaagtacatgtatctggcgcaggagctcttggttgatccagaatggccaccaaaacctcagacaaccacagaagctaaagctttagttaaggagaatggatcatgtcaaatcatcaccataacatagcagtgaatcagtctcagtggtattgctgatagcagtattcaggaatatgtgattttaggagtttctgatcctgtgtgtcagaatggcactagttcagtttatgtcccttctgatatagtagcttatttgacagctttgctcttccttaaaataaaaacagaaaaatatatcgtcctaacagttaaattaacaatcaatccataaagtcctatatcttcattcagcaacccaaatattacatacatttccagaattttcttgattgttactttcagtgatattctttatattgggtacaggagaagtttggtgtttggtaggtttttcaacattagtttttgagactagtttacctcttcacatttatgctcacaaccctcttgttagaaaagtctgtgtttatatacaggctgtaagtttgtgattgataaaaagaagatgagtgttaattagcctccagtgaaaatatactgaaagcctgttttcatttgattccaatgtttcttccaaagaattctgtataaacatatgccaattccctatgatggtctagagttaggaatgagtgtttatggtgttgcttatagaacaactcaggtaatctccatttctggttttatattttctgtacaaactgcctgggttttatttttctaatcagcaaggtgcttcactgccttcttgagacgcctctcaaagctcttaaatggctcctgtgctatgtgtggtgttggcagtctaatttgcttctgttaaatgttgtagaacctttttcactaggaaataagattcatttctttcggcagtagatgtagattcatcttttaacgtttcttcaaatttgtttctgtcaggctttgtgttattttaaatggttttttaaaattttcttctatgttttcaattacctaaagacataggataatagttttttttaagttagaattttacctcataaaattttttgaggtttgatgtatgtctctgtcttatcaataatgaggcttaaaaaatactggatttgaatggctgccgttttttcaaagcaatatgaatttgatgagtttgttttatgccattaggtggcgccagaggtcagaacatgtctattttgaattggatcgttacaaatgagcatatttgatgcggaaatttctgggagaaaaaaaattgaggaaataaagttaaaaaattgacattcattgagccaaaagagatgtggagaaacatttttcacctttctgtttggcctgattaacatttaaattcttgccaaaattaaggtaacttttaaaaaacaccttttataggtggatccagcagtctggcaacgcccacagttaccacaacacagaaaactgatcgtgctataaaatggacgctaaactatgaaaacagtgtgacattgttctctgttcttccagagccagtaacatgcttgctcgtgctttctacttctagctgatcattcttttcccaacatatatttacaaatttaccaaattttacctagaattttaggaccaaatggttctcactctttatgctgcaaagacctggatgatgtttggtaactatagaaaaatagaaattacactcaggatcactgttactgctattgccactgatgattcctgcaaaaatataatcgaagttttccatcaaatgtataatatgctattaatacacattagatgataacagttgttccatgaatgattctatgaagctatgcatcttagacctcttgagctgtgaattagcactattttctatagttacttattctctggatcattttataatttccatattaatttcaaatatgctcgtgttattcttcagtgatttccacaattgtgcattttattctttggtttaagtactgaagcatataatgaaagtaattgctaagtagcagcttaaaaattcaattatccgattgtatttaacatctttaagagcatgatcataaagagctatttttgacaccccccccccacttttttaacatttagagttagtaagggttttatatctcttctgtccatattgttttcaaaggaatgaggtgtttaggtggctggaaaagcatttgtaggaagttagatttgaatatagacaaggtgggttattcacgttgagaatgttatttgaagaatgcctgtgaagccaggtgtgggttctactcagtgccatagatagactgagtcttctctcgtaggttaccattacatagtaattttgattctgaatttcacattaaattatttgagtttatacagacctaaattttaaaatctgtacatatattattttgatgtattaagatgaatattgctgatttaaattttatttatgcacatacttaaaggacagaaatgtctgggaaagtaattgttaaataatgatatgtaactttttaactttttaaataaataacaagatttttaatgtgtgtctccctcagggttgtttaaagttttttttctccctcaagtataaatagtggtaactatatgttttgtatcttctagcaccaactgctgtaaagcaatgctgcaaataatgcttgaatacaagtggctaagccaacaacagaataaatacttttatagtagttttataatcctgaaattcgaaagctttcccaattgcacttgcatctaaacaaaactgttgcagtttttactctatttattttgttccccatgtttatgaaagtcctgcacagtttcaaaggcatggtaaataatatatcaatgtttatgtagtctgttacagaaacagctatagataacattatccagtgaagagcaaaattcaagctttagaaaatattcatgcatgcaattttgacatatctaaaaataggtttttgtatatttatggtgggaggtggttgggaacttttaacaaaatggggtgttaatttttgtacagtctgtgggcatttacacatttttaatgtattaaaatttggtaattatgtgtacattaaattaataaaagttacttctagttatgatttgtgaattccctaagaccttggatttttttaagtaactttatatcagaaatgatactgcatctttatatttttaaaattgtattgctgctcaagaatggtaccctcttgtcaaaaaggcatacattcataattgtacattcagcattgtaaataatcttatgaaaccttttttgattgaagctattcaaaataaaaattttaatgaatgaaa

SEQ ID NO: 109645 - DNA, 490 bp, Homo sapiens
  Payload ID: 1534
  Gene Symbol: ATP13A3
  Gene Name: ATPase type 13A3
  ENST ID: ENST00000457986
  CDS Start-End: 183-490
gcggcggccgggtcccccgcggtccctggggctggtccggccgcgagggaggccgcggaggaggcggcgcggcggcggccagtgagcggccccgatctgacagacatccctgaatcttggtgtttggacataggagtgatcttccattgtttgaagcactggacctttaatccactgtaggtatggacagggaagaaaggaagaccatcaatcagggtcaagaagatgaaatggagatttatggttacaatttgagtcgctggaagcttgccatagtttctttaggagtgatttgctctggtgggtttctcctcctcctcctctattggatgcctgagtggcgggtgaaagcgacctgtgtcagagctgcaattaaagactgtgaagtagtgctgctgaggactactgatgaattcaaaatgtggttttgtgcaaaaattcgcgttctttctttggaaacttacccagtttcaagtccaaaatctatgtc

SEQ ID NO: 109646 - DNA, 542 bp, Homo sapiens
  Payload ID: 1534
  Gene Symbol: ATP13A3
  Gene Name: ATPase type 13A3
  ENST ID: ENST00000446356
  CDS Start-End: 403-542
tttattcaaataataggagctctacgagtgacagatggcagaagggcacatcttctgaaaacttactaaaaattggtgaattacaaaattctaaattttaataccttaatcattttgaaagcagttcagacagaaccgaaacagaaatatttggcataaaattccaaatttttatgcttagttttatttttattattaaaagccagcttttgaaagctgtgcaaatatcaggaattgggaagaatgatgatatagtgctactggtaagaaaaatttcttcaatttgttttctctgatatcgaatttgacttggttaaaaaacgtgtgctccagcagtccagaaaagttatatttcttgatcttccattgtttgaagcactggacctttaatccactgtaggtatggacagggaagaaaggaagaccatcaatcagggtcaagaagatgaaatggagatttatggttacaatttgagtcgctggaagcttgccatagtttctttaggagtgatttgctctggtgggtttctcctcctcctcct

SEQ ID NO: 109647 - DNA, 7720 bp, Homo sapiens
  Payload ID: 1534
  Gene Symbol: ATP13A3
  Gene Name: ATPase type 13A3
  Uniprot ID: Q9H7F0
  ENST ID: ENST00000439040
  CDS Start-End: 793-4473
cttctgcctcagcctgagtagctgggatgggactacagatgcacgccaccacacatggctaatttttttattttttagagacgaggtcccatgtgagccacggtgccccaccttttaaagcaattaccgtaaggaagcaactgtctttagcaaatagaagatcataaacatccttctggagatcttgagatgttgactgtggtttatagggcaatgaaaatctacatacctgagtggggcagtgagacatgagtgccacctatgatccttccagtgagcaattctttctggtgccaggagcccaaaggaaactcagtcaaccagctgtagatgggcttgttccgagtttgttctagaagtcagaactgccagctctgaaagtaggtcacaagtgactggccatccctgggctgctcacaggaagtagctgcaaaggtcagggaaagtttttaatgactatacaggccagtgaatgacaggctttgaggagcttctcttcttggcatctgaaacagcatactttctgactaccgctgtgtgctgtgaggggctgaggatccagatgtggctgaggaaggtcctggctcatgaggaggtggaagtctgggtgcttaaacagataatccagagttttgatgcgagatgaactcattctggtgaatcactctggcttcatttggttatagtggtcaagagtttggccctggagcaaagtgtctgggtttgaatcctggctgtgctttcggtgatcttccattgtttgaagcactggacctttaatccactgtaggtatggacagggaagaaaggaagaccatcaatcagggtcaagaagatgaaatggagatttatggttacaatttgagtcgctggaagcttgccatagtttctttaggagtgatttgctctggtgggtttctcctcctcctcctctattggatgcctgagtggcgggtgaaagcgacctgtgtcagagctgcaattaaagactgtgaagtagtgctgctgaggactactgatgaattcaaaatgtggttttgtgcaaaaattcgcgttctttctttggaaacttacccagtttcaagtccaaaatctatgtctaataagctttcaaatggccatgcagtttgtttaattgagaatcccactgaagaaaataggcacaggatcagtaaatattcacagactgaatcacaacagattcgttatttcacccaccatagtgtaaaatatttctggaatgataccattcacaattttgatttcttaaagggactggatgaaggtgtttcttgtacgtcaatttatgaaaagcatagtgcaggactgacaaaggggatgcatgcctacagaaaactgctttatggagtaaatgaaattgctgtaaaagtgccttctgtttttaagcttctaattaaagaggttctcaacccattttacattttccagctgttcagtgttatactgtggagcactgatgaatactattactatgctctagctattgtggttatgtccatagtatcaatcgtaagctcactatattccattagaaagcaatatgttatgttgcatgacatggtggcaactcatagtaccgtaagagtttcagtttgtagagtaaatgaagaaatagaagaaatcttttctaccgaccttgtgccaggagatgtcatggtcattccattaaatgggacaataatgccttgtgatgctgtgcttattaatggtacctgcattgtaaacgaaagcatgttaacaggagaaagtgttccagtgacaaagactaatttgccaaatccttcagtggatgtgaaaggaataggagatgaattatataatccagaaacacataaacgacatactttgttttgtgggacaactgttattcagactcgtttctacactggagaactcgtcaaagccatagttgttagaacaggatttagtacttccaaaggacagcttgttcgttccatattgtatcccaaaccaactgattttaaactctacagagatgcctacttgtttctactatgtcttgtggcagttgctggcattgggtttatctacactattattaatagcattttaaatgaggtacaagttggggtcataattatcgagtctcttgatattatcacaattactgtgccccctgcacttcctgctgcaatgactgctggtattgtgtatgctcagagaagactgaaaaaaatcggtattttctgtatcagtcctcaaagaataaatatttgtggacagctcaatcttgtttgctttgacaagactggaactctaactgaagatggtttagatctttgggggattcaacgagtggaaaatgcacgatttctttcaccagaagaaaatgtgtgcaatgagatgttggtaaaatcccagtttgttgcttgtatggctacttgtcattcacttacaaaaattgaaggagtgctctctggtgatccacttgatctgaaaatgtttgaggctattggatggattctggaagaagcaactgaagaagaaacagcacttcataatcgaattatgcccacagtggttcgtcctcccaaacaactgcttcctgaatctacccctgcaggaaaccaagaaatggagctgtttgaacttccagctacttatgagataggaattgttcgccagttcccattttcttctgctttgcaacgtatgagtgtggttgccagggtgctgggggataggaaaatggacgcctacatgaaaggagcgcccgaggccattgccggtctctgtaaacctgaaacagttcctgtcgattttcaaaacgttttggaagacttcactaaacagggcttccgtgtgattgctcttgcacacagaaaattggagtcaaaactgacatggcataaagtacagaatattagcagagatgcaattgagaacaacatggattttatgggattaattataatgcagaacaaattaaagcaagaaacccctgcagtacttgaagatttgcataaagccaacattcgcaccgtcatggtcacaggtgacagtatgttgactgctgtctctgtggccagagattgtggaatgattctacctcaggataaagtgattattgctgaagcattacctccaaaggatgggaaagttgccaaaataaattggcattatgcagactccctcacgcagtgcagtcatccatcagcaattgacccagaggctattccggttaaattggtccatgatagcttagaggatcttcaaatgactcgttatcattttgcaatgaatggaaaatcattctcagtgatactggagcattttcaagaccttgttcctaagttgatgttgcatggcaccgtgtttgcccgtatggcacctgatcagaagacacagttgatagaagcattgcaaaatgttgattattttgttgggatgtgtggtgatggcgcaaatgattgtggtgctttgaagagggcacacggaggcatttccttatcggagctcgaagcttcagtggcatctccctttacctctaagactcctagtatttcctgtgtgccaaaccttatcagggaaggccgtgctgctttaataacttccttctgtgtgtttaaattcatggcattgtacagcattatccagtacttcagtgttactctgctgtattctatcttaagtaacctaggagacttccagtttctcttcattgatctggcaatcattttggtagtggtatttacaatgagtttaaatcctgcctggaaagaacttgtggcacaaagaccaccttcgggtcttatatctggggcccttctcttctccgttttgtctcagattatcatctgcattggatttcaatctttgggttttttttgggtcaaacagcaaccttggtatgaagtgtggcatccaaaatcagatgcttgtaatacaacaggaagcgggttttggaattcttcacacgtagacaatgaaaccgaacttgatgaacataatatacaaaattatgaaaataccacagtgttttttatttccagttttcagtacctcatagtggcaattgccttttcaaaaggaaaacccttcaggcaaccttgctacaaaaattatttttttgttttttctgtgatttttttatatatttttatattattcatcatgttgtatccagttgcctctgttgaccaggttcttcagatagtgtgtgtaccatatcagtggcgtgtaactatgctcatcattgttcttgtcaatgcctttgtgtctatcacagtggaggagtcagtggatcggtggggaaaatgctgcttaccctgggccctgggctgtagaaagaagacaccaaaggcaaagtacatgtatctggcgcaggagctcttggttgatccagaatggccaccaaaacctcagacaaccacagaagctaaagctttagttaaggagaatggatcatgtcaaatcatcaccataacatagcagtgaatcagtctcagtggtattgctgatagcagtattcaggaatatgtgattttaggagtttctgatcctgtgtgtcagaatggcactagttcagtttatgtcccttctgatatagtagcttatttgacagctttgctcttccttaaaataaaaacagaaaaatatatcgtcctaacagttaaattaacaatcaatccataaagtcctatatcttcattcagcaacccaaatattacatacatttccagaattttcttgattgttactttcagtgatattctttatattgggtacaggagaagtttggtgtttggtaggtttttcaacattagtttttgagactagtttacctcttcacatttatgctcacaaccctcttgttagaaaagtctgtgtttatatacaggctgtaagtttgtgattgataaaaagaagatgagtgttaattagcctccagtgaaaatatactgaaagcctgttttcatttgattccaatgtttcttccaaagaattctgtataaacatatgccaattccctatgatggtctagagttaggaatgagtgtttatggtgttgcttatagaacaactcaggtaatctccatttctggttttatattttctgtacaaactgcctgggttttatttttctaatcagcaaggtgcttcactgccttcttgagacgcctctcaaagctcttaaatggctcctgtgctatgtgtggtgttggcagtctaatttgcttctgttaaatgttgtagaacctttttcactaggaaataagattcatttctttcggcagtagatgtagattcatcttttaacgtttcttcaaatttgtttctgtcaggctttgtgttattttaaatggttttttaaaattttcttctatgttttcaattacctaaagacataggataatagttttttttaagttagaattttacctcataaaattttttgaggtttgatgtatgtctctgtcttatcaataatgaggcttaaaaaatactggatttgaatggctgccgttttttcaaagcaatatgaatttgatgagtttgttttatgccattaggtggcgccagaggtcagaacatgtctattttgaattggatcgttacaaatgagcatatttgatgcggaaatttctgggagaaaaaaaattgaggaaataaagttaaaaaattgacattcattgagccaaaagagatgtggagaaacatttttcacctttctgtttggcctgattaacatttaaattcttgccaaaattaaggtaacttttaaaaaacaccttttataggtggatccagcagtctggcaacgcccacagttaccacaacacagaaaactgatcgtgctataaaatggacgctaaactatgaaaacagtgtgacattgttctctgttcttccagagccagtaacatgcttgctcgtgctttctacttctagctgatcattcttttcccaacatatatttacaaatttaccaaattttacctagaattttaggaccaaatggttctcactctttatgctgcaaagacctggatgatgtttggtaactatagaaaaatagaaattacactcaggatcactgttactgctattgccactgatgattcctgcaaaaatataatcgaagttttccatcaaatgtataatatgctattaatacacattagatgataacagttgttccatgaatgattctatgaagctatgcatcttagacctcttgagctgtgaattagcactattttctatagttacttattctctggatcattttataatttccatattaatttcaaatatgctcgtgttattcttcagtgatttccacaattgtgcattttattctttggtttaagtactgaagcatataatgaaagtaattgctaagtagcagcttaaaaattcaattatccgattgtatttaacatctttaagagcatgatcataaagagctatttttgacaccccccccccacttttttaacatttagagttagtaagggttttatatctcttctgtccatattgttttcaaaggaatgaggtgtttaggtggctggaaaagcatttgtaggaagttagatttgaatatagacaaggtgggttattcacgttgagaatgttatttgaagaatgcctgtgaagccaggtgtgggttctactcagtgccatagatagactgagtcttctctcgtaggttaccattacatagtaattttgattctgaatttcacattaaattatttgagtttatacagacctaaattttaaaatctgtacatatattattttgatgtattaagatgaatattgctgatttaaattttatttatgcacatacttaaaggacagaaatgtctgggaaagtaattgttaaataatgatatgtaactttttaactttttaaataaataacaagatttttaatgtgtgtctccctcagggttgtttaaagttttttttctccctcaagtataaatagtggtaactatatgttttgtatcttctagcaccaactgctgtaaagcaatgctgcaaataatgcttgaatacaagtggctaagccaacaacagaataaatacttttatagtagttttataatcctgaaattcgaaagctttcccaattgcacttgcatctaaacaaaactgttgcagtttttactctatttattttgttccccatgtttatgaaagtcctgcacagtttcaaaggcatggtaaataatatatcaatgtttatgtagtctgttacagaaacagctatagataacattatccagtgaagagcaaaattcaagctttagaaaatattcatgcatgcaattttgacatatctaaaaataggtttttgtatatttatggtgggaggtggttgggaacttttaacaaaatggggtgttaatttttgtacagtctgtgggcatttacacatttttaatgtattaaaatttggtaattatgtgtacattaaattaataaaagttacttctagttatgatttgtgaattccctaagaccttggatttttttaagtaactttatatcagaaatgatactgcatctttatatttttaaaattgtattgctgctcaagaatggtaccctcttgtcaaaaaggcatacattcataattgtacattcagcattgtaaataatcttatgaaaccttttttgattgaagctattcaaaataaaaattttaatgaatgaaataaca

SEQ ID NO: 109648 - DNA, 5227 bp, Homo sapiens
  Payload ID: 1534
  Gene Symbol: ATP13A3
  Gene Name: ATPase type 13A3
  ENST ID: ENST00000619199
  CDS Start-End: 1759-3864
aaaatacttgccctttggaaaaaaatcattctggcgtccacattcagactggtttagaggagagtaatactgaagacatgcccccccgaatcaaggtagcaattgcggagatgaaaagaaatgagttcaaaagatacttaaatgtgaccattgaacaggatttgactcattggatatgaggccatggagcagtgtctggctaggtggatggatgttggtgctgtttagttaaataggaaactggaagagaagcaggcttgcaagaatggtaatattttggacgtgtaacttgtctggcaagatgttgaagaggtaaaggaggcagcacagcatcatgggccttggaggcagaagccgctttgatttactcagaacaccaaatcagtctccattttcttgactcagactacacccaagagattgcttccttccctgtgcttcctggccacttgctactctagctaggaagatctgcctcccttagctgaagtctaagatgtgtagcttattgatgcctctcctcttcttgttctgctgttgctgaatataatggggatgccagggcagacataccattcaacttgaatcttccttacccactttgtatagtcttacatgtcattgataccttgttttctggtacgcctaaaaggagtagaacttcaagtggtatttaaaagctttaagaaaagtcaaatttttacttttttcttcccatctgaggaatggatttattttctttttaaagaaatccaaatttttaaaagaagggatcttatttttaaaacgaagatcgataatatctactatgtactaaatgtcattctttaaaagttgttccctcataatttagtaaattacttccttttttaaaaaaaggaaagaaagagtgtttgtcttacaggctaacatcacaaacaataagtttcttctcatccatctccatttataaactagtgtgactgtcttctgagcacagtattaaacctggacagggagagggagggtgttagagaatgagaggaaaagagagagaatacctacatataaggtgaccctaaagaaaagcctttcacccttcggaagatcttttcattttcatttttctttttttcaaacaccaacttgtaccagagggaagatctttttttaaaagtgtttcactaaaatttgtaaggaaataatgagctagataaaatattacagtgtttatttaatgaatttactcatatttaaaataatatctaaaaagagtaatttaggaatattgaggcaatgagacttgaaggttataaatagtggcagtgagaaaaggaatattatagataagctgttgaaaagaaaagatgctaagttttctagtgcttccttctgtttccaagggattatagaaatcggagtttgtttgacctgtttcacaggcatctcctttgtggactcattgtgtctcttccttaggctaatagtcaccatttatcatggacggttgtcatgagtgttgaagcacacttaacctgcttcgtcagagggtacttggcatcaccggtgcacagctggtgtcctagcaggagactaactagctgacacaccgtgctttgttagcctaataatcttatttgttaaaacttgccatttgttggatttttctattttaccccattataaacttcttattgagatcagatgacttctgaatagcatttgctgtatttttccaaggtaaagaatatctttttcagatttttctttctttctttaatttcagaaatagaagaaatcttttctaccgaccttgtgccaggagatgtcatggtcattccattaaatgggacaataatgccttgtgatgctgtgcttattaatggtacctgcattgtaaacgaaagcatgttaacaggagaaagtgttccagtgacaaagactaatttgccaaatccttcagtggatgtgaaaggaataggagatgaattatataatccagaaacacataaacgacatactttgttttgtgggacaactgttattcagactcgtttctacactggagaactcgtcaaagccatagttgttagaacaggatttagtacttccaaaggacagcttgttcgttccatattgtatcccaaaccaactgattttaaactctacagagatgcctacttgtttctactatgtcttgtggcagttgctggcattgggtttatctacactattattaatagcattttaaatgaggtacaagttggggtcataattatcgagtctcttgatattatcacaattactgtgccccctgcacttcctgctgcaatgactgctggtattgtgtatgctcagagaagactgaaaaaaatcggtattttctgtatcagtcctcaaagaataaatatttgtggacagctcaatcttgtttgctttgacaagactggaactctaactgaagatggtttagatctttgggggattcaacgagtggaaaatgcacgatttctttcaccagaagaaaatgtgtgcaatgagatgttggtaaaatcccagtttgttgcttgtatggctacttgtcattcacttacaaaaattgaaggagtgctctctggtgatccacttgatctgaaaatgtttgaggctattggatggattctggaagaagcaactgaagaagaaacagcacttcataatcgaattatgcccacagtggttcgtcctcccaaacaactgcttcctgaatctacccctgcaggaaaccaagaaatggagctgtttgaacttccagctacttatgagataggaattgttcgccagttcccattttcttctgctttgcaacgtatgagtgtggttgccagggtgctgggggataggaaaatggacgcctacatgaaaggagcgcccgaggccattgccggtctctgtaaacctgaaacagttcctgtcgattttcaaaacgttttggaagacttcactaaacagggcttccgtgtgattgctcttgcacacagaaaattggagtcaaaactgacatggcataaagtacagaatattagcagagatgcaattgagaacaacatggattttatgggattaattataatgcagaacaaattaaagcaagaaacccctgcagtacttgaagatttgcataaagccaacattcgcaccgtcatggtcacaggtgacagtatgttgactgctgtctctgtggccagagattgtggaatgattctacctcaggataaagtgattattgctgaagcattacctccaaaggatgggaaagttgccaaaataaattggcattatgcagactccctcacgcagtgcagtcatccatcagcaattgacccagaggctattccggttaaattggtccatgatagcttagaggatcttcaaatgactcgttatcattttgcaatgaatggaaaatcattctcagtgatactggagcattttcaagaccttgttcctaagttgatgttgcatggcaccgtgtttgcccgtatggcacctgatcagaagacacagttgatagaagcattgcaaaatgttgattattttgttgggatgtgtggtgatggcgcaaatgattgtggtgctttgaagagggcacacggaggcatttccttatcggagctcgaagcttcagtggcatctccctttacctctaagactcctagtatttcctgtgtgccaaaccttatcagggaaggccgtgctgctttaataacttccttctgtgaattagcactattttctatagttacttattctctggatcattttataatttccatattaatttcaaatatgctcgtgttattcttcagtgatttccacaattgtgcattttattctttggtttaagtactgaagcatataatgaaagtaattgctaagtagcagcttaaaaattcaattatccgattgtatttaacatctttaagagcatgatcataaagagctatttttgacaccccccccccacttttttaacatttagagttagtaagggttttatatctcttctgtccatattgttttcaaaggaatgaggtgtttaggtggctggaaaagcatttgtaggaagttagatttgaatatagacaaggtgggttattcacgttgagaatgttatttgaagaatgcctgtgaagccaggtgtgggttctactcagtgccatagatagactgagtcttctctcgtaggttaccattacatagtaattttgattctgaatttcacattaaattatttgagtttatacagacctaaattttaaaatctgtacatatattattttgatgtattaagatgaatattgctgatttaaattttatttatgcacatacttaaaggacagaaatgtctgggaaagtaattgttaaataatgatatgtaactttttaactttttaaataaataacaagatttttaatgtgtgtctccctcagggttgtttaaagttttttttctccctcaagtataaatagtggtaactatatgttttgtatcttctagcaccaactgctgtaaagcaatgctgcaaataatgcttgaatacaagtggctaagccaacaacagaataaatacttttatagtagttttataatcctgaaattcgaaagctttcccaattgcacttgcatctaaacaaaactgttgcagtttttactctatttattttgttccccatgtttatgaaagtcctgcacagtttcaaaggcatggtaaataatatatcaatgtttatgtagtctgttacagaaacagctatagataacattatccagtgaagagcaaaattcaagctttagaaaatattcatgcatgcaattttgacatatctaaaaataggtttttgtatatttatggtgggaggtggttgggaacttttaacaaaatggggtgttaatttttgtacagtctgtgggcatttacacatttttaatgtattaaaatttggtaattatgtgtacattaaattaataaaagttacttctagttatgatttgtgaattccctaagaccttggatttttttaagtaactttatatcagaaatgatactgcatctttatatttttaaaattgtattgctgctcaagaatggtaccctcttgtcaaaaaggcatacattcataattgtacattcagcattgtaaataatcttatgaaaccttttttgattgaagctattcaaaataaaaattttaatgaatgaaataa

SEQ ID NO: 109649 - DNA, 2157 bp, Homo sapiens
  Payload ID: 1535
  Gene Symbol: ATP13A4
  Gene Name: ATPase type 13A4
  Uniprot ID: Q4VNC1
  ENST ID: ENST00000295548
  CDS Start-End: 1-1731
atgggacactttgagaagggccagcacgctctgctcaatgaaggagaagagaatgagatggagatatttggctatcggactcaaggctgccggaaaagtctctgccttgccggatccatcttctcatttggaatcctccccttggtgttttactggagaccagcatggcacgtatgggcacattgtgtcccatgttccttgcaagaagcagacactgtgttgctgaggacaacggatgaattccaaatttactcttggaaaaaggtaatatggatctacctgtcagcattaaacagcgcatttggtctcactcctgaccaccctctcatgacagatgaggagtatatcataaatagagccataagaaagccagacctaaaggtgagatgcatcaaagtgcagaaaataagatatgtttggaactacttagaaggacagttccagaaaattggttctttggaagactggcttagttctgccaagatacatcaaaaatttggatcaggcttgacaagagaagaacaggagattaggaggttaatatgtgggcctaatactatcgatgttgaagttacaccaatttggaaactgctcatcaaggaggttctaaatccattttatatatttcaactcttcagtgtctgtttgtggtttagtgaagactataaggaatatgcttttgccatcataatcatgtccataatttccatatctttgacagtatatgatctcagagagcaatctgtaaaactccaccatctcgtcgagtcacataatagcattacggtctctgtatgtgggagaaaagctggagttcaagagctggaatcacgcgtcctggtgcctggagatttattaattttgacagggaacaaagtgctaatgccatgtgatgccgttctgattgaaggcagctgtgtggtggatgaaggcatgctgacaggagaaagtattccagtcaccaaaactccgttacccaagatggatagctctgtgccctggaaaacacagagtgaagcggattacaagcggcatgtcctcttctgtggaacagaggttatccaggccaaggcagcttgctctgggaccgtgagagccgtggtactgcagactggattcaacactgcaaagggagaccttgtgagatccattctctaccctaagccagtgaattttcagttgtacagggatgccatcaggttcctcctgtgccttgtaggaacagccaccattgggatgatctatactctgtgtgtctatgtgcttagtggggaacctccagaggaggtggtgaggaaagcccttgacgtcatcacaattgcggttcctccggctctacctgctgctctgaccacaggcattatctatgcccagaggaggctgaagaagagaggcatcttctgcattagcccccagaggatcaacgtatgtggacagttaaaccttgtctgctttgacaagacaggcaccttaacaagggacggcttggacctctggggagtcgtgtcctgtgataggaatggctttcaggaagttcacagctttgcctcaggccaggctttgccatggggcccactgtgtgcagcgatggccagctgccactctctgatccttcttgatgggaccatccagggagaccctctggacctcaaaatgtttgaagccaccacctgggtaagcctctgctcttcagagaatctgagaagcttcttcaatgccagagcaacataggcaatatcagagctatctaattcttataaaaggtgaggtttccaatgtggagtacatttggtagtgaagggcaaaccaatctaaggctggtttcctcatctgtgcaatgaagctaataatagcatctacataatgagattgtgaggattaaatgagatgatgcagtaagaaaatccttggcactatgcctggcaaatattaaaggttcgatcatattaatataattgtacttattatgcagttatttcttgtctctctgtactgttctccgagcattgtctggtttcgaagattttccagaatatggggatcagaaaacattgctttctccagtgctcaggataactcatagattcacggggactataagtcttatttctattaatttcatattgattttatttccaagactagaaagaacaaaaa

SEQ ID NO: 109650 - DNA, 4208 bp, Homo sapiens
  Payload ID: 1535
  Gene Symbol: ATP13A4
  Gene Name: ATPase type 13A4
  Uniprot ID: Q4VNC1
  ENST ID: ENST00000342695
  CDS Start-End: 324-3914
aggcaatgagttctttccctgtaagttgggcacaaaaagatcggcatgggagcagcctcctttgagacagctgctctgagagaatgcaataagcagggagcagccagcaattcctcctagcagagggcgactcgtgggaggagttcagtttgccaagtattgtcatttgttgagagaaggtgtgtgctcaaggaggagttttaacctggaggatcattaactcttttagtcagctgaggagctgcggtggctcggcgagttggagttcatcctggaagcgtctgcacgacaaggtcagggaggaggtgtggaataactttttcatgggacactttgagaagggccagcacgctctgctcaatgaaggagaagagaatgagatggagatatttggctatcggactcaaggctgccggaaaagtctctgccttgccggatccatcttctcatttggaatcctccccttggtgttttactggagaccagcatggcacgtatgggcacattgtgtcccatgttccttgcaagaagcagacactgtgttgctgaggacaacggatgaattccaaatttactcttggaaaaaggtaatatggatctacctgtcagcattaaacagcgcatttggtctcactcctgaccaccctctcatgacagatgaggagtatatcataaatagagccataagaaagccagacctaaaggtgagatgcatcaaagtgcagaaaataagatatgtttggaactacttagaaggacagttccagaaaattggttctttggaagactggcttagttctgccaagatacatcaaaaatttggatcaggcttgacaagagaagaacaggagattaggaggttaatatgtgggcctaatactatcgatgttgaagttacaccaatttggaaactgctcatcaaggaggttctaaatccattttatatatttcaactcttcagtgtctgtttgtggtttagtgaagactataaggaatatgcttttgccatcataatcatgtccataatttccatatctttgacagtatatgatctcagagagcaatctgtaaaactccaccatctcgtcgagtcacataatagcattacggtctctgtatgtgggagaaaagctggagttcaagagctggaatcacgcgtcctggtgcctggagatttattaattttgacagggaacaaagtgctaatgccatgtgatgccgttctgattgaaggcagctgtgtggtggatgaaggcatgctgacaggagaaagtattccagtcaccaaaactccgttacccaagatggatagctctgtgccctggaaaacacagagtgaagcggattacaagcggcatgtcctcttctgtggaacagaggttatccaggccaaggcagcttgctctgggaccgtgagagccgtggtactgcagactggattcaacactgcaaagggagaccttgtgagatccattctctaccctaagccagtgaattttcagttgtacagggatgccatcaggttcctcctgtgccttgtaggaacagccaccattgggatgatctatactctgtgtgtctatgtgcttagtggggaacctccagaggaggtggtgaggaaagcccttgacgtcatcacaattgcggttcctccggctctacctgctgctctgaccacaggcattatctatgcccagaggaggctgaagaagagaggcatcttctgcattagcccccagaggatcaacgtatgtggacagttaaaccttgtctgctttgacaagacaggcaccttaacaagggacggcttggacctctggggagtcgtgtcctgtgataggaatggctttcaggaagttcacagctttgcctcaggccaggctttgccatggggcccactgtgtgcagcgatggccagctgccactctctgatccttcttgatgggaccatccagggagaccctctggacctcaaaatgtttgaagccaccacctgggaaatggctttttctggggacgatttccacatcaagggagtgccggcacatgccatggtagttaagccctgcagaacagccagccaggtcccagtggaaggaattgcaatcctgcatcagttcccattctcatcggcactgcaaagaatgacagtcattgtccaagagatgggaggtgaccgactggcattcatgaaaggtgcaccagagagggtggccagcttttgccaacctgagacagtacccactagttttgttagcgaacttcagatttacacgacacagggcttccgagtcatagcactggcctacaagaagctggaaaatgaccatcacgctactaccttgacgagggagacggtagaatcagacctgatatttctggggctgctgatcttggagaatcgattgaaggaagagacaaaacctgtcttggaagagctcatctcagcccggataaggactgtaatgatcacaggtgacaatcttcagactgcaataacagtggccagaaaatctggaatggtttctgaaagccagaaagtcattctcattgaggcaaatgaaaccaccgggtcctcatcagcatctatatcttggacgttagtagaagagaagaaacacattatgtatgggaatcaggacaattacattaacatcagggatgaagtctctgataaaggcagagaaggaagttaccattttgccctaactggaaaatcctttcatgttataagtcaacatttcagcagcctactgccaaagatattgatcaatgggaccatctttgcaagaatgtctcctgggcagaagtccagtctggtggaagaatttcagaaactggattactttgtaggtatgtgtggtgatggagccaatgactgtggggctctgaaaatggctcatgtgggcatctcattatcagagcaggaggcatctgtggcctcacctttcacttccaaaactccaaacattgagtgcgtacctcaccttatcaaggaaggacgtgcagctctcgttacctccttttgcatgtttaagtacatggctctgtacagcatgattcagtatgttggtgttctgctgctctactgggagacaaacagcctttcaaattaccagtttctgttccaggatctggccattacaactcttattggtgtaacaatgaatctgaatggtgcctaccctaagctggtgcctttcagacctgcaggacggctgatctctccacctctgctactctctgtgattttcaacattcttctcagcctggccatgcatattgcaggcttcatcctggttcagaggcagccttggtattccgtggagatacacagtgcctgcacagtacaaaatgaaagcatctcagagttaaccatgtctccaactgctccagaaaaaatggaaagtaatagcaccttcacaagttttgagaacactacagtctggttcttgggaacaatcaactgtatcactgtggctcttgtgttctctaaaggaaaaccatttagacagccaacttatacaaactatatatttgtccttgtgctgataatacagcttggtgtatgtctattcattctatttgctgatataccagaattatatagacgtttggatctgctctgcactcccgtcctgtggagggcctccattgtcatcatgctcagcttgaatttcattgtgtcccttgtggccgaggaggctgttattgaaaatcgagccctgtggatgatgattaaaagatgtttcggctatcagtcaaaaagccagtatcggatatggcagagggacttggcaaatgaccctagttggcccccgctaaaccaaacctcccactctgacatgccggagtgtggcagaggagtgtcttacagcaatccagtatttgagagcaatgaagaacaactctgaaggacatgtgatatccaagttgatattacagagaaacaatgacaaaagggaccagtttcattgattttaagaaatgagactcttgtaacatcagctggagttttggggctacctatcaaatcatggtgacaaactaaagtctgtttgataaaatactgtctacagagaagaacattgacccagaagagtgctttcctcttggcttctgaaggtattagaggcattcagtgaaggcaagaatgggccaagaatttctatgggccaagagacaagcaggctaaaggggaaaaatat

SEQ ID NO: 109651 - DNA, 4016 bp, Homo sapiens
  Payload ID: 1535
  Gene Symbol: ATP13A4
  Gene Name: ATPase type 13A4
  ENST ID: ENST00000392443
  CDS Start-End: 189-3722
gggaggagttcagtttgccaagtattgtcatttgttgagagaaggtgtgtgctcaaggaggagttttaacctggaggatcattaactcttttagtcagctgaggagctgcggtggctcggcgagttggagttcatcctggaagcgtctgcacgacaaggtcagggaggaggtgtggaataactttttcatgggacactttgagaagggccagcacgctctgctcaatgaaggagaagagaatgagatggagatatttggctatcggactcaaggctgccggaaaagtctctgccttgccggatccatcttctcatttggaatcctccccttggtgttttactggagaccagcatggcacgtatgggcacattgtgtcccatgttccttgcaagaagcagacactgtgttgctgaggacaacggatgaattccaaatttactcttggaaaaaggtaatatggatctacctgtcagcattaaacagcgcatttggtctcactcctgaccaccctctcatgacagatgaggagtatatcataaatagagccataagaaagccagacctaaaggtgagatgcatcaaagtgcagaaaataagatatgtttggaactacttagaaggacagttccagaaaattggttctttggaagactggcttagttctgccaagatacatcaaaaatttggatcaggcttgacaagagaagaacaggagattaggaggttaatatgtgggcctaatactatcgatgttgaagttacaccaatttggaaactgctcatcaaggaggttctaaatccattttatatatttcaactcttcagtgtctgtttgtggtttagtgaagactataaggaatatgcttttgccatcataatcatgtccataatttccatatctttgacagtatatgatctcagagagcaatctgtaaaactccaccatctcgtcgagtcacataatagcattacggtctctgtatgtgggagaaaagctggagttcaagagctggaatcacgcgtcctggtgcctggagatttattaattttgacagggaacaaagtgctaatgccatgtgatgccgttctgattgaaggcagctgtgtggtggatgaaggcatgctgacaggagaaagtattccagtcaccaaaactccgttacccaagatggatagctctgtgccctggaaaacacagagtgaagcggattacaagcggcatgtcctcttctgtggaacagaggttatccaggccaaggcagcttgctctgggaccgtgagagccgtggtactgcagactggattcaacactgcaaagggagaccttgtgagatccattctctaccctaagccagtgaattttcagttgtacagggatgccatcaggttcctcctgtgccttgaacctccagaggaggtggtgaggaaagcccttgacgtcatcacaattgcggttcctccggctctacctgctgctctgaccacaggcattatctatgcccagaggaggctgaagaagagaggcatcttctgcattagcccccagaggatcaacgtatgtggacagttaaaccttgtctgctttgacaagacaggcaccttaacaagggacggcttggacctctggggagtcgtgtcctgtgataggaatggctttcaggaagttcacagctttgcctcaggccaggctttgccatggggcccactgtgtgcagcgatggccagctgccactctctgatccttcttgatgggaccatccagggagaccctctggacctcaaaatgtttgaagccaccacctgggaaatggctttttctggggacgatttccacatcaagggagtgccggcacatgccatggtagttaagccctgcagaacagccagccaggtcccagtggaaggaattgcaatcctgcatcagttcccattctcatcggcactgcaaagaatgacagtcattgtccaagagatgggaggtgaccgactggcattcatgaaaggtgcaccagagagggtggccagcttttgccaacctgagacagtacccactagttttgttagcgaacttcagatttacacgacacagggcttccgagtcatagcactggcctacaagaagctggaaaatgaccatcacgctactaccttgacgagggagacggtagaatcagacctgatatttctggggctgctgatcttggagaatcgattgaaggaagagacaaaacctgtcttggaagagctcatctcagcccggataaggactgtaatgatcacaggtgacaatcttcagactgcaataacagtggccagaaaatctggaatggtttctgaaagccagaaagtcattctcattgaggcaaatgaaaccaccgggtcctcatcagcatctatatcttggacgttagtagaagagaagaaacacattatgtatgggaatcaggacaattacattaacatcagggatgaagtctctgataaaggcagagaaggaagttaccattttgccctaactggaaaatcctttcatgttataagtcaacatttcagcagcctactgccaaagatattgatcaatgggaccatctttgcaagaatgtctcctgggcagaagtccagtctggtggaagaatttcagaaactggattactttgtaggtatgtgtggtgatggagccaatgactgtggggctctgaaaatggctcatgtgggcatctcattatcagagcaggaggcatctgtggcctcacctttcacttccaaaactccaaacattgagtgcgtacctcaccttatcaaggaaggacgtgcagctctcgttacctccttttgcatgtttaagtacatggctctgtacagcatgattcagtatgttggtgttctgctgctctactgggagacaaacagcctttcaaattaccagtttctgttccaggatctggccattacaactcttattggtgtaacaatgaatctgaatggtgcctaccctaagctggtgcctttcagacctgcaggacggctgatctctccacctctgctactctctgtgattttcaacattcttctcagcctggccatgcatattgcaggcttcatcctggttcagaggcagccttggtattccgtggagatacacagtgcctgcacagtacaaaatgaaagcatctcagagttaaccatgtctccaactgctccagaaaaaatggaaagtaatagcaccttcacaagttttgagaacactacagtctggttcttgggaacaatcaactgtatcactgtggctcttgtgttctctaaaggaaaaccatttagacagccaacttatacaaactatatatttgtccttgtgctgataatacagcttggtgtatgtctattcattctatttgctgatataccagaattatatagacgtttggatctgctctgcactcccgtcctgtggagggcctccattgtcatcatgctcagcttgaatttcattgtgtcccttgtggccgaggaggctgttattgaaaatcgagccctgtggatgatgattaaaagatgtttcggctatcagtcaaaaagccagtatcggatatggcagagggacttggcaaatgaccctagttggcccccgctaaaccaaacctcccactctgacatgccggagtgtggcagaggagtgtcttacagcaatccagtatttgagagcaatgaagaacaactctgaaggacatgtgatatccaagttgatattacagagaaacaatgacaaaagggaccagtttcattgattttaagaaatgagactcttgtaacatcagctggagttttggggctacctatcaaatcatggtgacaaactaaagtctgtttgataaaatactgtctacagagaagaacattgacccagaagagtgctttcctcttggcttctgaaggtattagaggcattcagtgaaggcaagaatgggccaagaatttctatgggccaagagacaagcaggctaaaggggaaaaatat

SEQ ID NO: 109652 - DNA, 1458 bp, Homo sapiens
  Payload ID: 1535
  Gene Symbol: ATP13A4
  Gene Name: ATPase type 13A4
  Uniprot ID: Q4VNC1
  ENST ID: ENST00000400270
  CDS Start-End: 245-883
ggaataagaggggtaaatggaatagctgcatagcaacttggctctcaagcatcttaaatgttatcccttgacttctggcttccatggtttctgatgagaaattggctgctaatcttactgaagatcccttatagtgaatctgaatggtgcctaccctaagctggtgcctttcagacctgcaggacggctgatctctccacctctgctactctctgtgattttcaacattcttctcagcctggccatgcatattgcaggcttcatcctggttcagaggcagccttggtattccgtggagatacacagtgcctgcacagtacaaaatgaaagcatctcagagttaaccatgtctccaactgctccagaaaaaatggaaagtaatagcaccttcacaagttttgagaacactacagtctggttcttgggaacaatcaactgtatcactgtggctcttgtgttctctaaaggaaaaccatttagacagccaacttatacaaactatatatttgtccttgtgctgataatacagcttggtgtatgtctattcattctatttgctgatataccagaattatatagacgtttggatctgctctgcactcccgtcctgtggagggcctccattgtcatcatgctcagcttgaatttcattgtgtcccttgtggccgaggaggctgttattgaaaatcgagccctgtggatgatgattaaaagatgtttcggctatcagtcaaaaagccagtatcggatatggcagagggacttggcaaatgaccctagttggcccccgctaaaccaaacctcccactctgacatgccggagtgtggcagaggagtgtcttacagcaatccagtatttgagagcaatgaagaacaactctgaaggacatgtgatatccaagttgatattacagagaaacaatgacaaaagggaccagtttcattgattttaagaaatgagactcttgtaacatcagctggagttttggggctacctatcaaatcatggtgacaaactaaagtctgtttgataaaatactgtctacagagaagaacattgacccagaagagtgctttcctcttggcttctgaaggtattagaggcattcagtgaaggcaagaatgggccaagaatttctatgggccaagagacaagcaggctaaaggggaaaaatatgtgatctttcctcttaggacaggacaatactttcctttttataaaaatgagttgaggggaagtagtactgtgtatactcacggagttgtaatttttgaatttttacttcatcgatggaaaaactaatgcgtgggaaacattacaccaatctttactgtctgggttccttttctctgtagtacttttcagatttgaggctttttcttctgtttctggccttacccaacatattgttaaggataagcttagcctatgctgcaataaaaaacaactctcagata

SEQ ID NO: 109653 - DNA, 3056 bp, Homo sapiens
  Payload ID: 1535
  Gene Symbol: ATP13A4
  Gene Name: ATPase type 13A4
  ENST ID: ENST00000428352
  CDS Start-End: 1-1730
ctgggaccgtgagagccgtggtactgcagactggattcaacactgcaaagggagaccttgtgagatccattctctaccctaagccagtgaattttcagttgtacagggatgccatcaggttcctcctgtgccttgtaggaacagccaccattgggatgatctatactctgtgtgtctatgtgcttagtggggaacctccagaggaggtggtgaggaaagcccttgacgtcatcacaattgcggttcctccggctctacctgctgctctgaccacaggcattatctatgcccagaggaggctgaagaagagaggcatcttctgcattagcccccagaggatcaacgtatgtggacagttaaaccttgtctgctttgacaagacaggcaccttaacaagggacggcttggacctctggggagtcgtgtcctgtgataggaatggctttcaggaagttcacagctttgcctcaggccaggctttgccatggggcccactgtgtgcagcgatggccagctgccactctctgatccttcttgatgggaccatccagggagaccctctggacctcaaaatgtttgaagccaccacctgggaaatggctttttctggggacgatttccacatcaagggagtgccggcacatgccatggtagttaagccctgcagaacagccagccaggtcccagtggaaggaattgcaatcctgcatcagttcccattctcatcggcactgcaaagaatgacagtcattgtccaagagatgggaggtgaccgactggcattcatgaaaggtgcaccagagagggtggccagcttttgccaacctgagacagtacccactagttttgttagcgaacttcagatttacacgacacagggcttccgagtcatagcactggcctacaagaagctggaaaatgaccatcacgctactaccttgacgagggagacggtagaatcagacctgatatttctggggctgctgatcttggagaatcgattgaaggaagagacaaaacctgtcttggaagagctcatctcagcccggataaggactgtaatgatcacaggtgacaatcttcagactgcaataacagtggccagaaaatctggaatggtttctgaaagccagaaagtcattctcattgaggcaaatgaaaccaccgggtcctcatcagcatctatatcttggacgttagtagaagagaagaaacacattatgtatgggaatcaggacaattacattaacatcagggatgaagtctctgataaaggcagagaaggaagttaccattttgccctaactggaaaatcctttcatgttataagtcaacatttcagcagcctactgccaaagatattgatcaatgggaccatctttgcaagaatgtctcctgggcagaagtccagtctggtggaagaatttcagaaactggattactttgtaggtatgtgtggtgatggagccaatgactgtggggctctgaaaatggctcatgtgggcatctcattatcagagcaggaggcatctgtggcctcacctttcacttccaaaactccaaacattgagtgcgtacctcaccttatcaaggaaggacgtgcagctctcgttacctccttttgcatgtttaagtacatggctctgtacagcatgattcagagacaaacagcctttcaaattaccagtttctgttccaggatctggccattacaactcttattggtgtaacaatgaatctgaatggtgcctaccctaagctggtgcctttcagacctgcaggacggctgatctctccacctctgctactctctgtgattttcaacattcttctcagcctggccatgcatattgcaggcttcatcctggttcagaggcagccttggtattccgtggagatacacagtgcctgcacagtacaaaatgaaagcatctcagagttaaccatgtctccaactgctccagaaaaaatggaaagtaatagcaccttcacaagttttgagaacactacagtctggttcttgggaacaatcaactgtatcactgtggctcttgtgttctctaaaggaaaaccatttagacagccaacttatacaaactatatatttgtccttgtgctgataatacagcttggtgtatgtctattcattctatttgctgatataccagaattatatagacgtttggatctgctctgcactcccgtcctgtggagggcctccattgtcatcatgctcagcttgaatttcattgtgtcccttgtggccgaggaggctgttattgaaaatcgagccctgtggatgatgattaaaagatgtttcggctatcagtcaaaaagccagtatcggatatggcagagggacttggcaaatgaccctagttggcccccgctaaaccaaacctcccactctgacatgccggagtgtggcagaggagtgtcttacagcaatccagtatttgagagcaatgaagaacaactctgaaggacatgtgatatccaagttgatattacagagaaacaatgacaaaagggaccagtttcattgattttaagaaatgagactcttgtaacatcagctggagttttggggctacctatcaaatcatggtgacaaactaaagtctgtttgataaaatactgtctacagagaagaacattgacccagaagagtgctttcctcttggcttctgaaggtattagaggcattcagtgaaggcaagaatgggccaagaatttctatgggccaagagacaagcaggctaaaggggaaaaatatgtgatctttcctcttaggacaggacaatactttcctttttataaaaatgagttgaggggaagtagtactgtgtatactcacggagttgtaatttttgaatttttacttcatcgatggaaaaactaatgcgtgggaaacattacaccaatctttactgtctgggttccttttctctgtagtacttttcagatttgaggctttttcttctgtttctggccttacccaacatattgttaaggataagcttagcctatgctgcaataaaaaacaactctcagat

SEQ ID NO: 109654 - DNA, 565 bp, Homo sapiens
  Payload ID: 1535
  Gene Symbol: ATP13A4
  Gene Name: ATPase type 13A4
  ENST ID: ENST00000437904
  CDS Start-End: 1-367
caatcttcagactgcaataacagtggccagaaaatctggaatggtttctgaaagccagaaagtcattctcattgaggcaaatgaaaccaccgggtcctcatcagcatctatatcttggacgttagtagaagagaagaaacacattatgtatgggaatcaggacaattacattaacatcagggatgaagtctctgataaaggcagagaaggaagttaccattttgccctaactggaaaatcctttcatgttataagtcaacatttcagcagcctactgccaaagatattgatcaatgggaccatctttgcaagaatgtctcctgggcagaagtccagtctggtggaagaatttcagaaactggagtaggttctttgccagtgcaggtggcatgaactgcatggaggcataacagtcagggggagtggaagagttactttgtaggtatgtgtggtgatggagccaatgactgtggggctctgaaaatggctcatgtgggcatctcattatcagagcaggaggcatctgtggcctcacctttcacttccaaaactccaaacattgagt

SEQ ID NO: 109655 - DNA, 3658 bp, Homo sapiens
  Payload ID: 1535
  Gene Symbol: ATP13A4
  Gene Name: ATPase type 13A4
  ENST ID: ENST00000450950
  CDS Start-End: 71-322
ggcgagttggagttcatcctggaagcgtctgcacgacaaggtcagggaggaggtgtggaataactttttcatgggacactttgagaagggccagcacgctctgctcaatgaaggagaagagaatgagatggagatatttggctatcggactcaaggctgccggaaaagtctctgccttgccggatccatcttctcatttggaatcctccccttggtgttttactggagaccagcatggcacgtatgggcacattgtgtcccatgttccttgcaagaagcagacactgtgttgctgaggacaacgatgaggagtatatcataaatagagccataagaaagccagacctaaaggtgagatgcatcaaagtgcagaaaataagatatgtttggaactacttagaaggacagttccagaaaattggttctttggaagactggcttagttctgccaagatacatcaaaaatttggatcaggcttgacaagagaagaacaggagattagcaatctgtaaaactccaccatctcgtcgagtcacataatagcattacggtctctgtatgtgggagaaaagctggagttcaagagctggaatcacgcgtcctggtgcctggagatttattaattttgacagggaacaaagtgctaatgccatgtgatgccgttctgattgaaggcagctgtgtggtggatgaaggcatgctgacaggagaaagtattccagtcaccaaaactccgttacccaagatggatagctctgtgccctggaaaacacagagtgaagcggattacaagcggcatgtcctcttctgtggaacagaggttatccaggccaaggcagcttgctctgggaccgtgagagccgtggtactgcagactggattcaacactgcaaagggagaccttgtgagatccattctctaccctaagccagtgaattttcagttgtacagggatgccatcaggttcctcctgtgccttgtaggaacagccaccattgggatgatctatactctgtgtgtctatgtgcttagtggggaacctccagaggaggtggtgaggaaagcccttgacgtcatcacaattgcggttcctccggctctacctgctgctctgaccacaggcattatctatgcccagaggaggctgaagaagagaggcatcttctgcattagcccccagaggatcaacgtatgtggacagttaaaccttgtctgctttgacaagacaggcaccttaacaagggacggcttggacctctggggagtcgtgtcctgtgataggaatggctttcaggaagttcacagctttgcctcaggccaggctttgccatggggcccactgtgtgcagcgatggccagctgccactctctgatccttcttgatgggaccatccagggagaccctctggacctcaaaatgtttgaagccaccacctgggaaatggctttttctggggacgatttccacatcaagggagtgccggcacatgccatggtagttaagccctgcagaacagccagccaggtcccagtggaaggaattgcaatcctgcatcagttcccattctcatcggcactgcaaagaatgacagtcattgtccaagagatgggaggtgaccgactggcattcatgaaaggtgcaccagagagggtggccagcttttgccaacctgagacagtacccactagttttgttagcgaacttcagatttacacgacacagggcttccgagtcatagcactggcctacaagaagctggaaaatgaccatcacgctactaccttgacgagggagacggtagaatcagacctgatatttctggggctgctgatcttggagaatcgattgaaggaagagacaaaacctgtcttggaagagctcatctcagcccggataaggactgtaatgatcacaggtgacaatcttcagactgcaataacagtggccagaaaatctggaatggtttctgaaagccagaaagtcattctcattgaggcaaatgaaaccaccgggtcctcatcagcatctatatcttggacgttagtagaagagaagaaacacattatgtatgggaatcaggacaattacattaacatcagggatgaagtctctgataaaggcagagaaggaagttaccattttgccctaactggaaaatcctttcatgttataagtcaacatttcagcagcctactgccaaagatattgatcaatgggaccatctttgcaagaatgtctcctgggcagaagtccagtctggtggaagaatttcagaaactggattactttgtaggtatgtgtggtgatggagccaatgactgtggggctctgaaaatggctcatgtgggcatctcattatcagagcaggaggcatctgtggcctcacctttcacttccaaaactccaaacattgagtgcgtacctcaccttatcaaggaaggacgtgcagctctcgttacctccttttgcatgtttaagtacatggctctgtacagcatgattcagtatgttggtgttctgctgctctactgggagacaaacagcctttcaaattaccagtttctgttccaggatctggccattacaactcttattggtgtaacaatgaatctgaatggtgcctaccctaagctggtgcctttcagacctgcaggacggctgatctctccacctctgctactctctgtgattttcaacattcttctcagcctggccatgcatattgcaggcttcatcctggttcagaggcagccttggtattccgtggagatacacagtgcctgcacagtacaaaatgaaagcatctcagagttaaccatgtctccaactgctccagaaaaaatggaaagtaatagcaccttcacaagttttgagaacactacagtctggttcttgggaacaatcaactgtatcactgtggctcttgtgttctctaaaggaaaaccatttagacagccaacttatacaaactatatatttgtccttgtgctgataatacagcttggtgtatgtctattcattctatttgctgatataccagaattatatagacgtttggatctgctctgcactcccgtcctgtggagggcctccattgtcatcatgctcagcttgaatttcattgtgtcccttgtggccgaggaggctgttattgaaaatcgagccctgtggatgatgattaaaagatgtttcggctatcagtcaaaaagccagtatcggatatggcagagggacttggcaaatgaccctagttggcccccgctaaaccaaacctcccactctgacatgccggagtgtggcagaggagtgtcttacagcaatccagtatttgagagcaatgaagaacaactctgaaggacatgtgatatccaagttgatattacagagaaacaatgacaaaagggaccagtttcattgattttaagaaatgagactcttgtaacatcagctggagttttggggctacctatcaaatcatggtgacaaactaaagtctgtttgataaaatactgtctacagagaagaacattgacccagaagagtgctttcctcttggcttctgaaggtattagaggcattcagtgaaggcaagaatgggccaagaatttctatgggccaagagacaagcaggctaaaggggaaaaatatgtgatctt

SEQ ID NO: 109656 - DNA, 4027 bp, Homo sapiens
  Payload ID: 1536
  Gene Symbol: ATP13A5
  Gene Name: ATPase type 13A5
  Uniprot ID: Q4VNC0
  ENST ID: ENST00000342358
  CDS Start-End: 119-3775
aaaagcgcctgggaagagcaatcacaagttgtgacgattccaagttcacagaagcccaagggattttgacatttctccaaggagttagccagaagagatcctcgccggttgagttcagatggaagagaacagtaagaaggaccatcgggctttgctcaaccagggagaggaggatgaactggaggtgtttggttaccgggaccacaatgtacggaaagccttctgccttgtcgcatccgtgctgacctgtgggggccttctgctggtgttctactggagaccccagtggagagtgtgggccaactgcatcccatgccccttgcaagaagcagacactgttttgctgaggacaacagacgaatttcaaagatatatgaggaagaaggtattctgcctctacttatccacactgaagtttcctgtaagcaagaagtgggaagaatccctggtggctgaccgccactctgtcataaaccaagccttaataaagccagaattaaaactgcggtgcatggaagtgcagaaaatcaggtatgtttggaacgacctggagaagcggtttcagaaagttgggttgctagaagacagcaattcctgctctgacatccatcagacatttggattgggtctgaccagtgaagagcaagaggtcagaagattagtgtgtgggcccaacgccattgaggttgaaatccaacccatatggaagctgcttgttaaacaggttttaaatccattctatgtgttccaagccttcaccctaactttgtggctgtctcaaggttacatagaatactctgtggccatcatcattttgactgttatctccattgtcttaagtgtgtatgatttgcgacagcaatcagttaagctgcataacctcgtggaggaccacaacaaagtccaggttacaatcattgtaaaagacaaaggtttggaggagctggaatcccgtctcttggttcccggagacattcttattcttccaggaaaattttcattgccatgtgatgctgttttgattgatggaagctgcgtggtgaatgaaggcatgcttacaggagaaagtatacctgttacaaagacaccattgccccagatggagaacactatgccttggaaatgtcacagtttggaggattataggaaacacgtccttttctgtggaacagaagttatccaggtcaagccctctgggcaggggcctgtacgagcagtcgttttgcaaacaggttacaatacagccaaaggggacttagtgagatccatcctgtacccccggcctctgaacttcaaactatacagcgatgccttcaagttcatcgtgttcctggcctgccttggtgtcatgggttttttctatgccctaggggtatatatgtaccatggagttcctccaaaagatactgtgaccatggccctgatcctcctcaccgtgactgtccctccagtgctgccagctgccctgaccataggcaacgtgtatgctcagaagagactgaagaaaaagaaaatcttctgtatctccccacagagaatcaacatgtgtgggcaaataaacctcgtgtgctttgacaaaactggcactctcactgaagatgggctggacctctgggggactgtccctactgctgacaactgcttccaggaagcccacagctttgcctcaggccaggctgtgccatggagcccactgtgtgcggccatggccagctgccactctctgatccttctcaatgggaccatccagggagaccctctggacctcaaaatgtttgagggcactgcctggaaaatggaagattgcattgtagactcctgcaaatttgggacgtcagtttcaaacatcataaaaccaggaccaaaagccagtaagagtccagtggaagccatcatcaccttgtgccagtttccattttcctcgagcctgcagaggatgtccgtgatcgctcagctagctggggagaatcatttccatgtctacatgaaaggtgccccagaaatggtggccaggttctgcagatctgaaacagtgcccaagaatttcccacaggaactgaggagttacacggtgcaaggcttccgtgtcattgctcttgcccacaaaaccttaaagatggggaatctttcagaagtcgagcacttagccagagaaaaagtggagtcagagttaacatttctgggacttctcatcatggagaatcgcttgaaaaaagaaaccaaactggtcttgaaggaactgagtgaggcccgtatcaggactgtgatgattacaggtgataaccttcaaacggccattactgttgcaaagaattctgaaatgatccctccaggcagccaagtgatcattgttgaggccgatgaaccagaagaatttgttcctgcctctgtgacctggcagctggtggagaaccaagagactggacctgggaagaaagaaatctacatgcatactggaaacagttcaacccctcgtggggaaggaggaagctgttaccattttgcaatgagtgggaaatcataccaagtgatatttcagcatttcaacagcttgcttccaaaaattctggtgaatggaacagtttttgcaagaatgtctcctgggcagaaatcaagccttattgaagaatttcagaaattaaattattatgtgggcatgtgtggagatggagctaacgactgtggggctttgaaagcggctcatgcaggcatttcattatcagagcaggaagcatctgtggcatccccttttacctctaaaacaaccaacatccagtgtgtgcctcatctcatcagagaaggccgagctgctctggtttcatcctttggagtatttaaatacttgaccatgtacggcataatccagtttatcagtgcattactgctctattggcaactacaactctttggaaattaccagtatctcatgcaagatgtagccattactttgatggtctgtttaacaatgagttcaactcatgcctacccaaagctggctccatatagaccagcaggacagctcctttctccccctttactgctttcaatatttttgaattcctgtttctcctgcattgtgcagatcagtgcatttctctatgtgaagcagcagccttggtattgtgaggtctaccaatacagtgagtgttttctggccaaccaaagtaatttttcaacaaatgtgagtttggaaagaaactggactggaaatgcaactctgattcctggttcaattttaagttttgagaccaccacactgtggcccatcaccaccatcaactatatcacagtagcattcatcttttctaagggaaagccatttcgaaaacccatctatacaaactatatattttcatttctgctgctagctgccttgggcctcacaattttcattctgttttctgactttcaagttatataccgtggaatggagttgatcccaaccataacatcgtggagggttttaattttggtggtagccctcacccaattctgtgtggctttctttgtagaggattccatccttcaaaatcatgaactctggctgttgatcaaaagagaatttggattctactctaaaagtcaatataggacttggcaaaagaagctagcagaagactcaacctggcctcccataaacaggacagattattcaggtgatggcaaaaatggattctacatcaacggaggctatgaaagccatgaacagattccaaaaagaaaactcaaattgggaggccaacccacagaacagcatttctgggccaggctgtaatcagaattgtcgtcgtacatgctcaacagcattgcttttttccccaaaattaacacattgtggagaagtgatgatactctccccttacctttcctctctccattcaagcattcaaagtatattttcaatgaattaaaccttgcagcaagggaccttagataggcttattctgactgtatgctttaccaatgagagaaaaaaatgcatttcctgtatcatccttttcaataaactgtattcattttgcatagc

SEQ ID NO: 109657 - DNA, 569 bp, Homo sapiens
  Payload ID: 1536
  Gene Symbol: ATP13A5
  Gene Name: ATPase type 13A5
  ENST ID: ENST00000446087
  CDS Start-End: 96-569
acaagttgtgacgattccaagttcacagaagcccaagggattttgacatttctccaaggagttagccagaagagatcctcgccggttgagttcagatggaagagaacagtaagaaggaccatcgggctttgctcaaccagggagaggaggatgaactggtggagtcttgcccaggctggagtgaaatggcacgatctcggctcactgcaacgtctgcctcccaggaggtgtttggttaccgggaccacaatgtacggaaagccttctgccttgtcgcatccgtgctgacctgtgggggccttctgctggtgttctactggagaccccagtggagagtgtgggccaactgcatcccatgccccttgcaagaagcagacactgttttgctgaggacaacagacgaatttcaaagatatatgaggaagaaggtattctgcctctacttatccacactgaagtttcctgtaagcaagaagtgggaagaatccctggtggctgaccgccactctgtcataaaccaagccttaataaagccagaattaaaactgcggtgcatggaagtgcagaaa

SEQ ID NO: 109658 - DNA, 709 bp, Homo sapiens
  Payload ID: 1536
  Gene Symbol: ATP13A5
  Gene Name: ATPase type 13A5
  ENST ID: ENST00000620313
  CDS Start-End: 119-463
gggaaagccatttcgaaaacccatctatacaaactatatattttcatttctgctgctagctgccttgggcctcacaattttcattctgttttctgactttcaagttatataccgtggaatggagttgatcccaaccataacatcgtggagggttttaattttggtggtagccctcacccaattctgtggctttctttgtagaggattccatcttcaaaatcatgaactctggctgttgatcaaaagagaatttggattctactctaaaagtcaatataggacttggcaaaagaagctagcagaagactcaacctggcctcccataaacaggacagattattcaggtgatggcaaaaatggattctacatcaacggaggctatgaaagccatgaacagattccaaaaagaaaactcaaattgggaggccaacccacagaacagcatttctgggccaggctgtaatcagaattgtcgtcgtacatgctcaacagcattgcttttttccccaaaattaacacattgtggagaagtgatgatactctccccttacctttcctctctccattcaagcattcaaagtatattttcaatgaattaaaccttgcagcaagggaccttagataggcttattctgactgtatgctttaccaatgagagaaaaaaatgcatttcctgtatcatccttttcaataaactgtattcattttg

SEQ ID NO: 109659 - DNA, 8209 bp, Homo sapiens
  Payload ID: 1537
  Gene Symbol: ATP8A1
  Gene Name: ATPase, aminophospholipid transporter (APLT), class I, type 8A, member 1
  Uniprot ID: Q9Y2Q0
  ENST ID: ENST00000264449
  CDS Start-End: 221-3670
agctctgcgggcgccgccaccttcgccgccaccgctgcctttctcctcctcctgtcggcgtgcgggggccgcgcccggcggcagctctgccctaggtgggcggcggcgcggcccaggctgcagctgagcgctctgcgcggcgcagccgggtctcccgcgtgtaccacgccgtgacaggtgcagagtccgggctgaggacccacctgcagccgccgccgcgatgcccaccatgcggaggaccgtgtcggagatccgctcgcgcgccgaaggttatgagaagacagatgatgtttcagagaagacctcactggctgaccaggaggaagtaaggactattttcatcaaccagccccagctgacaaaattctgcaataaccatgtcagcactgcaaaatacaacataatcacattccttccaagatttctctactctcagttcagaagagctgctaattcattttttctctttattgcactgctgcagcaaatacctgatgtgtcaccaacaggtcgttatacaacactggttcctctcttatttattttagctgtggcagctatcaaagagataatagaagatattaaacgacataaagctgataatgcagtgaacaagaaacaaacgcaagttttgagaaatggtgcttgggaaattgtccactgggaaaaggtaaatgttggagatatagttataataaaaggcaaagagtatatacctgctgacactgtacttctctcatcaagtgagccccaagccatgtgctacattgaaacatccaacttagatggtgaaacaaacttgaaaattagacagggcttaccagcaacatcagatatcaaagacgttgacagtttgatgaggatttctggcagaattgagtgtgaaagtccaaacagacatctctacgattttgttggaaacataaggcttgatggacatggcaccgttccactgggagcagatcagattcttcttcgaggagctcagttgagaaatacacagtgggttcatggaatagttgtctacactggacatgacaccaagctgatgcagaattcaacaagtccaccacttaagctctcaaatgtggaacggattacaaatgtacaaattttgattttattttgtatcttaattgccatgtctcttgtctgttctgtgggctcagccatttggaatcgaaggcattctggaaaagactggtatctcaatctaaactatggtggcgctagtaattttggactgaatttcttgaccttcatcatccttttcaacaatctcattcctatcagcttattggttacattagaagttgtgaaatttacccaggcatacttcataaattgggatcttgacatgcactatgaacccacagacactgctgctatggctcgaacatctaatctgaatgaggaacttggccaggttaaatacatattttctgacaaaactggtactctgacatgcaatgtaatgcagtttaagaagtgcaccatagcgggagttgcttatgggcagaactcacagtttggagatgaaaaaacatttagtgattcatcattgctggaaaatctccaaaataatcatccaactgcacctataatatgtgaatttcttacaatgatggcagtctgtcacacagcagtgccagagcgagaaggtgacaagattatttatcaagcagcatctccagatgagggagcattggtcagagcagccaagcaattgaattttgttttcactggaagaacacccgactcggtgattatagattcactggggcaggaagaaagatatgaattgctcaatgtcttggagtttaccagtgctaggaaaagaatgtcagtgattgttcgcactccatctggaaagttacgactctactgcaaaggagctgacactgtaatttatgatcgactggcagagacgtcaaaatacaaagaaattaccctaaaacatttagagcagtttgctacagaagggttaagaactttatgttttgctgtggctgagatttcagagagcgactttcaggagtggcgagcagtctatcagcgagcatctacatctgtgcagaacaggctactcaaactcgaagagagttatgagttgattgaaaagaatcttcagctacttggagcaacagccattgaggataaattacaagatcaagtgcctgaaaccatagaaacgctaatgaaagcagacatcaaaatctggatccttacaggggacaagcaagaaactgccattaacatcggacactcctgcaaactgttgaagaagaacatgggaatgattgttataaatgaaggctctcttgatggaacaagggaaactctcagtcgtcactgtactacccttggtgatgctctccggaaagagaatgattttgctcttataattgatgggaaaaccctcaaatatgccttaacctttggagtacgacagtatttcctggacttagctttgtcatgcaaagctgtcatttgctgtcgggtttctcctcttcaaaaatctgaagttgttgagatggttaagaaacaagtcaaagtcgtaacgcttgcaatcggtgatggagcaaatgatgtcagcatgatacagacagcgcacgttggtgttggtatcagtggcaatgaaggcctgcaggcagctaattcctctgactactccatagctcagttcaaatatttgaagaatttactgatgattcatggtgcctggaactataacagagtctccaagtgcatcttatactgcttctacaagaatatagtgctctatattatcgagatctggtttgcctttgttaatggcttttctggacagatcctctttgaaagatggtgtataggtctctataacgtgatgtttacagcaatgcctcctttaactcttggaatatttgagagatcatgcagaaaagagaacatgttgaagtaccctgaattatacaaaacatctcagaatgccctggacttcaacaccaaggttttctgggttcattgtttaaatggcctcttccactcagttattctgttttggtttccactaaaagcccttcagtatggtactgcatttggaaatgggaaaacctcggattatctgctactgggaaactttgtgtacacttttgtggtgataactgtgtgtttgaaagctggattggagacatcatattggacatggttcagccacatagcgatatgggggagcatcgcactctgggtggtgttttttggaatctactcatctctgtggcctgccattccgatggcccctgatatgtcaggagaggcagccatgttgttcagttctggagtcttttggatgggcttgttattcatccctgtggcatctctgctccttgatgtggtgtacaaggttatcaagaggactgcttttaaaacattggtcgatgaagttcaggagctggaggcaaaatctcaagacccaggagcagttgtacttggaaaaagcctgaccgagagggcgcaactgctcaagaacgtctttaagaagaaccacgtgaacttgtaccgctctgaatccttgcaacaaaatctgctccatgggtatgcgttctctcaagatgaaaatggaatcgtttcacagtctgaagtgataagagcatatgataccacgaaacagaggcccgacgaatggtgatggggagagcctgaaaggcaggctctgttacctctctaaggagagctaccaggttgtcaccgcagtctgctaaccaattccagtctggtccatgaagaggaaaggtagatctgagctcatctcgctgatggacattcagattcatgtatattatagacataagcactgtgcaactgtactgtaacaccatctcttttggatttttttaaggtatttgctaagtctttgtaaacggaaattgaaaatgacctggtatcttgccagagggctttcttaaacggagaataagtcagtattcttatgccattactgtggggctgtaactgactgtcagtttattggctgtaccacaaggtaaccaaccattaaaaaactctaaatgatatttagttaaagggactcttggtatccagacttagatttcaggatatgctgaaacaaaccagcattcttaaggaactgactcaccttcctgagcaaaatttctaaacaagcatttgtgtccaaaattgtcttgataaatgtttgccaaagaggttcagtaagtgtttttctagttcagtagtcatatgcccagaaatgtaagagaaagtttacttccagttccgctgtaagatctgcatgcctgactttccaaatgtaagagtgatttacaaaaatgaatatttcaaggcatttgctactaaaatcggtgatgttgcacctttggccttacaaatgcttctttgttgtttgtcgtgtttatttgttagaggacacacgtgttaatgtgactctgttgttatgacactgatttttcaaactatgtatgtttcaggtatttctgatgaagtttcatcatcatttagatttttctaaaaatctggctaatgcagtagattgagtgatgtcattttgtcttaaagtttttcctcttaagaaacatatgctacgtatttacgtgggatttccaaagcttctgttgcaatatttggaataacatgtcagataaatgcatgggcttttgtcctgtgttccagttcccactagagatgcctgtgtcttgtgtagcacacccagtgttatggtgactgccccctatactgaagactgaaaattatttcacagttcactcatcaaatagttcccaaaattcgtcacatgctgcttattgggacaaataggtagtacattttccccatttaaaaaatgcggattttactcaggccggtaactttacagtcagaggacacgttcatcatgagtagcttttgttagtatgttttaaaatgtatcttcagttcaattattttcagcatttacaagacatctgaaaatggctattttgctaccaacagtaaatgaaggggctgtttaaaaaccacaaccagttttctacactattttttaaataatactttcatttgaaaaaaaggaattagttttcagatacacttcagagattgaagcaaactatttgccttttactcaaaagcctgcttgcctttacatggacttaccagcaaaataggtagaactttctcttttaaaaaaagtcaactagaattgagaagaggtgattttttttcagatcgcttctcgagtttaatattttcacattcttttcaccctttttctcaatctagatttaaaattaggatatatgtcatttccttgtctgtatttgtagctccttagttaccagtatgcctctccattttctacaaataagaggttataacacatatacataattctaaccttaagggaacacacgtttacatactttacttcccaagcccttcctgtttggggtacagattgagagagtcatgaatcaacacatctagcaagaccacaggtgtaagagtctaagatcgtcttcaaaattctgaagtcccagtctttacctgtccagtgaatgaatattcagagcagcttttcctgggcttcccagtggtgatagctgaggtcaaaccacaaaaaataagaaagcaagagtgaaatgcacccctccagagaaacactttgtagtgtttaattctgttaatagagaagagctgcttctgtttgcgctcacttcatcagtggcacccttctgcagaattttaatataaaaacattatggatataatagaactggattttctgacttaaaaatgtaagttttattttaatcttgaaacgtggattgtttctgtggagctcttaaacatgagaagaatacttacggttgataatgtgtaacatgatctgaaatgtgactaatttgagcctctttgtcccatcgtcctgtttttgaattattgacattgtcagtctctttgcttcctgggtgagacttggggtttgagggacagggaatgaccttcttggtgaaacttaaaatataacattgcaattgcagtgactttacagtgttaaattagagaaaatagtctgattttttaaaccttccttaactggaaaaaagtcacatggttttaccaggattgaaataaacagtcaatgtgacttttaacatgtgtttttttgaaataaagggcacgtactcttcaattaaaaagttccttatagggactctggcaaatgctaacacagttgctttacaatgtttacaattcagacaatacgacttataatagaaaatcctcattcatttagcattgaaaagctggaagttgcttctttaatgttgaatagtatacagtggtattgagcatggactttctaaatgttttatatatacatataaaaatatattggtgtctcacacccagaaagatgttatattgtagatattattaggaaaacagtgtttctcaggaacgttgtaaattttaaatgatatatgtacttcccgtcctcccacctccactctgtgctctaatgtgagactgcttcagcagtgttgctaagttaatggaaaactttttctaatcaagtcaggtgaatgtgtattctgctaaataatgttagccatttacatgaattgtatggtcattaaatggaatcagtgattcctctttaatttccagaggggaaatgaattatggaaatcagtcagcattctgatcattaaattttatactttaattttgccgttcagcattctaaatatccaatgtgaaagtcacatgataatttgttttgcattgcgtgcactgtacaacacttacaacttgtcatttaaaatgttttctcgggaaatgaatgctagtcagaaagtaatagattgtattattcatagttttaaaattatgacaatgtcataattactacaaagctaaataatcgtgtttatttttgtgcagttgccctttgatagttcctggttttaaaacctattaagtgtataatcttacaaatagtcatctacaaaatttatggagaaagtgcccagcccattcacatcacatggaccaggaattcttttgtaaatgacttaaggtaacatcatgcagttcagtgcctaataaatgctttttaatgatgaacatttctataatgactcgtaagataccatagtctgatttttctcacattaaaataactgaagtcacttgtgtaacgtagttatactttgctgcattttaattaaccttcaacagctattaaagtggaatgtaagttaaattttgaaggaaaggaaataaatgttttccatatttcgtcttgatttactttctgtatgagaacagctgtgtttttgataggtttatggtttgcatgagttcatatttaaagtgatccaggccaatgcatggctattgctgtaaatcttgatgtttatttctgccttgtaaagttctatcacggcctacctggaatttaaaattcagtagacaaattaattggtcctctgcacaacttttttaataagtagattattttacaaagaaatttgaacaaatttaattgaatcttttgtttagcttgcctctaagaacttttcttaataaagctcccaaaacttctcagcaaataaatctcccttaagtaggaaagctagatttcatatttgcttactttgaattaacagcaactttccacaggtaaatctgttcttgcaaagatgtgagcagaatagttaaaaataatatttttatgtttcatggttctaaatggaagccataaatgcagtaaatactatctgttgtttaactactttaatcgtcattttttacattttcaagtttattaggttaagaaaaacagggcagccttggaaggcagctactacagaaaactgcagttttgcgttaaagataaagtagtattttcagctccctgaaaaaccattcctgctgaaactgctgtagaaattgtgaagctgcatgagtggagagtattgaatctgtggttatagtagttttctcaggtttgtttatcttgatgtttgatgcactgtgttttatagttattaaaattgagtaatattatttctatgcagtgttatgtgtcattggccttttgtgaatgtgcatgttttaaactgcaaattttaaacattttgtcctctaattgttattaaaaatgaaataaactttaccattactt

SEQ ID NO: 109660 - DNA, 8270 bp, Homo sapiens
  Payload ID: 1537
  Gene Symbol: ATP8A1
  Gene Name: ATPase, aminophospholipid transporter (APLT), class I, type 8A, member 1
  Uniprot ID: Q9Y2Q0
  ENST ID: ENST00000381668
  CDS Start-End: 233-3727
aagagctcgcccagctctgcgggcgccgccaccttcgccgccaccgctgcctttctcctcctcctgtcggcgtgcgggggccgcgcccggcggcagctctgccctaggtgggcggcggcgcggcccaggctgcagctgagcgctctgcgcggcgcagccgggtctcccgcgtgtaccacgccgtgacaggtgcagagtccgggctgaggacccacctgcagccgccgccgcgatgcccaccatgcggaggaccgtgtcggagatccgctcgcgcgccgaaggttatgagaagacagatgatgtttcagagaagacctcactggctgaccaggaggaagtaaggactattttcatcaaccagccccagctgacaaaattctgcaataaccatgtcagcactgcaaaatacaacataatcacattccttccaagatttctctactctcagttcagaagagctgctaattcattttttctctttattgcactgctgcagcaaatacctgatgtgtcaccaacaggtcgttatacaacactggttcctctcttatttattttagctgtggcagctatcaaagagataatagaagatattaaacgacataaagctgataatgcagtgaacaagaaacaaacgcaagttttgagaaatggtgcttgggaaattgtccactgggaaaaggtggcagtaggggagatagtgaaagtgaccaatggggaacatctcccagcagatctcatcagtctgtcctcaagtgagccccaagccatgtgctacattgaaacatccaacttagatggtgaaacaaacttgaaaattagacagggcttaccagcaacatcagatatcaaagacgttgacagtttgatgaggatttctggcagaattgagtgtgaaagtccaaacagacatctctacgattttgttggaaacataaggcttgatggacatggcaccgttccactgggagcagatcagattcttcttcgaggagctcagttgagaaatacacagtgggttcatggaatagttgtctacactggacatgacaccaagctgatgcagaattcaacaagtccaccacttaagctctcaaatgtggaacggattacaaatgtacaaattttgattttattttgtatcttaattgccatgtctcttgtctgttctgtgggctcagccatttggaatcgaaggcattctggaaaagactggtatctcaatctaaactatggtggcgctagtaattttggactgaatttcttgaccttcatcatccttttcaacaatctcattcctatcagcttattggttacattagaagttgtgaaatttacccaggcatacttcataaattgggatcttgacatgcactatgaacccacagacactgctgctatggctcgaacatctaatctgaatgaggaacttggccaggttaaatacatattttctgacaaaactggtactctgacatgcaatgtaatgcagtttaagaagtgcaccatagcgggagttgcttatggccatgtccctgaacctgaggattatggctgctctcctgatgaatggcagaactcacagtttggagatgaaaaaacatttagtgattcatcattgctggaaaatctccaaaataatcatccaactgcacctataatatgtgaatttcttacaatgatggcagtctgtcacacagcagtgccagagcgagaaggtgacaagattatttatcaagcagcatctccagatgagggagcattggtcagagcagccaagcaattgaattttgttttcactggaagaacacccgactcggtgattatagattcactggggcaggaagaaagatatgaattgctcaatgtcttggagtttaccagtgctaggaaaagaatgtcagtgattgttcgcactccatctggaaagttacgactctactgcaaaggagctgacactgtaatttatgatcgactggcagagacgtcaaaatacaaagaaattaccctaaaacatttagagcagtttgctacagaagggttaagaactttatgttttgctgtggctgagatttcagagagcgactttcaggagtggcgagcagtctatcagcgagcatctacatctgtgcagaacaggctactcaaactcgaagagagttatgagttgattgaaaagaatcttcagctacttggagcaacagccattgaggataaattacaagatcaagtgcctgaaaccatagaaacgctaatgaaagcagacatcaaaatctggatccttacaggggacaagcaagaaactgccattaacatcggacactcctgcaaactgttgaagaagaacatgggaatgattgttataaatgaaggctctcttgatggaacaagggaaactctcagtcgtcactgtactacccttggtgatgctctccggaaagagaatgattttgctcttataattgatgggaaaaccctcaaatatgccttaacctttggagtacgacagtatttcctggacttagctttgtcatgcaaagctgtcatttgctgtcgggtttctcctcttcaaaaatctgaagttgttgagatggttaagaaacaagtcaaagtcgtaacgcttgcaatcggtgatggagcaaatgatgtcagcatgatacagacagcgcacgttggtgttggtatcagtggcaatgaaggcctgcaggcagctaattcctctgactactccatagctcagttcaaatatttgaagaatttactgatgattcatggtgcctggaactataacagagtctccaagtgcatcttatactgcttctacaagaatatagtgctctatattatcgagatctggtttgcctttgttaatggcttttctggacagatcctctttgaaagatggtgtataggtctctataacgtgatgtttacagcaatgcctcctttaactcttggaatatttgagagatcatgcagaaaagagaacatgttgaagtaccctgaattatacaaaacatctcagaatgccctggacttcaacaccaaggttttctgggttcattgtttaaatggcctcttccactcagttattctgttttggtttccactaaaagcccttcagtatggtactgcatttggaaatgggaaaacctcggattatctgctactgggaaactttgtgtacacttttgtggtgataactgtgtgtttgaaagctggattggagacatcatattggacatggttcagccacatagcgatatgggggagcatcgcactctgggtggtgttttttggaatctactcatctctgtggcctgccattccgatggcccctgatatgtcaggagaggcagccatgttgttcagttctggagtcttttggatgggcttgttattcatccctgtggcatctctgctccttgatgtggtgtacaaggttatcaagaggactgcttttaaaacattggtcgatgaagttcaggagctggaggcaaaatctcaagacccaggagcagttgtacttggaaaaagcctgaccgagagggcgcaactgctcaagaacgtctttaagaagaaccacgtgaacttgtaccgctctgaatccttgcaacaaaatctgctccatgggtatgcgttctctcaagatgaaaatggaatcgtttcacagtctgaagtgataagagcatatgataccacgaaacagaggcccgacgaatggtgatggggagagcctgaaaggcaggctctgttacctctctaaggagagctaccaggttgtcaccgcagtctgctaaccaattccagtctggtccatgaagaggaaaggtagatctgagctcatctcgctgatggacattcagattcatgtatattatagacataagcactgtgcaactgtactgtaacaccatctcttttggatttttttaaggtatttgctaagtctttgtaaacggaaattgaaaatgacctggtatcttgccagagggctttcttaaacggagaataagtcagtattcttatgccattactgtggggctgtaactgactgtcagtttattggctgtaccacaaggtaaccaaccattaaaaaactctaaatgatatttagttaaagggactcttggtatccagacttagatttcaggatatgctgaaacaaaccagcattcttaaggaactgactcaccttcctgagcaaaatttctaaacaagcatttgtgtccaaaattgtcttgataaatgtttgccaaagaggttcagtaagtgtttttctagttcagtagtcatatgcccagaaatgtaagagaaagtttacttccagttccgctgtaagatctgcatgcctgactttccaaatgtaagagtgatttacaaaaatgaatatttcaaggcatttgctactaaaatcggtgatgttgcacctttggccttacaaatgcttctttgttgtttgtcgtgtttatttgttagaggacacacgtgttaatgtgactctgttgttatgacactgatttttcaaactatgtatgtttcaggtatttctgatgaagtttcatcatcatttagatttttctaaaaatctggctaatgcagtagattgagtgatgtcattttgtcttaaagtttttcctcttaagaaacatatgctacgtatttacgtgggatttccaaagcttctgttgcaatatttggaataacatgtcagataaatgcatgggcttttgtcctgtgttccagttcccactagagatgcctgtgtcttgtgtagcacacccagtgttatggtgactgccccctatactgaagactgaaaattatttcacagttcactcatcaaatagttcccaaaattcgtcacatgctgcttattgggacaaataggtagtacattttccccatttaaaaaatgcggattttactcaggccggtaactttacagtcagaggacacgttcatcatgagtagcttttgttagtatgttttaaaatgtatcttcagttcaattattttcagcatttacaagacatctgaaaatggctattttgctaccaacagtaaatgaaggggctgtttaaaaaccacaaccagttttctacactattttttaaataatactttcatttgaaaaaaaggaattagttttcagatacacttcagagattgaagcaaactatttgccttttactcaaaagcctgcttgcctttacatggacttaccagcaaaataggtagaactttctcttttaaaaaaagtcaactagaattgagaagaggtgattttttttcagatcgcttctcgagtttaatattttcacattcttttcaccctttttctcaatctagatttaaaattaggatatatgtcatttccttgtctgtatttgtagctccttagttaccagtatgcctctccattttctacaaataagaggttataacacatatacataattctaaccttaagggaacacacgtttacatactttacttcccaagcccttcctgtttggggtacagattgagagagtcatgaatcaacacatctagcaagaccacaggtgtaagagtctaagatcgtcttcaaaattctgaagtcccagtctttacctgtccagtgaatgaatattcagagcagcttttcctgggcttcccagtggtgatagctgaggtcaaaccacaaaaaataagaaagcaagagtgaaatgcacccctccagagaaacactttgtagtgtttaattctgttaatagagaagagctgcttctgtttgcgctcacttcatcagtggcacccttctgcagaattttaatataaaaacattatggatataatagaactggattttctgacttaaaaatgtaagttttattttaatcttgaaacgtggattgtttctgtggagctcttaaacatgagaagaatacttacggttgataatgtgtaacatgatctgaaatgtgactaatttgagcctctttgtcccatcgtcctgtttttgaattattgacattgtcagtctctttgcttcctgggtgagacttggggtttgagggacagggaatgaccttcttggtgaaacttaaaatataacattgcaattgcagtgactttacagtgttaaattagagaaaatagtctgattttttaaaccttccttaactggaaaaaagtcacatggttttaccaggattgaaataaacagtcaatgtgacttttaacatgtgtttttttgaaataaagggcacgtactcttcaattaaaaagttccttatagggactctggcaaatgctaacacagttgctttacaatgtttacaattcagacaatacgacttataatagaaaatcctcattcatttagcattgaaaagctggaagttgcttctttaatgttgaatagtatacagtggtattgagcatggactttctaaatgttttatatatacatataaaaatatattggtgtctcacacccagaaagatgttatattgtagatattattaggaaaacagtgtttctcaggaacgttgtaaattttaaatgatatatgtacttcccgtcctcccacctccactctgtgctctaatgtgagactgcttcagcagtgttgctaagttaatggaaaactttttctaatcaagtcaggtgaatgtgtattctgctaaataatgttagccatttacatgaattgtatggtcattaaatggaatcagtgattcctctttaatttccagaggggaaatgaattatggaaatcagtcagcattctgatcattaaattttatactttaattttgccgttcagcattctaaatatccaatgtgaaagtcacatgataatttgttttgcattgcgtgcactgtacaacacttacaacttgtcatttaaaatgttttctcgggaaatgaatgctagtcagaaagtaatagattgtattattcatagttttaaaattatgacaatgtcataattactacaaagctaaataatcgtgtttatttttgtgcagttgccctttgatagttcctggttttaaaacctattaagtgtataatcttacaaatagtcatctacaaaatttatggagaaagtgcccagcccattcacatcacatggaccaggaattcttttgtaaatgacttaaggtaacatcatgcagttcagtgcctaataaatgctttttaatgatgaacatttctataatgactcgtaagataccatagtctgatttttctcacattaaaataactgaagtcacttgtgtaacgtagttatactttgctgcattttaattaaccttcaacagctattaaagtggaatgtaagttaaattttgaaggaaaggaaataaatgttttccatatttcgtcttgatttactttctgtatgagaacagctgtgtttttgataggtttatggtttgcatgagttcatatttaaagtgatccaggccaatgcatggctattgctgtaaatcttgatgtttatttctgccttgtaaagttctatcacggcctacctggaatttaaaattcagtagacaaattaattggtcctctgcacaacttttttaataagtagattattttacaaagaaatttgaacaaatttaattgaatcttttgtttagcttgcctctaagaacttttcttaataaagctcccaaaacttctcagcaaataaatctcccttaagtaggaaagctagatttcatatttgcttactttgaattaacagcaactttccacaggtaaatctgttcttgcaaagatgtgagcagaatagttaaaaataatatttttatgtttcatggttctaaatggaagccataaatgcagtaaatactatctgttgtttaactactttaatcgtcattttttacattttcaagtttattaggttaagaaaaacagggcagccttggaaggcagctactacagaaaactgcagttttgcgttaaagataaagtagtattttcagctccctgaaaaaccattcctgctgaaactgctgtagaaattgtgaagctgcatgagtggagagtattgaatctgtggttatagtagttttctcaggtttgtttatcttgatgtttgatgcactgtgttttatagttattaaaattgagtaatattatttctatgcagtgttatgtgtcattggccttttgtgaatgtgcatgttttaaactgcaaattttaaacattttgtcctctaattgttattaaaaatgaaataaactttaccattacttaaaa

SEQ ID NO: 109661 - DNA, 920 bp, Homo sapiens
  Payload ID: 1537
  Gene Symbol: ATP8A1
  Gene Name: ATPase, aminophospholipid transporter (APLT), class I, type 8A, member 1
  ENST ID: ENST00000506602
  CDS Start-End: 1-427
agctgtcatttgctgtcgggtttctcctcttcaaaaatctgaagttgttgagatggttaagaaacaagtcaaagtcgtaacgcttgcaatcggtgatggagcaaatgatgtcagcatgatacagacagcgcacgttggtgttggtatcagtggcaatgaaggcctgcaggcagctaattcctctgactactccatagctcagttcaaatatttgaagaatttactgatgattcatggtgcctggaactataacagagtctccaagtgcatcttatactgcttctacaagaatatagtgctctatattatcgagatctggtttgcctttgttaatggcttttctggacagatcctctttgaaagatggtgtataggtctctataacgtgtttgtgcgctttagatgtttacagcaatgcctcctttaactcttggaatatttgagagatcatgcagaaaagagaacatgttgaagtaccctgaattatacaaaacatctcagaatgccctggacttcaacaccaaggttttctgggttcattgtttaaatggcctcttccactcagttattctgttttggtttccactaaaagcccttcagtatggtactgcatttggaaatgggaaaacctcggattatctgctactgggaaactttgtgtacacttttgtggtgataactgtgtgtttgaaagctggattggagacatcatattggacatggttcagccacatagcgatatgggggagcatcgcactctgggtggtgttttttggaatctactcatctctgtggcctgccattccgatggcccctgatatgtcaggagaggcagccatgttgttcagttctggagtcttttggatgggcttgttattcatccctgtggcatctctgctccttgatgtggtgtacaaggt

SEQ ID NO: 109662 - DNA, 5918 bp, Homo sapiens
  Payload ID: 1537
  Gene Symbol: ATP8A1
  Gene Name: ATPase, aminophospholipid transporter (APLT), class I, type 8A, member 1
  ENST ID: ENST00000514372
  CDS Start-End: 1-228
aatcttcagctacttggagcaacagccattgaggataaattacaagatcaagtgcctgaaaccatagaaacgctaatgaaagcagacatcaaaatctggatccttacaggggacaagcaagaaactgccattaacatcggacactcctgcaaactgttgaagaagaacatgggaatgattgttataaatgaaggctctcttgatggtttctcctcttcaaaaatctgaagttgttgagatggttaagaaacaagtcaaagtcgtaacgcttgcaatcggtgatggagcaaatgatgtcagcatgatacagacagcgcacgttggtgttggtatcagtggcaatgaaggcctgcaggcagctaattcctctgactactccatagctcagttcaaatatttgaagaatttactgatgattcatggtgcctggaactataacagagtctccaagtgcatcttatactgcttctacaagaatatagtgctctatattatcgagatctggtttgcctttgttaatggcttttctggacagatcctctttgaaagatggtgtataggtctctataacgtgatgtttacagcaatgcctcctttaactcttggaatatttgagagatcatgcagaaaagagaacatgttgaagtaccctgaattatacaaaacatctcagaatgccctggacttcaacaccaaggttttctgggttcattgtttaaatggcctcttccactcagttattctgttttggtttccactaaaagcccttcagtatggtactgcatttggaaatgggaaaacctcggattatctgctactgggaaactttgtgtacacttttgtggtgataactgtgtgtttgaaagctggattggagacatcatattggacatggttcagccacatagcgatatgggggagcatcgcactctgggtggtgttttttggaatctactcatctctgtggcctgccattccgatggcccctgatatgtcaggagaggcagccatgttgttcagttctggagtcttttggatgggcttgttattcatccctgtggcatctctgctccttgatgtggtgtacaaggttatcaagaggactgcttttaaaacattggtcgatgaagttcaggagctggaggcaaaatctcaagacccaggagcagttgtacttggaaaaagcctgaccgagagggcgcaactgctcaagaacgtctttaagaagaaccacgtgaacttgtaccgctctgaatccttgcaacaaaatctgctccatgggtatgcgttctctcaagatgaaaatggaatcgtttcacagtctgaagtgataagagcatatgataccacgaaacagaggcccgacgaatggtgatggggagagcctgaaaggcaggctctgttacctctctaaggagagctaccaggttgtcaccgcagtctgctaaccaattccagtctggtccatgaagaggaaaggtagatctgagctcatctcgctgatggacattcagattcatgtatattatagacataagcactgtgcaactgtactgtaacaccatctcttttggatttttttaaggtatttgctaagtctttgtaaacggaaattgaaaatgacctggtatcttgccagagggctttcttaaacggagaataagtcagtattcttatgccattactgtggggctgtaactgactgtcagtttattggctgtaccacaaggtaaccaaccattaaaaaactctaaatgatatttagttaaagggactcttggtatccagacttagatttcaggatatgctgaaacaaaccagcattcttaaggaactgactcaccttcctgagcaaaatttctaaacaagcatttgtgtccaaaattgtcttgataaatgtttgccaaagaggttcagtaagtgtttttctagttcagtagtcatatgcccagaaatgtaagagaaagtttacttccagttccgctgtaagatctgcatgcctgactttccaaatgtaagagtgatttacaaaaatgaatatttcaaggcatttgctactaaaatcggtgatgttgcacctttggccttacaaatgcttctttgttgtttgtcgtgtttatttgttagaggacacacgtgttaatgtgactctgttgttatgacactgatttttcaaactatgtatgtttcaggtatttctgatgaagtttcatcatcatttagatttttctaaaaatctggctaatgcagtagattgagtgatgtcattttgtcttaaagtttttcctcttaagaaacatatgctacgtatttacgtgggatttccaaagcttctgttgcaatatttggaataacatgtcagataaatgcatgggcttttgtcctgtgttccagttcccactagagatgcctgtgtcttgtgtagcacacccagtgttatggtgactgccccctatactgaagactgaaaattatttcacagttcactcatcaaatagttcccaaaattcgtcacatgctgcttattgggacaaataggtagtacattttccccatttaaaaaatgcggattttactcaggccggtaactttacagtcagaggacacgttcatcatgagtagcttttgttagtatgttttaaaatgtatcttcagttcaattattttcagcatttacaagacatctgaaaatggctattttgctaccaacagtaaatgaaggggctgtttaaaaaccacaaccagttttctacactattttttaaataatactttcatttgaaaaaaaggaattagttttcagatacacttcagagattgaagcaaactatttgccttttactcaaaagcctgcttgcctttacatggacttaccagcaaaataggtagaactttctcttttaaaaaaagtcaactagaattgagaagaggtgattttttttcagatcgcttctcgagtttaatattttcacattcttttcaccctttttctcaatctagatttaaaattaggatatatgtcatttccttgtctgtatttgtagctccttagttaccagtatgcctctccattttctacaaataagaggttataacacatatacataattctaaccttaagggaacacacgtttacatactttacttcccaagcccttcctgtttggggtacagattgagagagtcatgaatcaacacatctagcaagaccacaggtgtaagagtctaagatcgtcttcaaaattctgaagtcccagtctttacctgtccagtgaatgaatattcagagcagcttttcctgggcttcccagtggtgatagctgaggtcaaaccacaaaaaataagaaagcaagagtgaaatgcacccctccagagaaacactttgtagtgtttaattctgttaatagagaagagctgcttctgtttgcgctcacttcatcagtggcacccttctgcagaattttaatataaaaacattatggatataatagaactggattttctgacttaaaaatgtaagttttattttaatcttgaaacgtggattgtttctgtggagctcttaaacatgagaagaatacttacggttgataatgtgtaacatgatctgaaatgtgactaatttgagcctctttgtcccatcgtcctgtttttgaattattgacattgtcagtctctttgcttcctgggtgagacttggggtttgagggacagggaatgaccttcttggtgaaacttaaaatataacattgcaattgcagtgactttacagtgttaaattagagaaaatagtctgattttttaaaccttccttaactggaaaaaagtcacatggttttaccaggattgaaataaacagtcaatgtgacttttaacatgtgtttttttgaaataaagggcacgtactcttcaattaaaaagttccttatagggactctggcaaatgctaacacagttgctttacaatgtttacaattcagacaatacgacttataatagaaaatcctcattcatttagcattgaaaagctggaagttgcttctttaatgttgaatagtatacagtggtattgagcatggactttctaaatgttttatatatacatataaaaatatattggtgtctcacacccagaaagatgttatattgtagatattattaggaaaacagtgtttctcaggaacgttgtaaattttaaatgatatatgtacttcccgtcctcccacctccactctgtgctctaatgtgagactgcttcagcagtgttgctaagttaatggaaaactttttctaatcaagtcaggtgaatgtgtattctgctaaataatgttagccatttacatgaattgtatggtcattaaatggaatcagtgattcctctttaatttccagaggggaaatgaattatggaaatcagtcagcattctgatcattaaattttatactttaattttgccgttcagcattctaaatatccaatgtgaaagtcacatgataatttgttttgcattgcgtgcactgtacaacacttacaacttgtcatttaaaatgttttctcgggaaatgaatgctagtcagaaagtaatagattgtattattcatagttttaaaattatgacaatgtcataattactacaaagctaaataatcgtgtttatttttgtgcagttgccctttgatagttcctggttttaaaacctattaagtgtataatcttacaaatagtcatctacaaaatttatggagaaagtgcccagcccattcacatcacatggaccaggaattcttttgtaaatgacttaaggtaacatcatgcagttcagtgcctaataaatgctttttaatgatgaacatttctataatgactcgtaagataccatagtctgatttttctcacattaaaataactgaagtcacttgtgtaacgtagttatactttgctgcattttaattaaccttcaacagctattaaagtggaatgtaagttaaattttgaaggaaaggaaataaatgttttccatatttcgtcttgatttactttctgtatgagaacagctgtgtttttgataggtttatggtttgcatgagttcatatttaaagtgatccaggccaatgcatggctattgctgtaaatcttgatgtttatttctgccttgtaaagttctatcacggcctacctggaatttaaaattcagtagacaaattaattggtcctctgcacaacttttttaataagtagattattttacaaagaaatttgaacaaatttaattgaatcttttgtttagcttgcctctaagaacttttcttaataaagctcccaaaacttctcagcaaataaatctcccttaagtaggaaagctagatttcatatttgcttactttgaattaacagcaactttccacaggtaaatctgttcttgcaaagatgtgagcagaatagttaaaaataatatttttatgtttcatggttctaaatggaagccataaatgcagtaaatactatctgttgtttaactactttaatcgtcattttttacattttcaagtttattaggttaagaaaaacagggcagccttggaaggcagctactacagaaaactgcagttttgcgttaaagataaagtagtattttcagctccctgaaaaaccattcctgctgaaactgctgtagaaattgtgaagctgcatgagtggagagtattgaatctgtggttatagtagttttctcaggtttgtttatcttgatgtttgatgcactgtgttttatagttattaaaattgagtaatattatttctatgcagtgttatgtgtcattggccttttgtgaatgtgcatgttttaaactgcaaattttaaacattttgtcctctaattgttattaaaaatgaaataaactttaccattacttaaaa

SEQ ID NO: 109663 - DNA, 2238 bp, Homo sapiens
  Payload ID: 1537
  Gene Symbol: ATP8A1
  Gene Name: ATPase, aminophospholipid transporter (APLT), class I, type 8A, member 1
  ENST ID: ENST00000510289
  CDS Start-End: 221-388
agctctgcgggcgccgccaccttcgccgccaccgctgcctttctcctcctcctgtcggcgtgcgggggccgcgcccggcggcagctctgccctaggtgggcggcggcgcggcccaggctgcagctgagcgctctgcgcggcgcagccgggtctcccgcgtgtaccacgccgtgacaggtgcagagtccgggctgaggacccacctgcagccgccgccgcgatgcccaccatgcggaggaccgtgtcggagatccgctcgcgcgccgaaggttatgagaagacagatgatgtttcagagaagacctcactggctgaccaggaggaagtaaggactattttcatcaaccagccccagctgacaaaattctgcaataaccatgtcaggtaagaactaccaaagaatgccatgagaccagccagcagagcagagctggttaggtcaaaatgaaaatgcttgcaaagagctttcagtgcagtcagttaatatttgagagctccctgttggcagtgtgaataggctgtttccccatcttctctcccatagagaaatattcataagaatctggaaatagcgaggagcagaaagaataagcacccatcctctgccgatgctgcatagatattgaataatgaaagctgcttatgtgtaaatgcctctgtcctaaacctgttaatagagcgatgcgttactggttttggttagcaagttttaacattttagaagaggtctttgcaattctgcaccaagaattccttctggttatatagtctttaagtattggtttttgatagttgtgaagtttagtatggtgtggaggaatggagggctgtgcgaattacttcactgcactgttgtgttttcattccaacaataatgtaaaaagtatctgtgtaagcactggccacttatgcggcttctgggaccacataaacaccttcaataccaataaagtgtttctccagtggcagagttaactagatttgagaagtgcccacttaatatgtacaatttcaaattctagaggaacatttctcaatttgggtaatgtggcatgtgtctgctttaatctcctttctatttgataaacaagaggaagatctgggtgtttctaagacctaagtagtgatatcttactgatgtgggcatatctggtgtgtttagtgtggatttctagccatgttcctggagtggcagtgaagaaaattcaaacagaaccccagagatctccctgaaattatccaggaaaggcatctctgtttacagtgtctggtcaaattgctcaaattgctgatttcggggttcttttggcaagattttattttctagtcacacgttgtactctgtcttatggagggctggagccctttaactccaaagttgctcttctttgtaagctacttctagtaatgttaagcagaataattggccaaataggacaaaagattatgcaaaaaaaaaaaaatctgtggtattcatgctttaccatttatttaaccttttcactctttttcatttaggttaatgaccctttgcaatattctcccaatttgaaacagccggcaaatgttccttatctaactttttatatgttagtaacagaactttgtaagtgtgggtgctaattatggagaagttttatgctacttttcatttttgttttctagcactgcaaaatacaacataatcacattccttccaagatttctctactctcagttcagaagagctgctaattcattttttctctttattgcactgctgcaggtaaagtcacgtcataaaaccttgtcaaatgttcaggtactaataaatgttaagcccgtgaccaatcccctgaggtttatgtaaatgccgagagataagctggttttggtggacatttctggctcctgctgcaagcagtgttggaatccactaccttttccagccttttgattcatttttatcagcttattttgggtgttctataaatttgatgtggcaaggactgttcattttgggtggtaaaggggatgggacgttttcttaaaatgctaattttcatagtaaaagtatcaactctgaaccttagaatgcaagaagttaaatcttgtgcttctctttgtatttaaattagttgtagtcagaaaaagttttagtttattaaaaagtagcatattgaacatatgcttaaatttgaaaaaatattttcattgaacttgaaaataaaaaatttttaaaacaccacaaaacacaag

SEQ ID NO: 109664 - DNA, 469 bp, Homo sapiens
  Payload ID: 1537
  Gene Symbol: ATP8A1
  Gene Name: ATPase, aminophospholipid transporter (APLT), class I, type 8A, member 1
  ENST ID: ENST00000515872
  CDS Start-End: 1-342
gtttctcctcttcaaaaatctgaagttgttgagatggttaagaaacaagtcaaagtcgtaacgcttgcaatcggtgatggagcaaatgatgtcagcatgatacagacagcgcacgttggtgttggtatcagtggcaatgaaggcctgcaggcagctaattcctctgactactccatagctcagttcaaatatttgaagaatttactgatgattcatggtgcctggaactataacagagtctccaagtgcatcttatactgcttctacaagaatatagtgctctatattatcgagaacactgacattcaagcaaataacaatttatacagtttatttacatagatttatcaagataccaggaatttaaagccactgccagcaataaatctgcttataaaaagttaattttataaaataagaatgtccaacttgtcgctttttaaatctaaattgacagcaataaagtaga

SEQ ID NO: 109665 - DNA, 326 bp, Homo sapiens
  Payload ID: 1537
  Gene Symbol: ATP8A1
  Gene Name: ATPase, aminophospholipid transporter (APLT), class I, type 8A, member 1
  ENST ID: ENST00000504024
  CDS Start-End: 1-90
aaacgacataaagctgataatgcagtgaacaagaaacaaacgcaagttttgagaaatggtgcttgggaaattgtccactgggaaaagtgagccccaagccatgtgctacattgaaacatccaacttagatggtgaaacaaacttgaaaattagacagggcttaccagcaacatcagatatcaaagacgttgacagtttgatgaggatttctggcagaattgagtgtgaaagtccaaacagacatctctacgattttgttggaaacataaggcttgatggacatggcaccgttccactgggagcagatcagattcttcttcgaggag

SEQ ID NO: 109666 - DNA, 3287 bp, Homo sapiens
  Payload ID: 1538
  Gene Symbol: ATP8A2
  Gene Name: ATPase, aminophospholipid transporter, class I, type 8A, member 2
  ENST ID: ENST00000255283
  CDS Start-End: 1-2985
atgtcccgggccacgtctgttggagaccagctggaggcacccgcccgcaccatttacctcaaccaaccgcatctcaacaaattccgcgacaaccagatcagtacggccaagtacagcgtgttgacatttctacctcgattcttgtatgagcagattagaagagctgctaatgccttctttctcttcattgccttattacagcaaattccagatgtatctccaacaggaagatataccaccctggtgccattgatcattattttaacaattgcaggcatcaaagagattgtagaagattttaagcgacacaaggcagacaatgcagttaacaaaaagaaaacaatagtgttaagaaatggtatgtggcataccattatgtggaaagaggtggcagtgggagacattgtgaaggtcgtcaatgggcagtatcttccagcagatgtggtcctgctgtcatccagtgaacctcaggcaatgtgttatgttgaaacagctaatctggatggggagacgaaccttaaaatacgtcagggtttgagtcacactgctgacatgcaaacacgtgaagttctgatgaagttatctggaactatagagtgtgaagggcccaaccgccacctctatgacttcactggaaacttgaacttagatgggaaaagccttgttgcccttgggcctgaccagatcttattaagaggtacacagcttagaaatactcagtgggtctttggcatagttgtttatactggacacgacaccaaactcatgcagaattcaaccaaagcgcctctcaagagatcaaatgttgagaaggtgactaacgtgcagatcctggtgttgtttggcatcctcttggtcatggccttggtgagctcggcgggggccctgtactggaacaggtctcatggtgaaaagaactggtacatcaagaagatggacaccacctcagataattttggatacaacctactgacgttcatcatcttatacaacaatcttattcccatcagtctgttggtgactcttgaggttgtgaagtatactcaagcccttttcataaactgggacacagatatgtattatataggaaatgacactcctgccatggccaggacatcaaaccttaatgaagagcttgggcaggtgaaatatctcttttctgacaagactggaacgcttacatgcaatatcatgaactttaagaagtgcagcattgccggagtaacctatggtcacttcccagaattggcaagagagccgtcttcagatgacttctgtcggatgcctcctccctgtagtgattcctgtgactttgatgaccccaggctgttgaagaacattgaggatcgccatcccacagccccttgcattcaggagttcctcacccttctggccgtgtgccacacggttgttcctgagaaggatggagataacatcatctaccaggcctcttccccagatgaagctgctttggtgaaaggagctaaaaagctgggctttgtcttcacagccagaacaccattctcagtcatcatagaagcggtgagtaacatgcgtgtgcatttcagatcacctgcttttgtgaagattgtgtgtgtgaaatggcatgtctattgtaaatatgttcaggccacaagggcagccattactcagcactgcactgaccttgggaatttgctgggcaaggaaaatgacgtggccctgatcatcgatggccacaccctgaagtacgcgctctccttcgaagtccggaggagtttcctggatttggcactctcgtgcaaagcggtcatatgctgcagagtgtctcctctgcagaagtctgagatagtggatgtggtgaagaagcgggtgaaggccatcaccctcgccatcggagacggcgccaacgatgtcgggatgatccagacagcccacgtgggtgtgggaatcagtgggaatgaaggcatgcaggccaccaacaactcggattacgccatcgcacagttttcctacttagagaagcttctgttggttcatggagcctggagctacaaccgggtgaccaagtgcatcttgtactgcttctataagaacgtggtcctgtatattattgagctttggttcgcctttgttaatggattttctgggcagattttatttgaacgttggtgcatcggcctgtacaatgtgattttcaccgctttgccgcccttcactctgggaatctttgagaggtcttgcactcaggagagcatgctcaggtttccccagctctacaaaatcacccagaatggcgaaggcttcaacacaaaggttttctggggtcactgcatcaacgccttggtccactccctcatcctcttctggtttcccatgaaagctctggagcatgatactgtgttgacaagtggtcatgctaccgactatttatttgttggaaatattgtttacacatatgttgttgttactgtttgtctgaaagctggtttggagaccacagcttggactaaattcagtcatctggctgtctggggaagcatgctgacctggctggtgttttttggcatctactcgaccatctggcccaccattcccattgctccagatatgagaggacaggcaactatggtcctgagctccgcacacttctggttgggattatttctggttcctactgcctgtttgattgaagatgtggcatggagagcagccaagcacacctgcaaaaagacattgctggaggaggtgcaggagctggaaaccaagtctcgagtcctgggaaaagcggtgctgcgggatagcaatggaaagaggctgaacgagcgcgaccgcctgatcaagaggctgggccggaagacgcccccgacgctgttccggggcagctccctgcagcagggcgtcccgcatgggtatgctttttctcaagaagaacacggagctgttagtcaggaagaagtcatccgtgcttatgacaccaccaaaaagaaatccaggaagaaataagacatgaattttcctgactgatcttaggaaagagattcagtttgttgcacccagtgttaacacatctttgtcagagaagactggcgtcagcagccaaaacaccaggaaacacatttctgtggccttagccaagcagtttgttagttacatattccctcgcaaacctggagtgcagaccacaggggaagctatctttgccctcccaactcgtctgcagtgcttagcctaacttttgtttatgtcgttatgaagcattcaactgtgctctgtgaggtgtgaaattaaaaacattatgtttcacc

SEQ ID NO: 109667 - DNA, 3891 bp, Homo sapiens
  Payload ID: 1538
  Gene Symbol: ATP8A2
  Gene Name: ATPase, aminophospholipid transporter, class I, type 8A, member 2
  ENST ID: ENST00000281620
  CDS Start-End: 393-2324
cctgttcgttcttctttgggctataagaaggcagaggatgagatgtcccgggccacgtctgttggagaccagctggaggcacccgcccgcaccatttacctcaaccaaccgcatctcaacaaattccgcgacaaccagatcagtacggccaagtacagcgtgttgacatttctacctcgattcttgtatgagcagattagaagagctgctaatgccttctttctcttcattgccttattacagatgtatctccaacaggaagatataccaccctggtgccattgatcattattttaacaattgcaggcatcaaagagattgtagaagattttaagcgacacaaggcagacaatgcagttaacaaaaagaaaacaatagtgttaagaaatggtatgtggcataccattatgtggaaagaggtggcagtgggagacattgtgaaggtcgtcaatgggcagtatcttccagcagatgtggtcctgctgtcatccagtgaacctcaggcaatgtgttatgttgaaacagctaatctggatggggagacgaaccttaaaatacgtcagggtttgagtcacactgctgacatgcaaacacgtgaagttctgatgaagttatctggaactatagagtgtgaagggcccaaccgccacctctatgacttcactggaaacttgaacttagatgggaaaagccttgttgcccttgggcctgaccagatcttattaagaggtacacagcttagaaatactcagtgggtctttggcatagttgtttatactggacacgacaccaaactcatgcagaattcaaccaaagcgcctctcaagagatcaaatgttgagaaggtgactaacgtgcagatcctggtgttgtttggcatcctcttggtcatggccttggtgagctcggcgggggccctgtactggaacaggtctcatggtgaaaagaactggtacatcaagaagatggacaccacctcagataattttggatacaacctactgacgttcatcatcttatacaacaatcttattcccatcagtctgttggtgactcttgaggttgtgaagtatactcaagcccttttcataaactgggacacagatatgtattatataggaaatgacactcctgccatggccaggacatcaaaccttaatgaagagcttgggcaggtgaaatatctcttttctgacaagactggaacgcttacatgcaatatcatgaactttaagaagtgcagcattgccggagtaacctatggtcacttcccagaattggcaagagagccgtcttcagatgacttctgtcggatgcctcctccctgtagtgattcctgtgactttgatgaccccaggctgttgaagaacattgaggatcgccatcccacagccccttgcattcaggagttcctcacccttctggccgtgtgccacacggttgttcctgagaaggatggagataacatcatctaccaggcctcttccccagatgaagctgctttggtgaaaggagctaaaaagctgggctttgtcttcacagccagaacaccattctcagtcatcatagaagcgatgggacaggaacaaacattcggaatccttaatgtcctggaattttctagtgacagaaaaagaatgtctgtaattgttcgaactccttcaggacgacttcggctttactgtaaaggggctgataatgtgatttttgagagactttcaaaagactcaaaatatatggaggaaacattatgccatctggaatactttgccacggaaggcttgcggactctctgtgtggcttatgctgatctctctgagaatgagtatgaggagtggctgaaagtctatcaggaagccagcaccatattgaaggacagagctcaacggttggaagagtgttacgagatcattgagaagaatttgctgctacttggagccacagccatagaagatcgccttcaagcaggagttccagaaaccatcgcaacactgttgaaggcagaaattaaaatatgggtgttgacaggagacaaacaagaaactgcgattaatatagggtattcctgccgattggtatcgcagaatatggcccttatcctattgaaggaggactctttggatgccacaagggcagccattactcagcactgcactgaccttgggaatttgctgggcaaggaaaatgacgtggccctgatcatcgatggccacaccctgaagtacgcgctctccttcgaagtccggaggagtttcctggatttggcactctcgtgcaaagcggtcatatgctgcaggtctttatttttgtccaaatggagataaattctctagcacagactaccaggggagaggactttgacctcttgagaacactcagaaatctttaaagtgactgtctcgtcaggaaaagagtcatgaaagaatcatcagtgaccccctgtgaggacgttagtgatggccccatcagagtccccagcaaatacagagtgtctcctctgcagaagtctgagatagtggatgtggtgaagaagcgggtgaaggccatcaccctcgccatcggagacggcgccaacgatgtcgggatgatccagacagcccacgtgggtgtgggaatcagtgggaatgaaggcatgcaggccaccaacaactcggattacgccatcgcacagttttcctacttagagaagcttctgttggttcatggagcctggagctacaaccgggtgaccaagtgcatcttgtactgcttctataagaacgtggtcctgtatattattgagctttggttcgcctttgttaatggattttctgggcagattttatttgaacgttggtgcatcggcctgtacaatgtgattttcaccgctttgccgcccttcactctgggaatctttgagaggtcttgcactcaggagagcatgctcaggtttccccagctctacaaaatcacccagaatggcgaaggcttcaacacaaaggttttctggggtcactgcatcaacgccttggtccactccctcatcctcttctggtttcccatgaaagctctggagcatgatactgtgttgacaagtggtcatgctaccgactatttatttgttggaaatattgtttacacatatgttgttgttactgtttgtctgaaagctggtttggagaccacagcttggactaaattcagtcatctggctgtctggggaagcatgctgacctggctggtgttttttggcatctactcgaccatctggcccaccattcccattgctccagatatgagaggacaggcaactatggtcctgagctccgcacacttctggttgggattatttctggttcctactgcctgtttgattgaagatgtggcatggagagcagccaagcacacctgcaaaaagacattgctggaggaggtgcaggagctggaaaccaagtctcgagtcctgggaaaagcggtgctgcgggatagcaatggaaagaggctgaacgagcgcgaccgcctgatcaagaggctgggccggaagacgcccccgacgctgttccggggcagctccctgcagcagggcgtcccgcatgggtatgctttttctcaagaagaacacggagctgttagtcaggaagaagtcatccgtgcttatgacaccaccaaaaagaaatccaggaagaaataagacatgaattttcctgactgatcttaggaaagagattcagtttgttgcacccagtgttaacacatctttgtcagagaagactggcgtcagcagccaaaacaccaggaaacacatttctgtggccttagccaagcagtttgttagttacatattccctcgcaaacctggagtgcagaccacaggggaagctatctttgccctcccaactcgtctgcagtgct

SEQ ID NO: 109668 - DNA, 9575 bp, Homo sapiens
  Payload ID: 1538
  Gene Symbol: ATP8A2
  Gene Name: ATPase, aminophospholipid transporter, class I, type 8A, member 2
  Uniprot ID: Q9NTI2
  ENST ID: ENST00000381655
  CDS Start-End: 143-3709
acaggcgccggcggtccccgccagctagcagcccggcgaggcgctggcccacccatggtcctcgggcggcggcccctgcgcccagccctgcgcgtagcctccgtctctcgcccggggccgccgagcccccgacacgggcgagatgctgaacggcgcaggcctggacaaagctcttaagatgtccctgccgcggaggtcgaggatccgctcgtccgtgggacctgttcgttcttctttgggctataagaaggcagaggatgagatgtcccgggccacgtctgttggagaccagctggaggcacccgcccgcaccatttacctcaaccaaccgcatctcaacaaattccgcgacaaccagatcagtacggccaagtacagcgtgttgacatttctacctcgattcttgtatgagcagattagaagagctgctaatgccttctttctcttcattgccttattacagcaaattccagatgtatctccaacaggaagatataccaccctggtgccattgatcattattttaacaattgcaggcatcaaagagattgtagaagattttaagcgacacaaggcagacaatgcagttaacaaaaagaaaacaatagtgttaagaaatggtatgtggcataccattatgtggaaagaggtggcagtgggagacattgtgaaggtcgtcaatgggcagtatcttccagcagatgtggtcctgctgtcatccagtgaacctcaggcaatgtgttatgttgaaacagctaatctggatggggagacgaaccttaaaatacgtcagggtttgagtcacactgctgacatgcaaacacgtgaagttctgatgaagttatctggaactatagagtgtgaagggcccaaccgccacctctatgacttcactggaaacttgaacttagatgggaaaagccttgttgcccttgggcctgaccagatcttattaagaggtacacagcttagaaatactcagtgggtctttggcatagttgtttatactggacacgacaccaaactcatgcagaattcaaccaaagcgcctctcaagagatcaaatgttgagaaggtgactaacgtgcagatcctggtgttgtttggcatcctcttggtcatggccttggtgagctcggcgggggccctgtactggaacaggtctcatggtgaaaagaactggtacatcaagaagatggacaccacctcagataattttggatacaacctactgacgttcatcatcttatacaacaatcttattcccatcagtctgttggtgactcttgaggttgtgaagtatactcaagcccttttcataaactgggacacagatatgtattatataggaaatgacactcctgccatggccaggacatcaaaccttaatgaagagcttgggcaggtgaaatatctcttttctgacaagactggaacgcttacatgcaatatcatgaactttaagaagtgcagcattgccggagtaacctatggtcacttcccagaattggcaagagagccgtcttcagatgacttctgtcggatgcctcctccctgtagtgattcctgtgactttgatgaccccaggctgttgaagaacattgaggatcgccatcccacagccccttgcattcaggagttcctcacccttctggccgtgtgccacacggttgttcctgagaaggatggagataacatcatctaccaggcctcttccccagatgaagctgctttggtgaaaggagctaaaaagctgggctttgtcttcacagccagaacaccattctcagtcatcatagaagcgatgggacaggaacaaacattcggaatccttaatgtcctggaattttctagtgacagaaaaagaatgtctgtaattgttcgaactccttcaggacgacttcggctttactgtaaaggggctgataatgtgatttttgagagactttcaaaagactcaaaatatatggaggaaacattatgccatctggaatactttgccacggaaggcttgcggactctctgtgtggcttatgctgatctctctgagaatgagtatgaggagtggctgaaagtctatcaggaagccagcaccatattgaaggacagagctcaacggttggaagagtgttacgagatcattgagaagaatttgctgctacttggagccacagccatagaagatcgccttcaagcaggagttccagaaaccatcgcaacactgttgaaggcagaaattaaaatatgggtgttgacaggagacaaacaagaaactgcgattaatatagggtattcctgccgattggtatcgcagaatatggcccttatcctattgaaggaggactctttggatgccacaagggcagccattactcagcactgcactgaccttgggaatttgctgggcaaggaaaatgacgtggccctgatcatcgatggccacaccctgaagtacgcgctctccttcgaagtccggaggagtttcctggatttggcactctcgtgcaaagcggtcatatgctgcagagtgtctcctctgcagaagtctgagatagtggatgtggtgaagaagcgggtgaaggccatcaccctcgccatcggagacggcgccaacgatgtcgggatgatccagacagcccacgtgggtgtgggaatcagtgggaatgaaggcatgcaggccaccaacaactcggattacgccatcgcacagttttcctacttagagaagcttctgttggttcatggagcctggagctacaaccgggtgaccaagtgcatcttgtactgcttctataagaacgtggtcctgtatattattgagctttggttcgcctttgttaatggattttctgggcagattttatttgaacgttggtgcatcggcctgtacaatgtgattttcaccgctttgccgcccttcactctgggaatctttgagaggtcttgcactcaggagagcatgctcaggtttccccagctctacaaaatcacccagaatggcgaaggcttcaacacaaaggttttctggggtcactgcatcaacgccttggtccactccctcatcctcttctggtttcccatgaaagctctggagcatgatactgtgttgacaagtggtcatgctaccgactatttatttgttggaaatattgtttacacatatgttgttgttactgtttgtctgaaagctggtttggagaccacagcttggactaaattcagtcatctggctgtctggggaagcatgctgacctggctggtgttttttggcatctactcgaccatctggcccaccattcccattgctccagatatgagaggacaggcaactatggtcctgagctccgcacacttctggttgggattatttctggttcctactgcctgtttgattgaagatgtggcatggagagcagccaagcacacctgcaaaaagacattgctggaggaggtgcaggagctggaaaccaagtctcgagtcctgggaaaagcggtgctgcgggatagcaatggaaagaggctgaacgagcgcgaccgcctgatcaagaggctgggccggaagacgcccccgacgctgttccggggcagctccctgcagcagggcgtcccgcatgggtatgctttttctcaagaagaacacggagctgttagtcaggaagaagtcatccgtgcttatgacaccaccaaaaagaaatccaggaagaaataagacatgaattttcctgactgatcttaggaaagagattcagtttgttgcacccagtgttaacacatctttgtcagagaagactggcgtcagcagccaaaacaccaggaaacacatttctgtggccttagccaagcagtttgttagttacatattccctcgcaaacctggagtgcagaccacaggggaagctatctttgccctcccaactcgtctgcagtgcttagcctaacttttgtttatgtcgttatgaagcattcaactgtgctctgtgaggtgtgaaattaaaaacattatgtttcaccaatatttaaacatcagtactagttgtcctgggagaaagggaaaggagttttatgttgcgtgagaggcccatcctgtgtaattggagcagggcacacttgcttcctgttgagttaactcagaggttaagtccaacgggccacatgcagacttcactgtaggcaggttgctctcctgctttgattcctgttttgtgtgtaaaattggcataaacttcttgattgcagtgaaatcacaaaattctctatcggggtggtcaacctgagaacatttatttgaacctcttagccacatttccagcagggcaaaccaactgatgccctggaagagtcttccgcaccctctccaggtgcactcggcccagtcctgccgccgtgtccaggcgcccctcacccccacacctgctgcatggctggccacaccactcagtgcatggcggccgatgggcagccaacccaaacccgcgcctttccttgttccactgcagactcagatacagatgcgaaaaattccttcttccaccgcccttctcgttctgtaaagaaagaaaagaaacatagcctttctgcatatattctaaacgtctctctgcctctgtctgacatggggccaccccacaggtcagagtggtggtagaaccccttcaggactcccagccgtggtcaggctctgaatactcccttcccaacatccagactgctgggcctttggcatccacttacattagaacccacgtttgtttcagagcacattttggactttcactgttgggaaatgaatgaatttataacatgcctgcacagcgaaggaacacacctgtcgctcttagctctagagtcagaggatgagtaaacccagatgcaagagtataggacattgagtggggagaacaagacgaccacagaagtcctcagaaggagaaggaaggacacggagacactgagaggaggacacagaggaatcgccaccagatctttgcagtagaaactctgaaataggccttgagacccagacaattgtcatgatcagcccagtgtgtatgagagcttaaacaagaccttcacacacagttctaattgaaaagaattccaaacatttcagggaaacacctttttaaaaaatatactgacatggtttcctttctgtatcccatcagtgttagacacaggtacctatcagaatacggcatatcctgaattatctaagacaaggaagtgaagagcggaatcactgactttcccaactgcagagtcccacacttaaatctcaacagaacctagatgtcttcaggcatgaatgtgagcacctggagcccttactaaacaacctgcctggagccctgttctctgctctggttgccaaaccagatttttggatggcctaaatacttgtgggcaactgttactggtgaaaaatgggagtggagagcatgttttggattttcactgtggggaaatgaatgaatttatcacatgactgtgcagcgaaggagcacacctgtcactcttagctctagagtcggaggatgagtcaaccctgtaggaatgattgtgctaaattaggaaataacactttagtgcactttgcttcctaacccttttttgtcagaaatctacaacctactgggcatggaaatgatttaaaatatgatctgcattgactaagaaaactcatcctcacttatgaggtgaccaggatgcagagagggcctgaggggcagcagaacaatgcaattcacaggtgaggctccaaaaagggccatttctttctccccaaggtgcatagaacatttttaaatatcagagtacccagcaagacggaaggactgtcatgcaggaactctaacacaaaatgtgcctatgactaacacgacaaaccaaggtgtatggtttctttgcacacccagaaaggtgatggccaagatacagaggagaaacgaaaactggaattgaatgtgcattaggcatcttaactattcatattttgtctcatttgggaactaagcctatttggaaagagtggattagaaattgaattctttgtcaaacagttagctctgtcttgaacttgaagccttccaaatcagaattatgtatttaagtgtgtgtttgtgtttgtttggggtttttgtttcttacattagagttcatattttctgggatttaaggatacaggtgtattttcctattctcttgagaagtagactaaacaatatttgcagtgatgacagacgcacacagaagaaaacattagaagagatgcctttctatcctctcatgtggttgagcattcttacagccaaatgactaaattggctgtaaattggtttctaggaggagcagctgtcactacgtgtgatgtataatatttagccagggccaactcaggggctgtgtcatttgtcctatctttaaattgaggtcagagtgtcacacacaacccctcccctggggcagggtggactggactaggttgcatacgctggctgtcagctcagcaaaaatgccacatggggcttgtcactccgccagacactcactgactcacgggctggcaggtcacgctcggttagcgctccagggcctgactctggattgagctaaactggcagaatccactcaggccaacccttggtctactgctgtgtacagacagcccagtcctgtgttgagtctctcttctcctggatgaccctgcaaaaggaagagaccagttgtactgtgggcttagttctgggtttccactgcacactgacacgtgccagcaagggtagctgtggaaaacacgtatcaggagagcagagtagtctggatgaatactctgtgctgatcagaacgggctcggtcataatttaggagtggagctgatgtgtctgtcctgcctcagtgcagaatattccaggcttcttgaccagggttatgttcacccatctcccaacacacacatgcacacatgaaaacaaaaacatggtaactcttttggttcggcacaccatacaaaacgtgctttggggcgaggagtgctgtttcttttaacacttgtagaggaatatcctgagaagtgaacctgggctttgggagagctcagctgagaattctgttgacattttctttcccttgacaaggcttcaggttcgtctcactatagggagctggctgtgaaaatcagtaataacttgtcaagaagcagtgaaaaatgcgggggggtggaaagagcctaggtaactaatgtcttataatgcatatgtatgtaaatattacaggatttaaggttgaattttttaaaaagaaagttatagtctgtaatttccatttgttataataatgacctttaatcttgtcatttggaaccataaagcatttttatcaggtacctctgttccaagggatttatgtcttagaccatagctgaattgaatgtttgcaaaacactgctataggataaggtggtctttagttttgaacgtgtgaaaggactgcacacttttcagccagggtttgagttactgcccagggtcatcgtctcaaagtaattcaaggagtgatttaacatcagcatttgaaatgtagtcttcatctcctgggatccataaaaaaatgtgaacagggaaatggtggctaagcagagcctgaaataataacttggcaaagaaatgagtttatcaggtcgagtcaaaacatggcatcccctgttacactcaagaaatgttttcttcatgtaaatgtttatacgggcatatataatcacaatgggaacagttaaaaccccctcccttcaaaaaaagaaaatctatatcagttgggtttggttttggttcttcattggctcaaggcagttaactgtctcagtatagccttcggggagatttaacctcattctagccatttttccatcctgaaggccaagaaggactattagaagggtttttgaggggtttcggaggtgagggcccaagacccccataatgacatcattaggcattcttgaaaggtgttaacagaccagcacgctcgatgtgttgtacccttcatttatttttttttctcagcatcccaagttgtccatcagtacattccccttcaccttacctgatcttcatttaatgcccagtctgtaactaatgttctgtttaaagctctcttaatttgttggctatgagtgatttgtgaatctgggatgtaaccctgagtgaggagaaaagggcattgagccagcataaatctgaatgggcagaagccacaaacaaatgggagcagaaaagaagggcgagctcccccgcgccgcaccccgtgtataatccagtgttaacctctgaggaacacctcggctctcccaactgaggagagacaaaagagggattctttttacacccaggctggcgcattttcaagtgacaatctcgggctctagttgcctttgagatatccactctgctctttctcccaggcctcagaccaagaaaaacatgctctcaagattagcccataggcagttcttgtgacctggctgaagaaagaaaggagacctgtttgttttaaaagtcgggcgcaaagtgtcaggtggctttgatttatgacagaaagaggaagaagaaagttggagtaatagcactatccaaataaccctgcccaggaaacttgggggtcaagagagcttatcaagagccttttataggtaagctcttccgtgtgaaagagaaaaggccggaaagagggagagagcccagagagcaggctgcgaactcacttccaatgggattggagtctgttgtattcttaagagatagcctgatatgtggtttataggtgaatcaataaacaccaacaacaacaaaaaaaaaaaaaaaaaaaaaggaagaaaagaaaaaaaggaaaccagccctgtcatggaatttctctccttccctgcacagtaaagacttttgggttttcatggataaaatcaatgtcagtactgaaactcctactctcccctcccgccccactctcccccgttgcccgagatggccaagttcaggcctgtgcaatgccgcttccctctgagcctccctctcaagggccacgcaggcagctgcagcagggccagctgcaggatggggctgccggtcactgaattgtcgttcaaatgcatcatctttgtggcgtctttctcatgcgagcaaagccacgtgctctcctgtctgctgtcacatctgtgcctggattgcttaaatattgtttgtgatggggaggttttaatctggtgatgcagagggaagcagggctgtgggggcacgtttaattggctcccagcagcgtggggggtgcttctatggtgtgtggggttttttgttgcctccctctagaagtgttaccgttttcacgtcctattaatgtcctctggttgttaaattacagcagcacattacagtgcactgggttccctcctggagtgaatacaaacggagggcatctacttgtatttttagaagttttgggagaatttagtgatttgtggctttgatcaatcctgttgactggtgtatgtctgcgcaaacctgtttcaaataaatcttttgttaaagtaa

SEQ ID NO: 109669 - DNA, 5818 bp, Homo sapiens
  Payload ID: 1539
  Gene Symbol: ATP8B1
  Gene Name: ATPase, aminophospholipid transporter, class I, type 8B, member 1
  Uniprot ID: O43520
  ENST ID: ENST00000283684
  CDS Start-End: 1-3756
atgagtacagaaagagactcagaaacgacatttgacgaggattctcagcctaatgacgaagtggttccctacagtgatgatgaaacagaagatgaacttgatgaccaggggtctgctgttgaaccagaacaaaaccgagtcaacagggaagcagaggagaaccgggagccattcagaaaagaatgtacatggcaagtcaaagcaaacgatcgcaagtaccacgaacaacctcactttatgaacacaaaattcttgtgtattaaggagagtaaatatgcgaataatgcaattaaaacatacaagtacaacgcatttacctttataccaatgaatctgtttgagcagtttaagagagcagccaatttatatttcctggctcttcttatcttacaggcagttcctcaaatctctaccctggcttggtacaccacactagtgcccctgcttgtggtgctgggcgtcactgcaatcaaagacctggtggacgatgtggctcgccataaaatggataaggaaatcaacaataggacgtgtgaagtcattaaggatggcaggttcaaagttgctaagtggaaagaaattcaagttggagacgtcattcgtctgaaaaaaaatgattttgttccagctgacattctcctgctgtctagctctgagcctaacagcctctgctatgtggaaacagcagaactggatggagaaaccaatttaaaatttaagatgtcacttgaaatcacagaccagtacctccaaagagaagatacattggctacatttgatggttttattgaatgtgaagaacccaataacagactagataagtttacaggaacactattttggagaaacacaagttttcctttggatgctgataaaattttgttacgtggctgtgtaattaggaacaccgatttctgccacggcttagtcatttttgcaggtgctgacactaaaataatgaagaatagtgggaaaaccagatttaaaagaactaaaattgattacttgatgaactacatggtttacacgatctttgttgttcttattctgctttctgctggtcttgccatcggccatgcttattgggaagcacaggtgggcaattcctcttggtacctctatgatggagaagacgatacaccctcctaccgtggattcctcattttctggggctatatcattgttctcaacaccatggtacccatctctctctatgtcagcgtggaagtgattcgtcttggacagagtcacttcatcaactgggacctgcaaatgtactatgctgagaaggacacacccgcaaaagctagaaccaccacactcaatgaacagctcgggcagatccattatatcttctctgataagacggggacactcacacaaaatatcatgacctttaaaaagtgctgtatcaacgggcagatatatggggaccatcgggatgcctctcaacacaaccacaacaaaatagagcaagttgattttagctggaatacatatgctgatgggaagcttgcattttatgaccactatcttattgagcaaatccagtcagggaaagagccagaagtacgacagttcttcttcttgctcgcagtttgccacacagtcatggtggataggactgatggtcagctcaactaccaggcagcctctcccgatgaaggtgccctggtaaacgctgccaggaactttggctttgccttcctcgccaggacccagaacaccatcaccatcagtgaactgggcactgaaaggacttacaatgttcttgccattttggacttcaacagtgaccggaagcgaatgtctatcattgtaagaaccccagaaggcaatatcaagctttactgtaaaggtgctgacactgttatttatgaacggttacatcgaatgaatcctactaagcaagaaacacaggatgccctggatatctttgcaaatgaaactcttagaaccctatgcctttgctacaaggaaattgaagaaaaagaatttacagaatggaataaaaagtttatggctgccagtgtggcctccaccaaccgggacgaagctctggataaagtatatgaggagattgaaaaagacttaattctcctgggagctacagctattgaagacaagctacaggatggagttccagaaaccatttcaaaacttgcaaaagctgacattaagatctgggtgcttactggagacaaaaaggaaactgctgaaaatataggatttgcttgtgaacttctgactgaagacaccaccatctgctatggggaggatattaattctcttcttcatgcaaggatggaaaaccagaggaatagaggtggcgtctacgcaaagtttgcacctcctgtgcaggaatctttttttccacccggtggaaaccgtgccttaatcatcactggttcttggttgaatgaaattcttctcgagaaaaagaccaagagaaataagattctgaagctgaagttcccaagaacagaagaagaaagacggatgcggacccaaagtaaaaggaggctagaagctaagaaagagcagcggcagaaaaactttgtggacctggcctgcgagtgcagcgcagtcatctgctgccgcgtcacccccaagcagaaggccatggtggtggacctggtgaagaggtacaagaaagccatcacgctggccatcggagatggggccaatgacgtgaacatgatcaaaactgcccacattggcgttggaataagtggacaagaaggaatgcaagctgtcatgtcgagtgactattcctttgctcagttccgatatctgcagaggctactgctggtgcatggccgatggtcttacataaggatgtgcaagttcctacgatacttcttttacaaaaactttgcctttactttggttcatttctggtactccttcttcaatggctactctgcgcagactgcatacgaggattggttcatcaccctctacaacgtgctgtacaccagcctgcccgtgctcctcatggggctgctcgaccaggatgtgagtgacaaactgagcctccgattccctgggttatacatagtgggacaaagagacttactattcaactataagagattctttgtaagcttgttgcatggggtcctaacatcgatgatcctcttcttcatacctcttggagcttatctgcaaaccgtagggcaggatggagaggcaccttccgactaccagtcttttgccgtcaccattgcctctgctcttgtaataacagtcaatttccagattggcttggatacttcttattggacttttgtgaatgctttttcaatttttggaagcattgcactttattttggcatcatgtttgactttcatagtgctggaatacatgttctctttccatctgcatttcaatttacaggcacagcttcaaacgctctgagacagccatacatttggttaactatcatcctggctgttgctgtgtgcttactacccgtcgttgccattcgattcctgtcaatgaccatctggccatcagaaagtgataagatccagaagcatcgcaagcggttgaaggcggaggagcagtggcagcgacggcagcaggtgttccgccggggcgtgtcaacgcggcgctcggcctacgccttctcgcaccagcggggctacgcggacctcatctcctccgggcgcagcatccgcaagaagcgctcgccgcttgatgccatcgtggcggatggcaccgcggagtacaggcgcaccggggacagctgatcccttacccccaggctgggatgcggccacaaagcacgtctatttttttatgaaagactctcaggactttgtgtgtgtgtgtgaattgcattcatcacaaagatattgaagacaataaataatctttataacaaactccttgggttggactattaaacaatagcagagccaagaaataggacttttaaaagtcctattattcggccgggcgtggtggctcaggtctgtaatcccagcactttaggaggctgaggaggggagatcacctgaggccaggagttcgagaccagcccagccaacatggtgaaaccctgtctctaccataaattaaaaattagccgggcttggtggtgggcacccgtaatcccacctatttgagaagctgaagcagaagaatcgcttgaacctgggagatggaggttacagtgagccgagattgcgccactgcactccagcctgggtgacagagcaagactctgtcttaagaaaaatttaaaaataggccgggcatggtggctcatgcctgtcatcctagcactttgggaggccaaggcaggtggatcacttgaggtcaggagaccagcccggccaacatggtgaaaccccatctctactaaaaatacaaaaattagctggaaatcgcttgaacctgggaggtggaggttccagtgagccgagatcgtggcactgcactccaacctgagcaacagagtgagacaccagctcaaaaaaaattttttaataataataaaagtcctattattcaactggttatgtacattatggttgaaagggaacgttttaatccagtctcaatccagggcaatagaattacaaagcatgttgtatttcagttcaaatggtattgtattataaaattacagttacattttcctttcggtgatcttcagcataatttcccagaggcccctttttcctccctataggccatcttattaacagattttaaaatttatagtaatgacaaatgacttatcagtgttcatcatctgaaagctaagtggttcgttcaatcactttttcaaagttgatagtagattgcatggtttcatgtttcctcatattggtttattaattctatttaatcaaggaaaataacttcagattccataaagtttcagtttatttttagtttactactaggtgagatagcacattacatacttttactatcaaatattattttagcagcttcccatagtaccaaatgatttgattccctactctcattttttaaagcatataaatatttatgggcttaaaaagggggtttttaaaaactgaggatatcagtaataaattgcagaatattttgcaaagctttcttttggaaagcaaacttttgtgcctgcctatatgcaaagtattttatcagggacttgaacaaagacctcactctttttcacttgtcttatgtcgagagaaaaggttattggcagccacattcctaagactggggaatggtgtgtccttttaaatttgaagataactttaggtaattatggaaactcctcaaagaggagaaagtaatttttttccagacatttttctcattctgtgtctttcacacactagtttccatagttcgagaattctgttttttaccattgggctgtgaatgttcacaatatcagtcctgttgaattcctatgaggtaatcacaatgtgtatatgttcattttctaggtatgataaaagaatgtatggctttttattctgtggaagtaaaatcctgaacgtttacaacttttccttaacttgtaaataaaaaattgtaagttttttctttttttacagaaaacttagcttgtgtaattctgttagtttcagatttctctcctgtttttgcaaattgtgggaaagattgacaatgcaaatgtgtcaaagacatactgttgggtgcaatattaacaattttaaatgcaaatttctttggataaattatttctatattctgtaaatctgagatttaatgtatattttgtttaaaaaaatgatttagtaaaatctttgaaaagtatgatcttctaaagtatttaaa

SEQ ID NO: 109670 - DNA, 5935 bp, Homo sapiens
  Payload ID: 1539
  Gene Symbol: ATP8B1
  Gene Name: ATPase, aminophospholipid transporter, class I, type 8B, member 1
  Uniprot ID: O43520
  ENST ID: ENST00000536015
  CDS Start-End: 121-3876
tggggccgggcgggcggcggcagcggccaggtgcgcagcgagcgctccgagcggcgcgcaccaggcggatgccccagccggggcccagcgaacgccaggtagttccaatttgccagcagaatgagtacagaaagagactcagaaacgacatttgacgaggattctcagcctaatgacgaagtggttccctacagtgatgatgaaacagaagatgaacttgatgaccaggggtctgctgttgaaccagaacaaaaccgagtcaacagggaagcagaggagaaccgggagccattcagaaaagaatgtacatggcaagtcaaagcaaacgatcgcaagtaccacgaacaacctcactttatgaacacaaaattcttgtgtattaaggagagtaaatatgcgaataatgcaattaaaacatacaagtacaacgcatttacctttataccaatgaatctgtttgagcagtttaagagagcagccaatttatatttcctggctcttcttatcttacaggcagttcctcaaatctctaccctggcttggtacaccacactagtgcccctgcttgtggtgctgggcgtcactgcaatcaaagacctggtggacgatgtggctcgccataaaatggataaggaaatcaacaataggacgtgtgaagtcattaaggatggcaggttcaaagttgctaagtggaaagaaattcaagttggagacgtcattcgtctgaaaaaaaatgattttgttccagctgacattctcctgctgtctagctctgagcctaacagcctctgctatgtggaaacagcagaactggatggagaaaccaatttaaaatttaagatgtcacttgaaatcacagaccagtacctccaaagagaagatacattggctacatttgatggttttattgaatgtgaagaacccaataacagactagataagtttacaggaacactattttggagaaacacaagttttcctttggatgctgataaaattttgttacgtggctgtgtaattaggaacaccgatttctgccacggcttagtcatttttgcaggtgctgacactaaaataatgaagaatagtgggaaaaccagatttaaaagaactaaaattgattacttgatgaactacatggtttacacgatctttgttgttcttattctgctttctgctggtcttgccatcggccatgcttattgggaagcacaggtgggcaattcctcttggtacctctatgatggagaagacgatacaccctcctaccgtggattcctcattttctggggctatatcattgttctcaacaccatggtacccatctctctctatgtcagcgtggaagtgattcgtcttggacagagtcacttcatcaactgggacctgcaaatgtactatgctgagaaggacacacccgcaaaagctagaaccaccacactcaatgaacagctcgggcagatccattatatcttctctgataagacggggacactcacacaaaatatcatgacctttaaaaagtgctgtatcaacgggcagatatatggggaccatcgggatgcctctcaacacaaccacaacaaaatagagcaagttgattttagctggaatacatatgctgatgggaagcttgcattttatgaccactatcttattgagcaaatccagtcagggaaagagccagaagtacgacagttcttcttcttgctcgcagtttgccacacagtcatggtggataggactgatggtcagctcaactaccaggcagcctctcccgatgaaggtgccctggtaaacgctgccaggaactttggctttgccttcctcgccaggacccagaacaccatcaccatcagtgaactgggcactgaaaggacttacaatgttcttgccattttggacttcaacagtgaccggaagcgaatgtctatcattgtaagaaccccagaaggcaatatcaagctttactgtaaaggtgctgacactgttatttatgaacggttacatcgaatgaatcctactaagcaagaaacacaggatgccctggatatctttgcaaatgaaactcttagaaccctatgcctttgctacaaggaaattgaagaaaaagaatttacagaatggaataaaaagtttatggctgccagtgtggcctccaccaaccgggacgaagctctggataaagtatatgaggagattgaaaaagacttaattctcctgggagctacagctattgaagacaagctacaggatggagttccagaaaccatttcaaaacttgcaaaagctgacattaagatctgggtgcttactggagacaaaaaggaaactgctgaaaatataggatttgcttgtgaacttctgactgaagacaccaccatctgctatggggaggatattaattctcttcttcatgcaaggatggaaaaccagaggaatagaggtggcgtctacgcaaagtttgcacctcctgtgcaggaatctttttttccacccggtggaaaccgtgccttaatcatcactggttcttggttgaatgaaattcttctcgagaaaaagaccaagagaaataagattctgaagctgaagttcccaagaacagaagaagaaagacggatgcggacccaaagtaaaaggaggctagaagctaagaaagagcagcggcagaaaaactttgtggacctggcctgcgagtgcagcgcagtcatctgctgccgcgtcacccccaagcagaaggccatggtggtggacctggtgaagaggtacaagaaagccatcacgctggccatcggagatggggccaatgacgtgaacatgatcaaaactgcccacattggcgttggaataagtggacaagaaggaatgcaagctgtcatgtcgagtgactattcctttgctcagttccgatatctgcagaggctactgctggtgcatggccgatggtcttacataaggatgtgcaagttcctacgatacttcttttacaaaaactttgcctttactttggttcatttctggtactccttcttcaatggctactctgcgcagactgcatacgaggattggttcatcaccctctacaacgtgctgtacaccagcctgcccgtgctcctcatggggctgctcgaccaggatgtgagtgacaaactgagcctccgattccctgggttatacatagtgggacaaagagacttactattcaactataagagattctttgtaagcttgttgcatggggtcctaacatcgatgatcctcttcttcatacctcttggagcttatctgcaaaccgtagggcaggatggagaggcaccttccgactaccagtcttttgccgtcaccattgcctctgctcttgtaataacagtcaatttccagattggcttggatacttcttattggacttttgtgaatgctttttcaatttttggaagcattgcactttattttggcatcatgtttgactttcatagtgctggaatacatgttctctttccatctgcatttcaatttacaggcacagcttcaaacgctctgagacagccatacatttggttaactatcatcctggctgttgctgtgtgcttactacccgtcgttgccattcgattcctgtcaatgaccatctggccatcagaaagtgataagatccagaagcatcgcaagcggttgaaggcggaggagcagtggcagcgacggcagcaggtgttccgccggggcgtgtcaacgcggcgctcggcctacgccttctcgcaccagcggggctacgcggacctcatctcctccgggcgcagcatccgcaagaagcgctcgccgcttgatgccatcgtggcggatggcaccgcggagtacaggcgcaccggggacagctgatcccttacccccaggctgggatgcggccacaaagcacgtctatttttttatgaaagactctcaggactttgtgtgtgtgtgtgaattgcattcatcacaaagatattgaagacaataaataatctttataacaaactccttgggttggactattaaacaatagcagagccaagaaataggacttttaaaagtcctattattcggccgggcgtggtggctcaggtctgtaatcccagcactttaggaggctgaggaggggagatcacctgaggccaggagttcgagaccagcccagccaacatggtgaaaccctgtctctaccataaattaaaaattagccgggcttggtggtgggcacccgtaatcccacctatttgagaagctgaagcagaagaatcgcttgaacctgggagatggaggttacagtgagccgagattgcgccactgcactccagcctgggtgacagagcaagactctgtcttaagaaaaatttaaaaataggccgggcatggtggctcatgcctgtcatcctagcactttgggaggccaaggcaggtggatcacttgaggtcaggagaccagcccggccaacatggtgaaaccccatctctactaaaaatacaaaaattagctggaaatcgcttgaacctgggaggtggaggttccagtgagccgagatcgtggcactgcactccaacctgagcaacagagtgagacaccagctcaaaaaaaattttttaataataataaaagtcctattattcaactggttatgtacattatggttgaaagggaacgttttaatccagtctcaatccagggcaatagaattacaaagcatgttgtatttcagttcaaatggtattgtattataaaattacagttacattttcctttcggtgatcttcagcataatttcccagaggcccctttttcctccctataggccatcttattaacagattttaaaatttatagtaatgacaaatgacttatcagtgttcatcatctgaaagctaagtggttcgttcaatcactttttcaaagttgatagtagattgcatggtttcatgtttcctcatattggtttattaattctatttaatcaaggaaaataacttcagattccataaagtttcagtttatttttagtttactactaggtgagatagcacattacatacttttactatcaaatattattttagcagcttcccatagtaccaaatgatttgattccctactctcattttttaaagcatataaatatttatgggcttaaaaagggggtttttaaaaactgaggatatcagtaataaattgcagaatattttgcaaagctttcttttggaaagcaaacttttgtgcctgcctatatgcaaagtattttatcagggacttgaacaaagacctcactctttttcacttgtcttatgtcgagagaaaaggttattggcagccacattcctaagactggggaatggtgtgtccttttaaatttgaagataactttaggtaattatggaaactcctcaaagaggagaaagtaatttttttccagacatttttctcattctgtgtctttcacacactagtttccatagttcgagaattctgttttttaccattgggctgtgaatgttcacaatatcagtcctgttgaattcctatgaggtaatcacaatgtgtatatgttcattttctaggtatgataaaagaatgtatggctttttattctgtggaagtaaaatcctgaacgtttacaacttttccttaacttgtaaataaaaaattgtaagttttttctttttttacagaaaacttagcttgtgtaattctgttagtttcagatttctctcctgtttttgcaaattgtgggaaagattgacaatgcaaatgtgtcaaagacatactgttgggtgcaatattaacaattttaaatgcaaatttctttggataaattatttctatattctgtaaatctgagatttaatgtatattttgtttaaaaaaatgatttagtaaaatctttgaaaagtatgatcttctaaagtattt

SEQ ID NO: 109671 - DNA, 532 bp, Homo sapiens
  Payload ID: 1539
  Gene Symbol: ATP8B1
  Gene Name: ATPase, aminophospholipid transporter, class I, type 8B, member 1
  ENST ID: ENST00000591728
  CDS Start-End: 127-312
cagggctggggccgggcgggcggcggcagcggccaggtgcgcagcgagcgctccgagcggcgcgcaccaggcggatgccccagccggggcccagcgaacgccaggtagttccaatttgccagcagaatgagtacagaaagagactcagaaacgacatttgacgaggattctcagcctaatgacgaagtggttccctacagtgatgatgaaacagaagatgaacttgatgaccaggggtctgctgttgaaccagaacaaaaccgagtcaacagggaagcagaggagaaccgggagccattcagaaaagaataatgcaattaaaacatacaagtacaacgcatttacctttataccaatgaatctgtttgagcagtttaagagagcagccaatttatatttcctggctcttcttatcttacaggcagttcctcaaatctctaccctggcttggtacaccacactagtgcccctgcttgtggtgctgggcgtcactgcaatcaaagacctggtggacgatgtggctcgccataaa

SEQ ID NO: 109672 - DNA, 489 bp, Homo sapiens
  Payload ID: 1539
  Gene Symbol: ATP8B1
  Gene Name: ATPase, aminophospholipid transporter, class I, type 8B, member 1
  ENST ID: ENST00000588255
  CDS Start-End: 214-489
ggggattgggtttcaacatatgaatttggagggggattctaacattcagaccatagcagtaaataagcagcttgctctcgtctgtacaatgagaataaaatctctactacttgccactcgtatccgagctctctacggaaaataatcttctgtcttcctagcgtggaagtgattcgtcttggacagagtcacttcatcaactgggacctgcaaatgtactatgctgagaaggacacacccgcaaaagctagaaccaccacactcaatgaacagctcgggcagatccattatatcttctctgataagacggggacactcacacaaaatatcatgacctttaaaaagtgctgtatcaacgggcagatatatggggaccatcgggatgcctctcaacacaaccacaacaaaatagagcaagttgattttagctggaatacatatgctgatgggaagcttgcattttatgaccactatcttattgagcaaatc

SEQ ID NO: 109673 - DNA, 527 bp, Homo sapiens
  Payload ID: 1539
  Gene Symbol: ATP8B1
  Gene Name: ATPase, aminophospholipid transporter, class I, type 8B, member 1
  ENST ID: ENST00000585322
  CDS Start-End: 495-527
gactccatctcaaaaaataaagcagcaaggttcaggaactcaggcttattttaaaaaaaagaaaatgaagaagaagaaagaaggaaaaggggctggatatggtagctcatgcctgtaatcccagtattttgtgaggccaaggagggaggattgcttgacctcaggagttcaagagcatcctgagcaaactagcaagacctcatctctactaaaaaccaaaaaaattagctgggtgtgatggtgcacacctttagtctcagctacttaggaggctgaggcaggaggatcacttgagcctgggagattgaggctgcagtgagcttgatcaccccagtgtactccagcctaggtgacagagcaagaacttgaatcaacaaccaaaaaaaaaaaaaaaaaggaagaaaaaagaagcaaaccacctcatgtgtatgccacactcacaggaaattaaagatgtgaacaccaaaagcaggtagttccaatttgccagcagaatgagtacagaaagagactcagaaacgacattt

SEQ ID NO: 109674 - DNA, 1523 bp, Homo sapiens
  Payload ID: 1540
  Gene Symbol: ATP8B2
  Gene Name: ATPase, aminophospholipid transporter, class I, type 8B, member 2
  Uniprot ID: P98198
  ENST ID: ENST00000368487
  CDS Start-End: 188-1351
cacaaagtagcgggccgaggccccgggggagcggggccgcagctgggggggcgggagcccgtggggagccgagccgagcgccccccgccccagcccccggcatgggcagtacggggccgccggggcgggcgccgagcgctgagcgctgagggtctcccatgggattgctgggatcttgctgggtgagatggcagtgtgtgcaaaaaagcgccccccagaagaagaaaggagggcgcgggctaatgaccgagaatacaatgagaaattccagtatgcgagtaactgcatcaagacctccaagtacaatattctcaccttcctgcctgtcaacctctttgagcagttccaggaagttgccaacacttacttcctgttcctcctcattctgcagttgatcccccagatctcttccctgtcctggttcaccaccattgtgcctttggttcttgtcctcaccatcacagctgttaaagatgccactgatgactatttccgccacaagagcgataaccaggtgaataaccgccagtctcaggtgctgatcaatggaatcctccagcaggagcagtggatgaatgtctgtgttggtgatattatcaagctagaaaataaccagtttgtggcggcggatctcctcctcctttccagcagtgagccccatgggctgtgttacatagagacagcagaacttgatggcgagaccaacatgaaagtacgtcaggcgattccagtcacctcagaattgggagacatcagtaagcttgccaagtttgacggtgaagtgatctgtgaacctcccaacaacaaactggacaaattcagcggaaccctctactggaaggaaaataagttccctctgagcaaccagaacatgctgctgcggggctgtgtgctgcgaaacaccgagtggtgcttcgggctggtcatctttgcaggtcccgacactaagctgatgcaaaacagcggcagaacaaagttcaaaagaacgagtatcgatcgcctaatgaataccctggtgctctggatttttggattcctggtttgcatgggggtgatcctggccattggcaatgccatctgggagcacgaggtggggatgcgtttccaggtctacctgccgtgggatgaggcagtggacagtgccttcttctctggcttcctctccttctggtcctacatcatcatcctcaacaccgttgtgcccatttcactctatgtcaggtatgtgccttctctgacctggggtctctccagggagtcaggcggtcccatagaacttttcttttctatgaagatgaagtccttgagaagtaacgagaagtcctcttcttcctgtactgtaaacatttgatgttatctgtttatctttgtgggcagagcaaactttttaccacagtttcctggtacttgggactgtattagagaaaaaaaaatattgatttattcagcacctatttattacatgcctactgtgtacaaagaagtgtgctaggtgccatcacaaataaaagatgaattaggaa

SEQ ID NO: 109675 - DNA, 5861 bp, Homo sapiens
  Payload ID: 1540
  Gene Symbol: ATP8B2
  Gene Name: ATPase, aminophospholipid transporter, class I, type 8B, member 2
  Uniprot ID: P98198
  ENST ID: ENST00000368489
  CDS Start-End: 1-3672
atggataccttgagagctgttccccttttttcaatatctggcctcttctcctttccctacagggtctcccatgggattgctgggatcttgctgggtgagatggcagtgtgtgcaaaaaagcgccccccagaagaagaaaggagggcgcgggctaatgaccgagaatacaatgagaaattccagtatgcgagtaactgcatcaagacctccaagtacaatattctcaccttcctgcctgtcaacctctttgagcagttccaggaagttgccaacacttacttcctgttcctcctcattctgcagttgatcccccagatctcttccctgtcctggttcaccaccattgtgcctttggttcttgtcctcaccatcacagctgttaaagatgccactgatgactatttccgccacaagagcgataaccaggtgaataaccgccagtctcaggtgctgatcaatggaatcctccagcaggagcagtggatgaatgtctgtgttggtgatattatcaagctagaaaataaccagtttgtggcggcggatctcctcctcctttccagcagtgagccccatgggctgtgttacatagagacagcagaacttgatggcgagaccaacatgaaagtacgtcaggcgattccagtcacctcagaattgggagacatcagtaagcttgccaagtttgacggtgaagtgatctgtgaacctcccaacaacaaactggacaaattcagcggaaccctctactggaaggaaaataagttccctctgagcaaccagaacatgctgctgcggggctgtgtgctgcgaaacaccgagtggtgcttcgggctggtcatctttgcaggtcccgacactaagctgatgcaaaacagcggcagaacaaagttcaaaagaacgagtatcgatcgcctaatgaataccctggtgctctggatttttggattcctggtttgcatgggggtgatcctggccattggcaatgccatctgggagcacgaggtggggatgcgtttccaggtctacctgccgtgggatgaggcagtggacagtgccttcttctctggcttcctctccttctggtcctacatcatcatcctcaacaccgttgtgcccatttcactctatgtcagtgtggaggtcatccgtctgggccacagctacttcatcaactgggataagaagatgttctgcatgaagaagcggacgcctgcagaagcccgcaccaccaccctaaacgaggagctgggccaggtggagtacatcttctccgacaagacgggcaccctcacccagaacatcatggttttcaacaagtgctccatcaatggccacagctatggtgatgtgtttgacgtcctgggacacaaagctgaattgggagagaggcctgaacctgttgacttctccttcaatcctctggctgacaagaagttcttattttgggaccccagcctgctggaggctgtcaagatcggggacccccacacgcatgagttcttccgcctcctttccctgtgtcatactgtcatgtcagaagaaaagaacgaaggagagctgtactacaaagctcagtccccagatgagggggccctggtcaccgcagccaggaactttggttttgttttccgctctcgcacccccaaaacaatcaccgtccatgagatgggcacagccatcacctaccagctgctggccatcctggacttcaacaacatccgcaagcggatgtcggtcatagtgcggaatccagaggggaagatccgactctactgcaaaggggctgacactatcctactggacagactgcaccactccactcaagagctgctcaacaccaccatggaccaccttaatgagtacgcaggggaagggctgaggaccctggtgctggcctacaaggatctggatgaagagtactacgaggagtgggctgagcgacgcctccaggccagcctggcccaggacagccgggaggacaggctggctagcatctatgaggaggttgagaacaacatgatgctgctgggtgcaacggccattgaggacaaacttcagcaaggggttccagagaccattgccctcctgacactggccaacatcaagatttgggtgctaaccggagacaagcaagagacggctgtgaacatcggctattcctgcaagatgctgacggatgacatgactgaggttttcatagtcactggccatactgtcctggaggtgcgggaggagctcaggaaagcccgggagaagatgatggactcatcccgctccgtaggcaacggcttcacctatcaggacaagctttcttcttccaagctaacttctgtcctggaggccgttgctggggagtacgccctggtcataaatggtcacagcctggcccacgcactggaggcagacatggagctggagtttctggagacagcgtgtgcctgcaaagctgtcatctgctgccgggtgacccccttgcagaaggcacaggtggtagaactggtcaagaagtacaagaaggctgtgacgcttgccattggagacggagccaatgatgtcagcatgatcaaaacggctcacattggtgtggggatcagtgggcaggaagggatccaggctgtcttggcctccgattactccttctcccagttcaagttcctgcagcgcctcctgctggtgcatgggcgctggtcctacctgcgaatgtgcaagtttctttgctatttcttctacaaaaactttgctttcaccatggtccacttctggtttggcttcttctgtggcttctcagcccagaccgtctatgaccagtatttcatcaccctgtataacatcgtgtacacctccctgccagtcctggctatgggggtctttgatcaggatgtccccgagcagcggagcatggagtaccctaagctgtatgagccgggccagctgaaccttctcttcaacaagcgggagttcttcatctgcatcgcccagggcatctacacctccgtgctcatgttcttcattccctatggggtgtttgctgatgccacccgggatgatggcactcagctggctgactaccagtcctttgcagtcactgtggccacatccttggtcattgtggttagcgtgcagattgggctcgacacaggctactggacggccatcaaccacttcttcatctggggaagccttgctgtttactttgccatcctctttgccatgcacagcaatgggctcttcgacatgtttcccaaccagttccggtttgtggggaatgcccagaacaccttggcccagcccacggtgtggctgaccattgtgctcaccacagtcgtctgcatcatgcccgtggttgccttccgattcctcaggctcaacctgaagccggatctctccgacacggtccgctacacacagctcgtgaggaagaagcagaaggcccagcaccgctgcatgcggcgggttggccgcactggctcccggcgctccggctatgccttctcccatcaggagggcttcggggagctcatcatgtctggcaagaacatgcggctgagctctctcgcgctctccagcttcaccacccgctccagctccagctggattgagagcctgcgcaggaagaagagtgacagtgccagtagccccagtggcggtgccgacaagcccctcaagggctgaaggccgaggatggatgccctgtgccagtgaccagagcacccagggctggccagtcactgagggaacagcgtctcggaactgctggtcctcattccttgcttcccgtccccccggtagactctgtcctgctggtcccaccacacatggctgggacatctgttcccagctgtaggcccttccaccagctggggagctagagggagcaggcccaagggcagagcagaggctgaggcacggggagccagccccactcggggaccagaagtggaaccaaaaacaagaaaaaactgtgagagattgtgtctgcccctgccctgcctgggacccacagggagactataatctccttatttttttactcctactccccagaggggccctagtgcctctgttcctgaattacataagaatgtaccatgccgggaagccagagacctgcaggggcctcggcccctcacatcgtgtatgtctctccttgatttgtgttgtgtccagtttggttttgtctttttttatttggcaagtggaggaggcttttatgtgacttttatgttgtggttggtgtcttaactctcctgggaaaaggaggctggcacacactgggatgccgcagcctggccggctgtggggtggtttgggaggatccatgtcggctctgcctgcagtgaccagtgctctgtggggcagaggagctgaccagggagggaggtacccatgagcagagggtagtgggagagtgtaaaggagggtttggtcctgtctgcttcctcaccttgagagtaaagtgctgccctctgcccccaacacacacacatatcaattcctggattccttagtcctgctggccttgggctggagcctaggaaagtggcccccaaatccttagtgagctaaagctgggtctgaaatttggtcagtggggaggggtagttttcttttcttttttctttttctttttttctttttttttttgagatggagtctcactcttgtcacctaggcaagagtgcaatggcacaatctcagctcactgcaacctccacctcctgggttcaagcgattctcctgcctcagcctcctgagtagctgggattacaggcacacaccaccacgcttggttaatttttgtatttttagtagagatgtttcaccatgttggccaggctagtcttgaattcctgacctcctgacctgcccacctcaacctcccaaagtgctgagattacaggcgtgagccaccacacccagctcagggaggcgtagttttctttaattttaaatttaaacccaagtttattggcagactcccttttgacctccctttgcctccccatctggtgctttcttgcatctacaccccagggccctgtggtggggctgcagggggaagctgtgcacctgagatgaggctggaacgggaattggcctctctgctcccttcttcagtaagcaaggagccccgcccctcaggcccagcctctggcaagaggtggtggaatccttgtgccgggtagtagaggaggataagggcaaaaccaggcccaggccagtgcctggcttggtctggatgggacactgtcagagtttggccacagcctgtcctttacttcatccacacctatgaagctattccctaaataaggcatttcccaagttagtcgctacctaatcagccttgagaagaatcctttcctcttctttgatagtgggtcgggggattcttcaggaatggtttggagctgggagtgggtagggggattttaaatgttccatatgggagccccaaaggaactggatgggctgcagtgaggtgggggcgggtgggcagggaatgggagaggggaagtcttggcagggaaatcccttttggccacacagtttacaaacccagtatcatgtctgtctgtgtgtctctcaaggtgagagtctgatttttataccaaagaggaaatgattttttttcatattttgtttgtctatattatataaatatatatatacagttatatatatatatattattttttggttctctctcgttttttagggagggaagaaagtaccaagttgcattgagctgtaattaaggaacattataatttatgacacatttctatacttgcaaaaattatatcattttatggatataagagaaaaatgcctttttataaaatttcaatttctgagaa

SEQ ID NO: 109676 - DNA, 5095 bp, Homo sapiens
  Payload ID: 1541
  Gene Symbol: ATP8B3
  Gene Name: ATPase, aminophospholipid transporter, class I, type 8B, member 3
  Uniprot ID: O60423
  ENST ID: ENST00000310127
  CDS Start-End: 240-4142
gtttcaggaccgttggcaccgggctaacggttccaccacgtccgccgccctggacgcccgcggcctgcccccccctgcctctcctgcgccgatacacttcgagtggattctggccatttgagcattctctccaactctccaatccccagtctgcccccacgggggtctcccccacctctcccccgtcccacagcctaaacccctcttcgccctgaacctcccttttcctcatgcggtgaatgggcactggccccgctcagactcccaggagcaccagagctggccctgagccaagccctgccccaccaggacctggggacacgggtgactcagacgtgactcaggaaggctcaggtcctgctggcatccgcggaggtgagacggtgatcagagctgggatgggagactccccaggcagaggggcacctgagaggaggcacaaggcccagcctggccgggctaggaagtatgaatggagaccagaaggccccaccagcatgggcagcctcggccagagagaagatctccaagatgaggacaggaactcagcattcacctggaaggtccaggccaacaaccgtgcctacaacgggcagttcaaggagaaggtgatcctgtgctggcaaaggaagaaatacaagaccaatgtcatccgcacggccaagtacaacttctactcgttcctgccgctgaacctgtacgagcagttccaccgcgtgtccaacctgttcttcctcatcatcatcatcctgcagagcattcccgacatctccacgctgccctggttctcgctcagtacccctatggtctgcctcctcttcatccgtgccacccgggacctggtggacgacatggggagacacaagagtgacagagccatcaacaacagaccctgccagattctgatggggaagagcttcaagcagaagaaatggcaggatctgtgcgtgggggatgtggtctgtctccgcaaggacaacatcgtcccagccgacatgctcttgctggccagcacggagcccagcagcctgtgctatgtggagacggtggacattgacggggagaccaacttgaagttcagacaggccctgatggtcacccacaaagaactggccactataaagaagatggcgtcctttcaaggcacagtgacgtgtgaggcgcctaacagtcggatgcaccacttcgtggggtgcctggaatggaatgacaagaaatactccctggacattggcaacctcctcctccgaggctgcaggattcgcaacacagacacctgctatggactggtcatttatgctggttttgacacaaaaattatgaagaactgtggcaagatccatttgaagagaaccaagctggacctcctgatgaacaagctggtggttgtgatcttcatctccgtggtgcttgtctgcctggtgttggccttcggcttcggtttctcagtcaaagaattcaaagaccaccactactacctctcgggggtgcatgggagcagcgtggccgcagagtccttcttcgtcttctggagcttcctcatcctgctcagcgtcaccatcccgatgtccatgttcatcctgtccgagttcatctacctggggaacagcgtcttcatcgactgggacgtgcagatgtactacaagccgcaggacgtgcctgccaaggcccgcagcaccagcctcaacgaccacctgggccaggtggaatacatcttctcggacaagacgggcacgctcacgcagaacatcttgaccttcaacaagtgctgcatcagcggccgcgtctatgggccggattcagaggccacgacccgacctaaggagaacccctacctctggaacaagttcgccgacgggaagctgctcttccacaatgcggccctgctgcacctcgtgcggaccaacggggacgaggccgtgcgggagttctggcgcctgctggccatctgccacacggtgatggtgcgggagagcccccgtgagcgcccagaccagctgttgtaccaggcggcctcccccgacgagggggcgctggtcaccgcagcccggaacttcggctacgtgttcctgtcccgcacccaggacaccgtcacgatcatggagctgggggaggaacgggtctaccaggtcctggccataatggacttcaacagcacgcgcaaacggatgtcggtgctggttcgaaagccagagggcgccatctgcctgtacaccaagggcgccgacacggtcatcttcgaacgcttgcacaggaggggggcaatggaatttgccacagaggaggccttggctgcctttgcccaggagaccctgcggacactgtgcctggcctacagggaggtggctgaggacatttacgaggactggcagcagcgccaccaggaggccagcctcctgctgcagaaccgggcacaggccctgcaacagctgctgggagccacagccatcgaggacagactccaggacggtgtccctgaaaccatcaaatgtctcaagaagagcaacatcaaaatatgggtgctcaccggggacaagcaggaaacggctgtgaacatcggcttcgcctgcgagctgctgtcagagaatatgctcattctggaggagaaggagattagccgcatcctggagacctactgggaaaacagtaacaaccttctaaccagggagtccctgtcgcaggtcaagctggccttggtcattaacggagacttcctggacaaactgctggtgtccctgcggaaggagccgcgcgccctggcgcagaacgtgaacatggacgaggcgtggcaggagctcggccagtccaggagggatttcctctacgccaggcgcctgtccctgctgtgccggaggttcgggctcccgctggctgcaccgccagcccaggactccagagcccgccgtagctccgaggtgctgcaggagcgcgccttcgtggacctggcgtccaagtgccaggcggtcatctgctgccgcgtgacgcccaagcagaaggccctgatcgtggccctggtcaagaagtaccaccaggtggtgaccctggccatcggggacggtgccaacgacatcaacatgatcaagaccgcggacgtgggcgtggggctggcgggccaggagggcatgcaggcagttcagaacagcgacttcgtgctcggccagttctgcttcctgcagcgcctcctgctggtgcacggccgctggtcctacgtgcggatctgcaagttcctgcgctacttcttctacaagagcatggccagcatgatggtgcaggtctggtttgcctgctacaacggcttcaccggccagcccctgtatgaaggatggttcctggctcttttcaacctcctgtacagcaccctgccagttctctacattgggctctttgagcaggacgtgagcgcagagcagagcctggagaagccggagctgtacgtggtggggcagaaggacgagctcttcaactactgggtcttcgtccaagccatcgcccatggtgtgaccacctctctggtcaacttcttcatgacactgtggatcagccgcgacacggcgggacccgccagcttcagcgaccaccagtcctttgcggtcgtggtggccctgtcttgcctgctgtccatcaccatggaggtcattcttatcatcaagtactggaccgccctgtgcgtggcgaccatcctcctcagccttggtttctacgccatcatgactaccaccacccagagcttctggctcttcagagtatcccccacgaccttcccgtttctgtatgccgacctcagcgtgatgtcctctccctccatcctgctggtggtcctgctgagtgtgtccataaacaccttccctgtcctggccctccgagtcatcttcccagccctcaaggagctacgtgccaaggaggagaaggtggaggagggccccagcgaggagattttcaccatggagcccttgcctcatgtacaccgggagtctcgtgcccgccgttccagctatgctttctcccaccgtgagggatatgcaaacctcatcactcagggcacaattctgcggaggggaccaggggtcagcagtgacatagcatctgaatccctagacccatctgatgaagaggcagcttcgagcccaaaagagtcacagtgacacctcaggaagatgtccttcctggggaagaagaagcaccagccacaggggcaggtgtcctcccaggaagtacagctcccccctacacctagctcatcattttctatggatagacaatccgctcttcatccagaaaaccaacctgccctccccaaatatgtgctcaccagcagcaacaggctatctgagtctttccaagagcaattgccaagggcacaggagaggtcattgtcacccaagcagaggccaccttctcctgagaagttgctgttgaccaaggagaggtcacattcttttcaggagaaatcactgttgcacagagaaagccagctgtcgtcatttgagagccagccacagcctctggggagccagtcatttctttcaggccagctgacgttggagagccagccagactcctcggaggagaagtcagcatttttgaagccctccacaccgttccggaagagctggcaaaaggagcctcacacccccaaggaggggacggtgccacttccagacaagacccacaaatctcaggtggagactctgccaccaagtctggaagaatcgtccacgtccacgagcgagcagcctatggaggtggagctgtggcccgcggagaagcagtcatcatcatccatggagtggctgctggtgcccggggaggagcagctatccttgcccccagaggagcagtcattgccctctgcggaggggaccagggttcagcagtgacgtagcatctgaatccctagacccatctgatgaagaggcatcttcgagcccaaaggagtcacgctggcatatcaggaagatgtccttcctgggaagaagaagctccagccagttctgctgcaagtcaaccagcatgcagggggccttcctctaaagacaaggactccacatgcttttctttttctaataaaccagggtccatctgaccccagcgctaa

SEQ ID NO: 109677 - DNA, 4014 bp, Homo sapiens
  Payload ID: 1541
  Gene Symbol: ATP8B3
  Gene Name: ATPase, aminophospholipid transporter, class I, type 8B, member 3
  Uniprot ID: O60423
  ENST ID: ENST00000525591
  CDS Start-End: 223-4014
gcctctcctgcgccggtgagcggcgggtgctcccactgctgtgcgtccccgggagcccgcgcaccctctctgggctccacccaggctgagagctggggtcgtggcggcgggggtggagagcgcgcccctagaggacctggggacacgggtgactcagacgtgactcaggaaggctcaggtcctgctggcatccgcggaggtgagacggtgatcagagctgggatgggagactccccaggcagaggggcacctgagaggaggcacaaggcccagcctggccgggctaggaagtatgaatggagaccagaaggccccaccagcatgggcagcctcggccagagagaagatctccaagatgaggacaggaactcagcattcacctggaaggtccaggccaacaaccgtgcctacaacgggcagttcaaggagaaggtgatcctgtgctggcaaaggaagaaatacaagaccaatgtcatccgcacggccaagtacaacttctactcgttcctgccgctgaacctgtacgagcagttccaccgcgtgtccaacctgttcttcctcatcatcatcatcctgcagagcattcccgacatctccacgctgccctggttctcgctcagtacccctatggtctgcctcctcttcatccgtgccacccgggacctggtggacgacatggggagacacaagagtgacagagccatcaacaacagaccctgccagattctgatggggaagagcttcaagcagaagaaatggcaggatctgtgcgtgggggatgtggtctgtctccgcaaggacaacatcgtcccagccgacatgctcttgctggccagcacggagcccagcagcctgtgctatgtggagacggtggacattgacggggagaccaacttgaagttcagacaggccctgatggtcacccacaaagaactggccactataaagaagatggcgtcctttcaaggcacagtgacgtgtgaggcgcctaacagtcggatgcaccacttcgtggggtgcctggaatggaatgacaagaaatactccctggacattggcaacctcctcctccgaggctgcaggattcgcaacacagacacctgctatggactggtcatttatgctgatggatacatgtttgtaggttttgacacaaaaattatgaagaactgtggcaagatccatttgaagagaaccaagctggacctcctgatgaacaagctggtggttgtgatcttcatctccgtggtgcttgtctgcctggtgttggccttcggcttcggtttctcagtcaaagaattcaaagaccaccactactacctctcgggggtgcatgggagcagcgtggccgcagagtccttcttcgtcttctggagcttcctcatcctgctcagcgtcaccatcccgatgtccatgttcatcctgtccgagttcatctacctggggaacagcgtcttcatcgactgggacgtgcagatgtactacaagccgcaggacgtgcctgccaaggcccgcagcaccagcctcaacgaccacctgggccaggtggaatacatcttctcggacaagacgggcacgctcacgcagaacatcttgaccttcaacaagtgctgcatcagcggccgcgtctatgggccggattcagaggccacgacccgacctaaggagaacccctacctctggaacaagttcgccgacgggaagctgctcttccacaatgcggccctgctgcacctcgtgcggaccaacggggacgaggccgtgcgggagttctggcgcctgctggccatctgccacacggtgatggtgcgggagagcccccgtgagcgcccagaccagctgttgtaccaggcggcctcccccgacgagggggcgctggtcaccgcagcccggaacttcggctacgtgttcctgtcccgcacccaggacaccgtcacgatcatggagctgggggaggaacgggtctaccaggtcctggccataatggacttcaacagcacgcgcaaacggatgtcggtgctggttcgaaagccagagggcgccatctgcctgtacaccaagggcgccgacacggtcatcttcgaacgcttgcacaggaggggggcaatggaatttgccacagaggaggccttggctgcctttgcccaggagaccctgcggacactgtgcctggcctacagggaggtggctgaggacatttacgaggactggcagcagcgccaccaggaggccagcctcctgctgcagaaccgggcacaggccctgcaacaggtgtacaacgagatggagcaggacctcaggctgctgggagccacagccatcgaggacagactccaggacggtgtccctgaaaccatcaaatgtctcaagaagagcaacatcaaaatatgggtgctcaccggggacaagcaggaaacggctgtgaacatcggcttcgcctgcgagctgctgtcagagaatatgctcattctggaggagaaggagattagccgcatcctggagacctactgggaaaacagtaacaaccttctaaccagggagtccctgtcgcaggtcaagctggccttggtcattaacggagacttcctggacaaactgctggtgtccctgcggaaggagccgcgcgccctggcgcagaacgtgaacatggacgaggcgtggcaggagctcggccagtccaggagggatttcctctacgccaggcgcctgtccctgctgtgccggaggttcgggctcccgctggctgcaccgccagcccaggactccagagcccgccgtagctccgaggtgctgcaggagcgcgccttcgtggacctggcgtccaagtgccaggcggtcatctgctgccgcgtgacgcccaagcagaaggccctgatcgtggccctggtcaagaagtaccaccaggtggtgaccctggccatcggggacggtgccaacgacatcaacatgatcaagaccgcggacgtgggcgtggggctggcgggccaggagggcatgcaggcagttcagaacagcgacttcgtgctcggccagttctgcttcctgcagcgcctcctgctggtgcacggccgctggtcctacgtgcggatctgcaagttcctgcgctacttcttctacaagagcatggccagcatgatggtgcaggtctggtttgcctgctacaacggcttcaccggccagcccctgtatgaaggatggttcctggctcttttcaacctcctgtacagcaccctgccagttctctacattgggctctttgagcaggacgtgagcgcagagcagagcctggagaagccggagctgtacgtggtggggcagaaggacgagctcttcaactactgggtcttcgtccaagccatcgcccatggtgtgaccacctctctggtcaacttcttcatgacactgtggatcagccgcgacacggcgggacccgccagcttcagcgaccaccagtcctttgcggtcgtggtggccctgtcttgcctgctgtccatcaccatggaggtcattcttatcatcaagtactggaccgccctgtgcgtggcgaccatcctcctcagccttggtttctacgccatcatgactaccaccacccagagcttctggctcttcagagtatcccccacgaccttcccgtttctgtatgccgacctcagcgtgatgtcctctccctccatcctgctggtggtcctgctgagtgtgtccataaacaccttccctgtcctggccctccgagtcatcttcccagccctcaaggagctacgtgccaaggaggagaaggtggaggagggccccagcgaggagattttcaccatggagcccttgcctcatgtacaccgggagtctcgtgcccgccgttccagctatgctttctcccaccgtgagggatatgcaaacctcatcactcagggcacaattctgcggaggggaccaggggtcagcagtgacatagcatctgaatccctagacccatctgatgaagaggcagcttcgagcccaaaagagtcacagtga

SEQ ID NO: 109678 - DNA, 887 bp, Homo sapiens
  Payload ID: 1541
  Gene Symbol: ATP8B3
  Gene Name: ATPase, aminophospholipid transporter, class I, type 8B, member 3
  ENST ID: ENST00000526847
  CDS Start-End: 1-116
tcggcttcgcctgcgagctgctgtcagagaatatgctcattctggaggagaaggagattaggacaaactgctggtgtccctgcggaaggagccgcgcgccctggcgcagaacgtgaacatggacgaggcgtggcaggagctcggccagtccaggagggatttcctctacgccaggcgcctgtccctgctgtgccggaggttcgggctcccgctggctgcaccgccagcccaggactccagagcccgccgtagctccgaggtgctgcaggagcgcgccttcgtggacctggcgtccaagtgccaggcggtcatctgctgccgcgtgacgcccaagcagaaggccctgatcgtggccctggtcaagaagtaccaccaggtggtgaccctggccatcggggacggtgccaacgacatcaacatgatcaagaccgcggacgtgggcgtggggctggcgggccaggagggcatgcaggcagttcagaacagcgacttcgtgctcggccagttctgcttcctgcagcgcctcctgctggtgcacggccgctggtcctacgtgcggatctgcaagttcctgcgctacttcttctacaagagcatggccagcatgatggtgcaggtctggtttgcctgctacaacggcttcaccggccagcccctgtatgaaggatggttcctggctcttttcaacctcctgtacagcaccctgccagttctctacattgggctctttgagcaggacgtgagcgcagagcagagcctggagaagccggagctgtacgtggtggggcagaaggacgagctcttcaactactgggtcttcgtccaagccatcgcccatggtgtgaccacctctctggtcaacttcttcatgacactgtggatcagcc

SEQ ID NO: 109679 - DNA, 5237 bp, Homo sapiens
  Payload ID: 1541
  Gene Symbol: ATP8B3
  Gene Name: ATPase, aminophospholipid transporter, class I, type 8B, member 3
  ENST ID: ENST00000531925
  CDS Start-End: 240-500
gtttcaggaccgttggcaccgggctaacggttccaccacgtccgccgccctggacgcccgcggcctgcccccccctgcctctcctgcgccgatacacttcgagtggattctggccatttgagcattctctccaactctccaatccccagtctgcccccacgggggtctcccccacctctcccccgtcccacagcctaaacccctcttcgccctgaacctcccttttcctcatgcggtgaatgggcactggccccgctcagactcccaggagcaccagagctggccctgagccaagccctgccccaccaggacctggggacacgggtgactcagacgtgactcaggaaggctcaggtcctgctggcatccgcggagccccaccagcatgggcagcctcggccagagagaagatctccaagatgaggacaggaactcagcattcacctggaaggtccaggccaacaaccgtgcctacaacgggcagttcaaggagaaggtgatcctgtgctggcaaaggaagaaatacaagaccaatgtcatccgcacggccaagtacaacttctactcgttcctgccgctgaacctgtacgagcagttccaccgcgtgtccaacctgttcttcctcatcatcatcatcctgcagagcattcccgacatctccacgctgccctggttctcgctcagtacccctatggtctgcctcctcttcatccgtgccacccgggacctggtggacgacatggggagacacaagagtgacagagccatcaacaacagaccctgccagattctgatggggaagagtccgacaggaaccgggcctgcattcattaggcgtttggccgggacgaggacagaggccgaggccctgatggcgaacccttgcagagcttagggctcgggcgatggggaggacaaggaaagtctgaagaggacgtgggtgcaggaccctggaggtcactgggtgggagcgtggacccgcggggagtggggtgggagcccggggaaggcttcctgagggggcaaaggcccggaggtggggactgcagctgcgggccccccgtcatcccgtgcctctggtctcccggtgtggggagggttggcagagggaggggcctccttcacaaccccctctccccgcagcttcaagcagaagaaatggcaggatctgtgcgtgggggatgtggtctgtctccgcaaggacaacatcgtcccagccgacatgctcttgctggccagcacggagcccagcagcctgtgctatgtggagacggtggacattgacggggagaccaacttgaagttcagacaggccctgatggtcacccacaaagaactggccactataaagaagatggcgtcctttcaaggcacagtgacgtgtgaggcgcctaacagtcggatgcaccacttcgtggggtgcctggaatggaatgacaagaaatactccctggacattggcaacctcctcctccgaggctgcaggattcgcaacacagacacctgctatggactggtcatttatgctggttttgacacaaaaattatgaagaactgtggcaagatccatttgaagagaaccaagctggacctcctgatgaacaagctggtggttgtgatcttcatctccgtggtgcttgtctgcctggtgttggccttcggcttcggtttctcagtcaaagaattcaaagaccaccactactacctctcgggggtgcatgggagcagcgtggccgcagagtccttcttcgtcttctggagcttcctcatcctgctcagcgtcaccatcccgatgtccatgttcatcctgtccgagttcatctacctggggaacagcgtcttcatcgactgggacgtgcagatgtactacaagccgcaggacgtgcctgccaaggcccgcagcaccagcctcaacgaccacctgggccaggtggaatacatcttctcggacaagacgggcacgctcacgcagaacatcttgaccttcaacaagtgctgcatcagcggccgcgtctatgggccggattcagaggccacgacccgacctaaggagaacccctacctctggaacaagttcgccgacgggaagctgctcttccacaatgcggccctgctgcacctcgtgcggaccaacggggacgaggccgtgcgggagttctggcgcctgctggccatctgccacacggtgatggtgcgggagagcccccgtgagcgcccagaccagctgttgtaccaggcggcctcccccgacgagggggcgctggtcaccgcagcccggaacttcggctacgtgttcctgtcccgcacccaggacaccgtcacgatcatggagctgggggaggaacgggtctaccaggtcctggccataatggacttcaacagcacgcgcaaacggatgtcggtgctggttcgaaagccagagggcgccatctgcctgtacaccaagggcgccgacacggtcatcttcgaacgcttgcacaggaggggggcaatggaatttgccacagaggaggccttggctgcctttgcccaggagaccctgcggacactgtgcctggcctacagggaggtggctgaggacatttacgaggactggcagcagcgccaccaggaggccagcctcctgctgcagaaccgggcacaggccctgcaacaggtgtacaacgagatggagcaggacctcaggctgctgggagccacagccatcgaggacagactccaggacggtgtccctgaaaccatcaaatgtctcaagaagagcaacatcaaaatatgggtgctcaccggggacaagcaggaaacggctgtgaacatcggcttcgcctgcgagctgctgtcagagaatatgctcattctggaggagaaggagattagccgcatcctggagacctactgggaaaacagtaacaaccttctaaccagggagtccctgtcgcaggtcaagctggccttggtcattaacggagacttcctggcgcctgtccctgctgtgccggaggttcgggctcccgctggctgcaccgccagcccaggactccagagcccgccgtagctccgaggtgctgcaggagcgcgccttcgtggacctggcgtccaagtgccaggcggtcatctgctgccgcgtgacgcccaagcagaaggccctgatcgtggccctggtcaagaagtaccaccaggtggtgaccctggccatcggggacggtgccaacgacatcaacatgatcaagaccgcggacgtgggcgtggggctggcgggccaggagggcatgcaggcagttcagaacagcgacttcgtgctcggccagttctgcttcctgcagcgcctcctgctggtgcacggccgctggtcctacgtgcggatctgcaagttcctgcgctacttcttctacaagagcatggccagcatgatggtgcaggtctggtttgcctgctacaacggcttcaccggccagcccctgtatgaaggatggttcctggctcttttcaacctcctgtacagcaccctgccagttctctacattgggctctttgagcaggacgtgagcgcagagcagagcctggagaagccggagctgtacgtggtggggcagaaggacgagctcttcaactactgggtcttcgtccaagccatcgcccatggtgtgaccacctctctggtcaacttcttcatgacactgtggatcagccgcgacacggcgggacccgccagcttcagcgaccaccagtcctttgcggtcgtggtggccctgtcttgcctgctgtccatcaccatggaggtcattcttatcatcaagtactggaccgccctgtgcgtggcgaccatcctcctcagccttggtttctacgccatcatgactaccaccacccagagcttctggctcttcagagtatcccccacgaccttcccgtttctgtatgccgacctcagcgtgatgtcctctccctccatcctgctggtggtcctgctgagtgtgtccataaacaccttccctgtcctggccctccgagtcatcttcccagccctcaaggagctacgtgccaaggaggagaaggtggaggagggccccagcgaggagattttcaccatggagcccttgcctcatgtacaccgggagtctcgtgcccgccgttccagctatgctttctcccaccgtgagggatatgcaaacctcatcactcagggcacaattctgcggaggggaccaggggtcagcagtgacatagcatctgaatccctagacccatctgatgaagaggcagcttcgagcccaaaagagtcacagtgacacctcaggaagatgtccttcctggggaagaagaagcaccagccacaggggcaggtgtcctcccaggaagtacagctcccccctacacctagctcatcattttctatggatagacaatccgctcttcatccagaaaaccaacctgccctccccaaatatgtgctcaccagcagcaacaggctatctgagtctttccaagagcaattgccaagggcacaggagaggtcattgtcacccaagcagaggccaccttctcctgagaagttgctgttgaccaaggagaggtcacattcttttcaggagaaatcactgttgcacagagaaagccagctgtcgtcatttgagagccagccacagcctctggggagccagtcatttctttcaggccagctgacgttggagagccagccagactcctcggaggagaagtcagcatttttgaagccctccacaccgttccggaagagctggcaaaaggagcctcacacccccaaggaggggacggtgccacttccagacaagacccacaaatctcaggtggagactctgccaccaagtctggaagaatcgtccacgtccacgagcgagcagcctatggaggtggagctgtggcccgcggagaagcagtcatcatcatccatggagtggctgctggtgcccggggaggagcagctatccttgcccccagaggagcagtcattgccctctgcggaggggaccagggttcagcagtgacgtagcatctgaatccctagacccatctgatgaagaggcatcttcgagcccaaaggagtcacgctggcatatcaggaagatgtccttcctgggaagaagaagctccagccagttctgctgcaagtcaaccagcatgcagggggccttcctctaaagacaaggactccacatgcttttctttttctaataaaccagggtccatctgaccccagcgct

SEQ ID NO: 109680 - DNA, 2759 bp, Homo sapiens
  Payload ID: 1541
  Gene Symbol: ATP8B3
  Gene Name: ATPase, aminophospholipid transporter, class I, type 8B, member 3
  ENST ID: ENST00000526092
  CDS Start-End: 181-1869
gtttcaggaccgttggcaccgggctaacggttccaccacgtccgccgccctggacgcccgcggcctgcccccccctgcctctcctgcgccggacctggggacacgggtgactcagacgtgactcaggaaggctcaggtcctgctggcatccgcggaggtgagacggtgatcagagctgggatgggagactccccaggcagaggggcacctgagaggaggcacaaggcccagcctggccgggctaggaagtatgaatggagaccagaaggccccaccagcatgggcagcctcggccagagagaagatctccaagatgaggacaggaactcagcattcacctggaaggtccaggccaacaaccgtgcctacaacgggcagttcaaggagaaggtgatcctgtgctggcaaaggaagaaatacaagaccaatgtcatccgcacggccaagtacaacttctactcgttcctgccgctgaacctgtacgagcagttccaccgcgtgtccaacctgttcttcctcatcatcatcatcctgcagagcattcccgacatctccacgctgccctggttctcgctcagtacccctatggtctgcctcctcttcatccgtgccacccgggacctggtggacgacatggggagacacaagagtgacagagccatcaacaacagaccctgccagattctgatggggaagagcttcaagcagaagaaatggcaggatctgtgcgtgggggatgtggtctgtctccgcaaggacaacatcgtcccagccgacatgctcttgctggccagcacggagcccagcagcctgtgctatgtggagacggtggacattgacggggagaccaacttgaagttcagacaggccctgatggtcacccacaaagaactggccactataaagaagatggcgtcctttcaaggcacagtgacgtgtgaggcgcctaacagtcggatgcaccacttcgtggggtgcctggaatggaatgacaagaaatactccctggacattggcaacctcctcctccgaggctgcaggattcgcaacacagacacctgctatggactggtcatttatgctggttttgacacaaaaattatgaagaactgtggcaagatccatttgaagagaaccaagctggacctcctgatgaacaagctggtggttgtgatcttcatctccgtggtgcttgtctgcctggtgttggccttcggcttcggtttctcagtcaaagaattcaaagaccaccactactacctctcgggggtgcatgggagcagcgtggccgcagagtccttcttcgtcttctggagcttcctcatcctgctcagcgtcaccatcccgatgtccatgttcatcctgtccgagttcatctacctggggaacagcgtcttcatcgactgggacgtgcagatgtactacaagccgcaggacgtgcctgccaaggcccgcagcaccagcctcaacgaccacctgggccaggtggaatacatcttctcggacaagacgggcacgctcacgcagaacatcttgaccttcaacaagtgctgcatcagcggccgcgtctatggtgcggccccgacacctgagctcccagctgggtcctcgatcttcaaggggctcagggtgcctgagaaccagagccacgtctggccccatgcccagcacctccgcccgaatctgaaccagggaaccgtagccagatggcctggtttcctttggagggggccaggaaaatttttttttttttttgaggcagagtctcactctgtctacccaggcaggaatgcagtggtgcaatcttggctcactgcaatctccacctcccaggttcaagcgattctcctggctcagcctcccgagtagctgggattacaggcacctgccaccacacctaatttttttgtatttttagcagagatggggtttcaccatgttggccatgctggtctcgaactcctggcctccggcgatccacctgcctcggcctcccaaagtgctgggattacaggcgtgagccaccacgcccggccgactttttttttttttttctctctgagacggagttttgctctcgttgcccaggctggagtgcagtggtgcgatctctgctcactgaaacctccgcctcctgggttgattctcccgcctcagcctcccaagtagctgggattacagttgcgtgccaccccgcctggctaatttttgtattttttttttcagtagagatggggtttcaccctgtttcccaggctggtctcgaactcctgacttcaggtgatctgcctgcctcagcctccaaaatattggcattgcaggcatgagccaccacacctagccaaacttttaaacagtgtgtatttatttattttttgagatggggtcttgctctgccgcccaggctggaatgcagtggtgcaatcatagcttattgcagcctcgaattcctgggctcaagcaatcctcccacttcagcttcccaagtagccgggactacaggagagtgccaccttacccagcttatttttgtattttttgtcaagacagggaatccctatgttgcccaggctggtcttgaactcctgggcttaagcgatccgcctgcctccgcttttcaaagcactggaattacagatgtgagccaccacacccggccactgctcttcttttgactttcacaagcctttatttgtggatgctgaaattcgaattgctgagtatttctcagatcacaaaataaaatagttttgtttgtt

SEQ ID NO: 109681 - DNA, 933 bp, Homo sapiens
  Payload ID: 1541
  Gene Symbol: ATP8B3
  Gene Name: ATPase, aminophospholipid transporter, class I, type 8B, member 3
  ENST ID: ENST00000587160
  CDS Start-End: 319-933
gtccgccgccctggacgcccgcggcctgcccccccctgcctctcctgcgccggtgagcggcgggtgctcccactgctgtgcgtccccgggagcccgcgcaccctctctgggctccacccaggctgagagctggggtcgtggcggcgggggtggagagcgcgcccctagagatacacttcgagtggattctggccatttgagcattctctccaactctccaatccccagtctgcccccacgggggtctcccccacctctcccccgtcccacagcctaaacccctcttcgccctgaacctcccttttcctcatgcggtgaatgggcactggccccgctcagactcccaggagcaccagagctggccctgagccaagccctgccccaccaggacctggggacacgggtgactcagacgtgactcaggaaggctcaggtcctgctggcatccgcggaggtgagacggtgatcagagctgggatgggagactccccaggcagaggggcacctgagaggaggcacaaggcccagcctggccgggctaggaagtatgaatggagaccagaaggccccaccagcatgggcagcctcggccagagagaagatctccaagatgaggacaggaactcagcattcacctggaaggtccaggccaacaaccgtgcctacaacgggcagttcaaggagaaggtgatcctgtgctggcaaaggaagaaatacaagaccaatgtcatccgcacggccaagtacaacttctactcgttcctgccgctgaacctgtacgagcagttccaccgcgtgtccaacctgttcttcctcatcatcatcatcctgcagagcattcccgacatctccacgctgccctggttctcgctcagtacccctatggtctgcctcctcttcatccgtgccacccgggacctggtggacgacatg

SEQ ID NO: 109682 - DNA, 3532 bp, Homo sapiens
  Payload ID: 1542
  Gene Symbol: ATP2A1
  Gene Name: ATPase, Ca++ transporting, cardiac muscle, fast twitch 1
  Uniprot ID: O14983
  ENST ID: ENST00000357084
  CDS Start-End: 268-3273
agccagccaatccctgatctggtggaggggggagcccggcctccccctgctccctcataaggaccagctgggggccggggggtggccggctgctcaagtgggacgggggtcagagctttgtggagggaagaaaaacctggagggggcaggagagtaaaaagaagaaacccaggcagacaggcagttggacacactgaggaagaccccccacgagtgggaaccccctggaaggaacacaccggccccggcccccaggaagggagcacaatggaggccgctcatgctaaaaccacggaggaatgtttggcctattttggggtgagtgagaccacgggcctcaccccggaccaagttaagcggaatctggagaaatacggcctcaatgagctccctgctgaggaagggaagaccctgtgggagctggtgatagagcagtttgaagacctcctggtgcggattctcctcctggccgcatgcatttccttcgtgctggcctggtttgaggaaggtgaagagaccatcactgcctttgttgaaccctttgtcatcctcttgatcctcattgccaatgccatcgtgggggtttggcaggagcggaacgcagagaacgccatcgaggccctgaaggagtatgagccagagatggggaaggtctaccgggctgaccgcaagtcagtgcaaaggatcaaggctcgggacatcgtccctggggacatcgtggaggtggctgtgggggacaaagtccctgcagacatccgaatcctcgccatcaaatccaccacgctgcgggttgaccagtccatcctgacaggcgagtctgtatctgtcatcaaacacacggagcccgttcctgacccccgagctgtcaaccaggacaagaagaacatgcttttctcgggcaccaacattgcagccggcaaggccttgggcatcgtggccaccactggtgtgggcaccgagattgggaagatccgagaccaaatggctgccacagaacaggacaagacccccttgcagcagaagctggatgagtttggggagcagctctccaaggtcatctccctcatctgtgtggctgtctggcttatcaacattggccacttcaacgaccccgtccatgggggctcctggttccgcggggccatctactactttaagattgccgtggccttggctgtggctgccatccccgaaggtcttcctgcagtcatcaccacctgcctggccctgggtacccgtcggatggcaaagaagaatgccattgtaagaagcttgccctccgtagagaccctgggctgcacctctgtcatctgttccgacaagacaggcaccctcaccaccaaccagatgtctgtctgcaagatgtttatcattgacaaggtggatggggacatctgcctcctgaatgagttctccatcaccggctccacttacgctccagagggagaggtcttgaagaatgataagccagtccggccagggcagtatgacgggctggtggagctggccaccatctgtgccctctgcaatgactcctccttggacttcaacgaggccaaaggtgtctatgagaaggtcggcgaggccaccgagacagcactcaccaccctggtggagaagatgaatgtgttcaacacggatgtgagaagcctctcgaaggtggagagagccaacgcctgcaactcggtgatccgccagctaatgaagaaggaattcaccctggagttctcccgagacagaaagtccatgtctgtctattgctccccagccaaatcttcccgggctgctgtgggcaacaagatgtttgtcaagggtgcccctgagggcgtcatcgaccgctgtaactatgtgcgagttggcaccacccgggtgccactgacggggccggtgaaggaaaagatcatggcggtgatcaaggagtggggcactggccgggacaccctgcgctgcttggccctggccacccgggacacccccccgaagcgagaggaaatggtcctggatgactctgccaggttcctggagtatgagacggacctgacattcgtgggtgtagtgggcatgctggaccctccgcgcaaggaggtcacgggctccatccagctgtgccgtgacgccgggatccgggtgatcatgatcactggggacaacaagggcacagccattgccatctgccggcgaattggcatctttggggagaacgaggaggtggccgatcgcgcctacacgggccgagagttcgacgacctgcccctggctgaacagcgggaagcctgccgacgtgcctgctgcttcgcccgtgtggagccctcgcacaagtccaagattgtggagtacctgcagtcctacgatgagatcacagccatgacaggtgatggcgtcaatgacgcccctgccctgaagaaggctgagattggcattgccatgggatctggcactgccgtggccaagactgcctctgagatggtgctggctgacgacaacttctccaccatcgtagctgctgtggaggagggccgcgccatctacaacaacatgaagcagttcatccgctacctcatttcctccaacgtgggcgaggtggtctgtatcttcctgaccgctgccctggggctgcctgaggccctgatcccggtgcagctgctatgggtgaacttggtgaccgacgggctcccagccacagccctgggcttcaacccaccagacctggacatcatggaccgccccccccggagccccaaggagcccctcatcagtggctggctcttcttccgctacatggcaatcgggggctatgtgggtgcagccaccgtgggagcagctgcctggtggttcctgtacgctgaggatgggcctcatgtcaactacagccagctgactcacttcatgcagtgcaccgaggacaacacccactttgagggcatagactgtgaggtcttcgaggcccccgagcccatgaccatggccctgtccgtgctggtgaccatcgagatgtgcaatgcactgaacagcctgtccgagaaccagtccctgctgcggatgccaccctgggtgaacatctggctgctgggctccatctgcctctccatgtccctgcacttcctcatcctctatgttgaccccctgccgatgatcttcaagctccgggccctggacctcacccagtggctcatggtcctcaagatctcactgccagtcattgggctcgacgaaatcctcaagttcgttgctcggaactacctagaggatccagaagatgaaagaaggaagtgagcatccttttgctctgtcctccccaccccgatagtgacacatcttcaggcagagctgtggcacagacccccgtcctgtcccccacacccgtgtcatgtgtctgtttataaacatgtccccttccctttccttccccctcggccacccgcctccctctcaaccttgtaaattccccttcccaaccccgaggggcttgcagggacaaggcgaccgactgcgctgagctgcttatttattgaaaataaacgacggaaaagtc

SEQ ID NO: 109683 - DNA, 3536 bp, Homo sapiens
  Payload ID: 1542
  Gene Symbol: ATP2A1
  Gene Name: ATPase, Ca++ transporting, cardiac muscle, fast twitch 1
  Uniprot ID: O14983
  ENST ID: ENST00000395503
  CDS Start-End: 185-3169
ggccggctgctcaagtgggacgggggtcagagctttgtggagggaagaaaaacctggagggggcaggagagtaaaaagaagaaacccaggcagacaggcagttggacacactgaggaagaccccccacgagtgggaaccccctggaaggaacacaccggccccggcccccaggaagggagcacaatggaggccgctcatgctaaaaccacggaggaatgtttggcctattttggggtgagtgagaccacgggcctcaccccggaccaagttaagcggaatctggagaaatacggcctcaatgagctccctgctgaggaagggaagaccctgtgggagctggtgatagagcagtttgaagacctcctggtgcggattctcctcctggccgcatgcatttccttcgtgctggcctggtttgaggaaggtgaagagaccatcactgcctttgttgaaccctttgtcatcctcttgatcctcattgccaatgccatcgtgggggtttggcaggagcggaacgcagagaacgccatcgaggccctgaaggagtatgagccagagatggggaaggtctaccgggctgaccgcaagtcagtgcaaaggatcaaggctcgggacatcgtccctggggacatcgtggaggtggctgtgggggacaaagtccctgcagacatccgaatcctcgccatcaaatccaccacgctgcgggttgaccagtccatcctgacaggcgagtctgtatctgtcatcaaacacacggagcccgttcctgacccccgagctgtcaaccaggacaagaagaacatgcttttctcgggcaccaacattgcagccggcaaggccttgggcatcgtggccaccactggtgtgggcaccgagattgggaagatccgagaccaaatggctgccacagaacaggacaagacccccttgcagcagaagctggatgagtttggggagcagctctccaaggtcatctccctcatctgtgtggctgtctggcttatcaacattggccacttcaacgaccccgtccatgggggctcctggttccgcggggccatctactactttaagattgccgtggccttggctgtggctgccatccccgaaggtcttcctgcagtcatcaccacctgcctggccctgggtacccgtcggatggcaaagaagaatgccattgtaagaagcttgccctccgtagagaccctgggctgcacctctgtcatctgttccgacaagacaggcaccctcaccaccaaccagatgtctgtctgcaagatgtttatcattgacaaggtggatggggacatctgcctcctgaatgagttctccatcaccggctccacttacgctccagagggagaggtcttgaagaatgataagccagtccggccagggcagtatgacgggctggtggagctggccaccatctgtgccctctgcaatgactcctccttggacttcaacgaggccaaaggtgtctatgagaaggtcggcgaggccaccgagacagcactcaccaccctggtggagaagatgaatgtgttcaacacggatgtgagaagcctctcgaaggtggagagagccaacgcctgcaactcggtgatccgccagctaatgaagaaggaattcaccctggagttctcccgagacagaaagtccatgtctgtctattgctccccagccaaatcttcccgggctgctgtgggcaacaagatgtttgtcaagggtgcccctgagggcgtcatcgaccgctgtaactatgtgcgagttggcaccacccgggtgccactgacggggccggtgaaggaaaagatcatggcggtgatcaaggagtggggcactggccgggacaccctgcgctgcttggccctggccacccgggacacccccccgaagcgagaggaaatggtcctggatgactctgccaggttcctggagtatgagacggacctgacattcgtgggtgtagtgggcatgctggaccctccgcgcaaggaggtcacgggctccatccagctgtgccgtgacgccgggatccgggtgatcatgatcactggggacaacaagggcacagccattgccatctgccggcgaattggcatctttggggagaacgaggaggtggccgatcgcgcctacacgggccgagagttcgacgacctgcccctggctgaacagcgggaagcctgccgacgtgcctgctgcttcgcccgtgtggagccctcgcacaagtccaagattgtggagtacctgcagtcctacgatgagatcacagccatgacaggtgatggcgtcaatgacgcccctgccctgaagaaggctgagattggcattgccatgggatctggcactgccgtggccaagactgcctctgagatggtgctggctgacgacaacttctccaccatcgtagctgctgtggaggagggccgcgccatctacaacaacatgaagcagttcatccgctacctcatttcctccaacgtgggcgaggtggtctgtatcttcctgaccgctgccctggggctgcctgaggccctgatcccggtgcagctgctatgggtgaacttggtgaccgacgggctcccagccacagccctgggcttcaacccaccagacctggacatcatggaccgccccccccggagccccaaggagcccctcatcagtggctggctcttcttccgctacatggcaatcgggggctatgtgggtgcagccaccgtgggagcagctgcctggtggttcctgtacgctgaggatgggcctcatgtcaactacagccagctgactcacttcatgcagtgcaccgaggacaacacccactttgagggcatagactgtgaggtcttcgaggcccccgagcccatgaccatggccctgtccgtgctggtgaccatcgagatgtgcaatgcactgaacagcctgtccgagaaccagtccctgctgcggatgccaccctgggtgaacatctggctgctgggctccatctgcctctccatgtccctgcacttcctcatcctctatgttgaccccctgccgatgatcttcaagctccgggccctggacctcacccagtggctcatggtcctcaagatctcactgccagtcattgggctcgacgaaatcctcaagttcgttgctcggaactacctagagggataactgttccccctcctccatctctgagcccgtgtcacagatccagaagatgaaagaaggaagtgagcatccttttgctctgtcctccccaccccgatagtgacacatcttcaggcagagctgtggcacagacccccgtcctgtcccccacacccgtgtcatgtgtctgtttataaacatgtccccttccctttccttccccctcggccacccgcctccctctcaaccttgtaaattccccttcccaaccccgaggggcttgcagggacaaggcgaccgactgcgctgagctgcttatttattgaaaataaacgacggaaaagtctggccttgcctctgtgcaagcttggaggcctgggtcgccgctgtg

SEQ ID NO: 109684 - DNA, 3130 bp, Homo sapiens
  Payload ID: 1542
  Gene Symbol: ATP2A1
  Gene Name: ATPase, Ca++ transporting, cardiac muscle, fast twitch 1
  Uniprot ID: O14983
  ENST ID: ENST00000536376
  CDS Start-End: 199-2808
agcgcggcggtgtgatgatgactccaaggagcccggcgcccggtgctggcctggtttgaggaaggtgaagagaccatcactgcctttgttgaaccctttgtcatcctcttgatcctcattgccaatgccatcgtgggggtttggcaggagcggaacgcagagaacgccatcgaggccctgaaggagtatgagccagagatggggaaggtctaccgggctgaccgcaagtcagtgcaaaggatcaaggctcgggacatcgtccctggggacatcgtggaggtggctgtgggggacaaagtccctgcagacatccgaatcctcgccatcaaatccaccacgctgcgggttgaccagtccatcctgacaggcgagtctgtatctgtcatcaaacacacggagcccgttcctgacccccgagctgtcaaccaggacaagaagaacatgcttttctcgggcaccaacattgcagccggcaaggccttgggcatcgtggccaccactggtgtgggcaccgagattgggaagatccgagaccaaatggctgccacagaacaggacaagacccccttgcagcagaagctggatgagtttggggagcagctctccaaggtcatctccctcatctgtgtggctgtctggcttatcaacattggccacttcaacgaccccgtccatgggggctcctggttccgcggggccatctactactttaagattgccgtggccttggctgtggctgccatccccgaaggtcttcctgcagtcatcaccacctgcctggccctgggtacccgtcggatggcaaagaagaatgccattgtaagaagcttgccctccgtagagaccctgggctgcacctctgtcatctgttccgacaagacaggcaccctcaccaccaaccagatgtctgtctgcaagatgtttatcattgacaaggtggatggggacatctgcctcctgaatgagttctccatcaccggctccacttacgctccagagggagaggtcttgaagaatgataagccagtccggccagggcagtatgacgggctggtggagctggccaccatctgtgccctctgcaatgactcctccttggacttcaacgaggccaaaggtgtctatgagaaggtcggcgaggccaccgagacagcactcaccaccctggtggagaagatgaatgtgttcaacacggatgtgagaagcctctcgaaggtggagagagccaacgcctgcaactcggtgatccgccagctaatgaagaaggaattcaccctggagttctcccgagacagaaagtccatgtctgtctattgctccccagccaaatcttcccgggctgctgtgggcaacaagatgtttgtcaagggtgcccctgagggcgtcatcgaccgctgtaactatgtgcgagttggcaccacccgggtgccactgacggggccggtgaaggaaaagatcatggcggtgatcaaggagtggggcactggccgggacaccctgcgctgcttggccctggccacccgggacacccccccgaagcgagaggaaatggtcctggatgactctgccaggttcctggagtatgagacggacctgacattcgtgggtgtagtgggcatgctggaccctccgcgcaaggaggtcacgggctccatccagctgtgccgtgacgccgggatccgggtgatcatgatcactggggacaacaagggcacagccattgccatctgccggcgaattggcatctttggggagaacgaggaggtggccgatcgcgcctacacgggccgagagttcgacgacctgcccctggctgaacagcgggaagcctgccgacgtgcctgctgcttcgcccgtgtggagccctcgcacaagtccaagattgtggagtacctgcagtcctacgatgagatcacagccatgacaggtgatggcgtcaatgacgcccctgccctgaagaaggctgagattggcattgccatgggatctggcactgccgtggccaagactgcctctgagatggtgctggctgacgacaacttctccaccatcgtagctgctgtggaggagggccgcgccatctacaacaacatgaagcagttcatccgctacctcatttcctccaacgtgggcgaggtggtctgtatcttcctgaccgctgccctggggctgcctgaggccctgatcccggtgcagctgctatgggtgaacttggtgaccgacgggctcccagccacagccctgggcttcaacccaccagacctggacatcatggaccgccccccccggagccccaaggagcccctcatcagtggctggctcttcttccgctacatggcaatcgggggctatgtgggtgcagccaccgtgggagcagctgcctggtggttcctgtacgctgaggatgggcctcatgtcaactacagccagctgactcacttcatgcagtgcaccgaggacaacacccactttgagggcatagactgtgaggtcttcgaggcccccgagcccatgaccatggccctgtccgtgctggtgaccatcgagatgtgcaatgcactgaacagcctgtccgagaaccagtccctgctgcggatgccaccctgggtgaacatctggctgctgggctccatctgcctctccatgtccctgcacttcctcatcctctatgttgaccccctgccgatgatcttcaagctccgggccctggacctcacccagtggctcatggtcctcaagatctcactgccagtcattgggctcgacgaaatcctcaagttcgttgctcggaactacctagagggataactgttccccctcctccatctctgagcccgtgtcacagatccagaagatgaaagaaggaagtgagcatccttttgctctgtcctccccaccccgatagtgacacatcttcaggcagagctgtggcacagacccccgtcctgtcccccacacccgtgtcatgtgtctgtttataaacatgtccccttccctttccttccccctcggccacccgcctccctctcaaccttgtaaattccccttcccaaccccgaggggcttgcagggacaaggcgaccgactgcgctgagctgcttatttattgaaaataaacgacggaaaagtc

SEQ ID NO: 109685 - DNA, 467 bp, Homo sapiens
  Payload ID: 1542
  Gene Symbol: ATP2A1
  Gene Name: ATPase, Ca++ transporting, cardiac muscle, fast twitch 1
  ENST ID: ENST00000564470
  CDS Start-End: 1-126
gtcatctgttccgacaagacaggcaccctcaccaccaaccagatgtctgtctgcaagggtcttccactgacctcaggccaagaacccctgcccttcacagagttttgtggaagactacacccatgaactagaaattgctgttctgagaagcaagggctgtgtggtcagatcagggtgagaaaggctgtaaccttggctcctgggcgagacccacaacatctgctgctatttgaaagccttagaggaggctgactgtgtaaagaagacggattctgctttgccccagaggttcccaagttttttttctgaccacagaacttttttgtcttggaacccatcttaaccatctctcttctcgggaatgaaaagcccagtctctgttgcgtttgcccaggattcaggatgtttatcattgacaaggtggatggggacatctgcctcctgaatgagttctccatcaccggctc

SEQ ID NO: 109686 - DNA, 831 bp, Homo sapiens
  Payload ID: 1542
  Gene Symbol: ATP2A1
  Gene Name: ATPase, Ca++ transporting, cardiac muscle, fast twitch 1
  ENST ID: ENST00000564732
  CDS Start-End: 1-386
gcggggccatctactactttaagattgccgtggccttggctgtggctgccatccccgaaggtcttcctgcagtcatcaccacctgcctggccctgggtacccgtcggatggcaaagaagaatgccattgtaagaagcttgccctccgtagagaccctgggctgcacctctgtcatctgttccgacaagacaggcaccctcaccaccaaccagatgtctgtctgcaagatgtttatcattgacaaggtggatggggacatctgcctcctgaatgagttctccatcaccggctccacttacgctccagagggagaggtgccaaaggtgtctatgagaaggtcggcgaggccaccgagacagcactcaccaccctggtggagaagatgaatgtgttcaacacggatgtgagaagcctctcgaaggtggagagagccaacgcctgcaactcggtgatccgccagctaatgaagaaggaattcaccctggagttctcccgagacagaaagtccatgtctgtctattgctccccagccaaatcttcccgggctgctgtgggcaacaagatgtttgtcaagggtgcccctgagggcgtcatcgaccgctgtaactatgtgcgagttggcaccacccgggtgccactgacggggccggtgaaggaaaagatcatggcggtgatcaaggagtggggcactggccgggacaccctgcgctgcttggccctggccacccgggacacccccccgaagcgagaggaaatggtcctggatgactctgccaggttcctggagtatgagacggacctgacattcgtgggtgtagtgggcatgctgga

SEQ ID NO: 109687 - DNA, 195 bp, Homo sapiens
  Payload ID: 1542
  Gene Symbol: ATP2A1
  Gene Name: ATPase, Ca++ transporting, cardiac muscle, fast twitch 1
  ENST ID: ENST00000564112
  CDS Start-End: 1-73
caagatctcactgccagtcattgggctcgacgaaatcctcaagttcgttgctcggaactacctagagggataactgttccccctcctccatctctgagcccgtgtcacaggtatcacccccttcttgccctcagcccagctgctgtgcccctgccacccgcgccccctcagccccttgcgcgtcgcatccaaggt

SEQ ID NO: 109688 - DNA, 576 bp, Homo sapiens
  Payload ID: 1542
  Gene Symbol: ATP2A1
  Gene Name: ATPase, Ca++ transporting, cardiac muscle, fast twitch 1
  ENST ID: ENST00000562185
  CDS Start-End: 498-576
cctaaaggttagagtcctgtccggggcagaagtctcccaggcgctttctccttgaagcagccaacccttgaactgccccccactttgccgagtctgtttctggactccaggcgagcttcttagcccttctctgggcaccaagctgtctgcccaccaccctagagcctccccactgcaggccggagtccagggcgctccatcccagaccttcacccactagaccttaacccggggccctccccttgcctcctcccccagggaagaccctgtgggagctggtgatagagcagtttgaagacctcctggtgcggattctcctcctggccgcatgcatttccttcgtgctggcctggtttgaggaaggtgaagagaccatcactgcctttgttgaaccctttgtcatcctcttgatcctcattgccaatgccatcgtgggggtttggcaggagcggaacgcagagaacgccatcgaggccctgaaggagtatgagccagagatggggaaggtctaccgggctgaccgcaagtcagtgcaaaggatcaaggctcgggacatcgtccctggggacatcgtgg

SEQ ID NO: 109689 - DNA, 545 bp, Homo sapiens
  Payload ID: 1542
  Gene Symbol: ATP2A1
  Gene Name: ATPase, Ca++ transporting, cardiac muscle, fast twitch 1
  ENST ID: ENST00000563975
  CDS Start-End: 205-545
cacgcgtttctcccttcagggtttcttaaggaagagctgggccgttgtccaatgctcgcagggggaagaagatactgagaaaacagagtcccgagatccagagttttgggaggttttaatgggatgaacttgatgaacctcaaggtggcctgattctcttagccacaaagtcttgggtgtggggggcatgaggctgaaccccaaatgaatctgtccttttcttctttttcctgggtagagctccctgctgaggaagggaagaccctgtgggagctggtgatagagcagtttgaagacctcctggtgcggattctcctcctggccgcatgcatttccttcgtgctggcctggtttgaggaaggtgaagagaccatcactgcctttgttgaaccctttgtcatcctcttgatcctcattgccaatgccatcgtgggggtttggcaggagcggaacgcagagaacgccatcgaggccctgaaggagtatgagccagagatggggaaggtctaccgggctgaccgcaagtcagtgcaaaggatcaaggc

SEQ ID NO: 109690 - DNA, 4453 bp, Homo sapiens
  Payload ID: 1543
  Gene Symbol: ATP2A2
  Gene Name: ATPase, Ca++ transporting, cardiac muscle, slow twitch 2
  Uniprot ID: P16615
  ENST ID: ENST00000308664
  CDS Start-End: 675-3668
gcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctgcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgat

SEQ ID NO: 109691 - DNA, 5702 bp, Homo sapiens
  Payload ID: 1543
  Gene Symbol: ATP2A2
  Gene Name: ATPase, Ca++ transporting, cardiac muscle, slow twitch 2
  ENST ID: ENST00000377685
  CDS Start-End: 494-646
gccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacggtaggtgcagggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaaccaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacaga

SEQ ID NO: 109692 - DNA, 4094 bp, Homo sapiens
  Payload ID: 1543
  Gene Symbol: ATP2A2
  Gene Name: ATPase, Ca++ transporting, cardiac muscle, slow twitch 2
  Uniprot ID: P16615
  ENST ID: ENST00000539276
  CDS Start-End: 110-3238
cccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataa

SEQ ID NO: 109693 - DNA, 529 bp, Homo sapiens
  Payload ID: 1543
  Gene Symbol: ATP2A2
  Gene Name: ATPase, Ca++ transporting, cardiac muscle, slow twitch 2
  ENST ID: ENST00000552636
  CDS Start-End: 393-527
gaggggggctctgaaggagccagattaggatgcagagcgcagcccgggcgaccgagggcgaggaggcgagccaaggacatcagcccgagggcgcctcgagacgccccgcgtggaccgcgctcccagctcctcggcctcgccttccaaccatccgcccaccggccccagagcagcgtgcccactgtgagcgccccaccctgcgtctgcagagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagtt

SEQ ID NO: 109694 - DNA, 2951 bp, Homo sapiens
  Payload ID: 1543
  Gene Symbol: ATP2A2
  Gene Name: ATPase, Ca++ transporting, cardiac muscle, slow twitch 2
  ENST ID: ENST00000548169
  CDS Start-End: 1-2800
aacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgact

SEQ ID NO: 109695 - DNA, 264 bp, Homo sapiens
  Payload ID: 1543
  Gene Symbol: ATP2A2
  Gene Name: ATPase, Ca++ transporting, cardiac muscle, slow twitch 2
  ENST ID: ENST00000553144
  CDS Start-End: 1-141
ctcatcttccagatcacaccgctgaacgtgacccagtggctgatggtgctgaaaatctccttgcccgtgattctcatggatgagacgctcaagtttgtggcccgcaactacctggaacctgttcttagctcagaactttagttgtactctgcttgaggggaagaaggctcctgctctgctgtcaatactggagtaaccgcttcctaaaccattttgcagaaatgtaagggtgttcggttgcgtgcatgtgcgtttttagcaaca

SEQ ID NO: 109696 - DNA, 6777 bp, Homo sapiens
  Payload ID: 1544
  Gene Symbol: ATP2B1
  Gene Name: ATPase, Ca++ transporting, plasma membrane 1
  Uniprot ID: P20020
  ENST ID: ENST00000261173
  CDS Start-End: 182-3844
ggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtttaagtggaaaccctgcagatttagaaagaagagaagcagtgtttggaaagaattttatacctcctaaaaagccaaaaacctttcttcaattagtatgggaagcattacaagatgtcactttaattatattagaaattgcagccatagtatcattgggcctttctttttatcagcctccagaaggggataatgcactttgtggagaagtttctgttggggaggaagaaggtgaaggtgaaactggttggattgaaggagctgcaatcctcttgtctgtagtgtgtgtggtgttagtaacagctttcaatgactggagtaaggaaaaacagtttagaggtttgcagagccgaattgaacaagaacagaagttcactgtcatcaggggtggtcaggtcattcagatacctgtagctgacattactgttggagatattgctcaagtgaaatatggtgatcttcttccagctgacggcatacttattcaaggcaacgatcttaaaattgatgaaagctcattgactggtgaatcagatcatgttaaaaagtctttagataaggatcccttacttctatcaggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagagattgagcaagagaggatagacaagatttggccaaaacttcgagtacttgcaagatcatctcctactgataagcatacactggttaaaggtataattgacagcactgtctcagaccaacgccaggttgtagctgtaactggtgatggtacaaatgatggcccagcactaaagaaagcagatgttggatttgcaatgggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagataataattgtgcagtttggtggaaaacctttcagttgttcagaactttcaatagaacagtggctatggtcaatattcctaggaatgggaacattactctggggccagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcaggaaaaaaaaaaaaaggggtgtttctattgaaactgtactaaatttttgcctacaatttaccttgttaaatattgtagataaattgctaatactaatagccaaatagataacactaatgctttgtttaaaaaaacgaaaaaaacaaaacaaaacaaaaaaacatgagcagtggtgttctaatgaagttatgacatctgtcctaattagtttcttaaatacatttactacttaatggttttgaagcaactgtttaatttttaaaatttttgaaaacttgctaataaccttttgttcagaatttagtagattgtttaatgcaggacatcaactacataatgaaagatgcttgaaatgcttttgttatttcaggcaaatcaaattaaatcagactatcaaactacaagagaaccttagtcttttttgtttttgtctaaacatgttagtttagtgatgtcttggtgaactgtgagtgaactgtattgatttttctaatctttagagaccttcacacagcatgagggctgttggcattttgaaaaaggttaataagtagaagcatacatgttttccttttgtttttgaaacttgtttgtaaacataaataaatatgcccttttattaaataaattcatggcaatgtttttttaaaagacatttcagcttctttactcagttctgcatatacagtgcatcagtctgttctctttgaccacaattggaatacatttcaagatggtaacagccccatgaagtaccgctttaattccttgctggtaatctaatagaatcagattaagaaaattaacacaattttaccatttgacatactcttcattgaatttagtttgtctaaaatagtctcacaggtaaaaaacataacaacaatgaccaccattgtctttgatacatttattttaattcttaagtggccaaataacagattaggtaaaatgagattacatgaaaaggttctaaaatgatatatttagatgcaataattaaccatatgctagaatgcccacctctaagccaattggattctttagctctctttttctttccttcatctaccttcttctcttttttgcctctgtctttaccctttagaaactggcatgtgttagggcccagatttcaccagatacacaatcctcaggctgacataaagtttacgaggactgctactataactgagagtgctgaccaagcaaagaaacatttagttgatggtgcttgatatttttggtgggtgggggaaatctttttctcaccatcaaatctttgcagtaatcctctgcaggtcttagaaacacattggctctgtcagcatttgtaattgtacatttattcatcaggtatttatagtgaatcatactgtaaaaaagaggtagcatgatatgctggaaagcatattagactaggagtcaagacctggtttctagtcttggttttgccattaatgtgctgcatgatcttgggaaaatcatttaccctaaataagggtggtggactatcttgaagaaccctttcaactctaaaaattgaccctatcaactggagagcccacaaggcatagggaatagagaaaagggaaatgttttcagttttcttttttattttggttatgcttaaatatgaatgtaattaccaaaagatttagaagtgcatgtgctttggaggatttgtattgagcttttacagtattcatttttcaactcaaggcaatggctttctacaccaactctaatccataaacgggtcttatgacatctatgaagtagtagcaagacatgcttagtgtgtatttctctctttgagacactgtaatttctaccagaaatttccagagcattatgtaggtagaaaaaaatgcaagcaagctgttaaagatcttggatcccattatatagtatgtatagctgaaatctgtaattcaatcactttttctcttttatcctctaaccaaaaaattgtttaattttgcatcccaaatgtttttaatctttgtatattttttaaaaatccttttctcctcatcattgccttttttgtggttgtaaatagacttacttgcactttgaagatgagttactccttgtcatcttacaaatatgtgatatggtaattttcataacagatgtcagttttgaaccaagaattggtgatttgtttataagaaaaaaactggcttcatttctgtgaaattgctctttgaaaatttctttttacacgtgtaagccaactgagataccgtgatggtgttgatttctttcaatgatgcttaccatctattttagccactgagccttttattatttgtctatttgtaaagtttatttgtcttaactcatttaataaatatactgtttatctgtttctg

SEQ ID NO: 109697 - DNA, 6977 bp, Homo sapiens
  Payload ID: 1544
  Gene Symbol: ATP2B1
  Gene Name: ATPase, Ca++ transporting, plasma membrane 1
  Uniprot ID: P20020
  ENST ID: ENST00000359142
  CDS Start-End: 226-3756
acagatgtgtatatctcatgattgatatggagaaactagtcatgggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtttaagtggaaaccctgcagatttagaaagaagagaagcagtgtttggaaagaattttatacctcctaaaaagccaaaaacctttcttcaattagtatgggaagcattacaagatgtcactttaattatattagaaattgcagccatagtatcattgggcctttctttttatcagcctccagaaggggataatgcactttgtggagaagtttctgttggggaggaagaaggtgaaggtgaaactggttggattgaaggagctgcaatcctcttgtctgtagtgtgtgtggtgttagtaacagctttcaatgactggagtaaggaaaaacagtttagaggtttgcagagccgaattgaacaagaacagaagttcactgtcatcaggggtggtcaggtcattcagatacctgtagctgacattactgttggagatattgctcaagtgaaatatggtgatcttcttccagctgacggcatacttattcaaggcaacgatcttaaaattgatgaaagctcattgactggtgaatcagatcatgttaaaaagtctttagataaggatcccttacttctatcaggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagagattgagcaagagaggatagacaagatttggccaaaacttcgagtacttgcaagatcatctcctactgataagcatacactggttaaaggtataattgacagcactgtctcagaccaacgccaggttgtagctgtaactggtgatggtacaaatgatggcccagcactaaagaaagcagatgttggatttgcaatgggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagataataattgtgcagtttggtggaaaacctttcagttgttcagaactttcaatagaacagtggctatggtcaatattcctaggaatgggaacattactctggggccagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagatggatgtagtgaatgctttccagagtggaagttccattcagggggctctaaggcggcaaccctccatcgccagccagcatcatgatgtaacaaatatttctacccctacacatgtagtgttttcctcttctactgcttctactactgtggggtattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcaggaaaaaaaaaaaaaggggtgtttctattgaaactgtactaaatttttgcctacaatttaccttgttaaatattgtagataaattgctaatactaatagccaaatagataacactaatgctttgtttaaaaaaacgaaaaaaacaaaacaaaacaaaaaaacatgagcagtggtgttctaatgaagttatgacatctgtcctaattagtttcttaaatacatttactacttaatggttttgaagcaactgtttaatttttaaaatttttgaaaacttgctaataaccttttgttcagaatttagtagattgtttaatgcaggacatcaactacataatgaaagatgcttgaaatgcttttgttatttcaggcaaatcaaattaaatcagactatcaaactacaagagaaccttagtcttttttgtttttgtctaaacatgttagtttagtgatgtcttggtgaactgtgagtgaactgtattgatttttctaatctttagagaccttcacacagcatgagggctgttggcattttgaaaaaggttaataagtagaagcatacatgttttccttttgtttttgaaacttgtttgtaaacataaataaatatgcccttttattaaataaattcatggcaatgtttttttaaaagacatttcagcttctttactcagttctgcatatacagtgcatcagtctgttctctttgaccacaattggaatacatttcaagatggtaacagccccatgaagtaccgctttaattccttgctggtaatctaatagaatcagattaagaaaattaacacaattttaccatttgacatactcttcattgaatttagtttgtctaaaatagtctcacaggtaaaaaacataacaacaatgaccaccattgtctttgatacatttattttaattcttaagtggccaaataacagattaggtaaaatgagattacatgaaaaggttctaaaatgatatatttagatgcaataattaaccatatgctagaatgcccacctctaagccaattggattctttagctctctttttctttccttcatctaccttcttctcttttttgcctctgtctttaccctttagaaactggcatgtgttagggcccagatttcaccagatacacaatcctcaggctgacataaagtttacgaggactgctactataactgagagtgctgaccaagcaaagaaacatttagttgatggtgcttgatatttttggtgggtgggggaaatctttttctcaccatcaaatctttgcagtaatcctctgcaggtcttagaaacacattggctctgtcagcatttgtaattgtacatttattcatcaggtatttatagtgaatcatactgtaaaaaagaggtagcatgatatgctggaaagcatattagactaggagtcaagacctggtttctagtcttggttttgccattaatgtgctgcatgatcttgggaaaatcatttaccctaaataagggtggtggactatcttgaagaaccctttcaactctaaaaattgaccctatcaactggagagcccacaaggcatagggaatagagaaaagggaaatgttttcagttttcttttttattttggttatgcttaaatatgaatgtaattaccaaaagatttagaagtgcatgtgctttggaggatttgtattgagcttttacagtattcatttttcaactcaaggcaatggctttctacaccaactctaatccataaacgggtcttatgacatctatgaagtagtagcaagacatgcttagtgtgtatttctctctttgagacactgtaatttctaccagaaatttccagagcattatgtaggtagaaaaaaatgcaagcaagctgttaaagatcttggatcccattatatagtatgtatagctgaaatctgtaattcaatcactttttctcttttatcctctaaccaaaaaattgtttaattttgcatcccaaatgtttttaatctttgtatattttttaaaaatccttttctcctcatcattgccttttttgtggttgtaaatagacttacttgcactttgaagatgagttactccttgtcatcttacaaatatgtgatatggtaattttcataacagatgtcagttttgaaccaagaattggtgatttgtttataagaaaaaaactggcttcatttctgtgaaattgctctttgaaaatttctttttacacgtgtaagccaactgagataccgtgatggtgttgatttctttcaatgatgcttaccatctattttagccactgagccttttattatttgtctatttgtaaagtttatttgtcttaactcatttaataaatatactgtttatctgtttctgaa

SEQ ID NO: 109698 - DNA, 3127 bp, Homo sapiens
  Payload ID: 1544
  Gene Symbol: ATP2B1
  Gene Name: ATPase, Ca++ transporting, plasma membrane 1
  ENST ID: ENST00000393164
  CDS Start-End: 94-2985
tttcctaaatgttgaggctgttaaaaacaatattactgaagtttgaaatttggtggtagcaaggagatctatcagtatttttaaaaacaaactatgtttttggttataggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagagattgagcaagagaggatagacaagatttggccaaaacttcgagtacttgcaagatcatctcctactgataagcatacactggttaaaggtataattgacagcactgtctcagaccaacgccaggttgtagctgtaactggtgatggtacaaatgatggcccagcactaaagaaagcagatgttggatttgcaatgggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagataataattgtgcagtttggtggaaaacctttcagttgttcagaactttcaatagaacagtggctatggtcaatattcctaggaatgggaacattactctggggccagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatt

SEQ ID NO: 109699 - DNA, 7032 bp, Homo sapiens
  Payload ID: 1544
  Gene Symbol: ATP2B1
  Gene Name: ATPase, Ca++ transporting, plasma membrane 1
  Uniprot ID: P20020
  ENST ID: ENST00000428670
  CDS Start-End: 458-4120
agcgtgagtagggagccccggctggtggacgccgagcctctcggctccttggccgccccatccccgaggtgcagctgcacctccgcgtggcgccccgagccctgcgagccggctgcggacgcgctgaggacggagcccccatcctctgcgtttcccgctgccccttaacgccccgcgaccctcccgcagcctgcctttccttccccctcggaaaatggttcccactgccgggcgagatgtgtatatctcatgattgatatggagaaactagtcatgggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtttaagtggaaaccctgcagatttagaaagaagagaagcagtgtttggaaagaattttatacctcctaaaaagccaaaaacctttcttcaattagtatgggaagcattacaagatgtcactttaattatattagaaattgcagccatagtatcattgggcctttctttttatcagcctccagaaggggataatgcactttgtggagaagtttctgttggggaggaagaaggtgaaggtgaaactggttggattgaaggagctgcaatcctcttgtctgtagtgtgtgtggtgttagtaacagctttcaatgactggagtaaggaaaaacagtttagaggtttgcagagccgaattgaacaagaacagaagttcactgtcatcaggggtggtcaggtcattcagatacctgtagctgacattactgttggagatattgctcaagtgaaatatggtgatcttcttccagctgacggcatacttattcaaggcaacgatcttaaaattgatgaaagctcattgactggtgaatcagatcatgttaaaaagtctttagataaggatcccttacttctatcaggtactcatgtaatggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagagattgagcaagagaggatagacaagatttggccaaaacttcgagtacttgcaagatcatctcctactgataagcatacactggttaaaggtataattgacagcactgtctcagaccaacgccaggttgtagctgtaactggtgatggtacaaatgatggcccagcactaaagaaagcagatgttggatttgcaatgggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagataataattgtgcagtttggtggaaaacctttcagttgttcagaactttcaatagaacagtggctatggtcaatattcctaggaatgggaacattactctggggccagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcaggaaaaaaaaaaaaaggggtgtttctattgaaactgtactaaatttttgcctacaatttaccttgttaaatattgtagataaattgctaatactaatagccaaatagataacactaatgctttgtttaaaaaaacgaaaaaaacaaaacaaaacaaaaaaacatgagcagtggtgttctaatgaagttatgacatctgtcctaattagtttcttaaatacatttactacttaatggttttgaagcaactgtttaatttttaaaatttttgaaaacttgctaataaccttttgttcagaatttagtagattgtttaatgcaggacatcaactacataatgaaagatgcttgaaatgcttttgttatttcaggcaaatcaaattaaatcagactatcaaactacaagagaaccttagtcttttttgtttttgtctaaacatgttagtttagtgatgtcttggtgaactgtgagtgaactgtattgatttttctaatctttagagaccttcacacagcatgagggctgttggcattttgaaaaaggttaataagtagaagcatacatgttttccttttgtttttgaaacttgtttgtaaacataaataaatatgcccttttattaaataaattcatggcaatgtttttttaaaagacatttcagcttctttactcagttctgcatatacagtgcatcagtctgttctctttgaccacaattggaatacatttcaagatggtaacagccccatgaagtaccgctttaattccttgctggtaatctaatagaatcagattaagaaaattaacacaattttaccatttgacatactcttcattgaatttagtttgtctaaaatagtctcacaggtaaaaaacataacaacaatgaccaccattgtctttgatacatttattttaattcttaagtggccaaataacagattaggtaaaatgagattacatgaaaaggttctaaaatgatatatttagatgcaataattaaccatatgctagaatgcccacctctaagccaattggattctttagctctctttttctttccttcatctaccttcttctcttttttgcctctgtctttaccctttagaaactggcatgtgttagggcccagatttcaccagatacacaatcctcaggctgacataaagtttacgaggactgctactataactgagagtgctgaccaagcaaagaaacatttagttgatggtgcttgatatttttggtgggtgggggaaatctttttctcaccatcaaatctttgcagtaatcctctgcaggtcttagaaacacattggctctgtcagcatttgtaattgtacatttattcatcaggtatttatagtgaatcatactgtaaaaaagaggtagcatgatatgctggaaagcatattagactaggagtcaagacctggtttctagtcttggttttgccattaatgtgctgcatgatcttgggaaaatcatttaccctaaataagggtggtggactatcttgaagaaccctttcaactctaaaaattgaccctatcaactggagagcccacaaggcatagggaatagagaaaagggaaatgttttcagttttcttttttattttggttatgcttaaatatgaatgtaattaccaaaagatttagaagtgcatgtgctttggaggatttgtattgagcttttacagtattcatttttcaactcaaggcaatggctttctacaccaactctaatccataaacgggtcttatgacatctatgaagtagtagcaagacatgcttagtgtgtatttctctctttgagacactgtaatttctaccagaaatttccagagcattatgtaggtagaaaaaaatgcaagcaagctgttaaagatcttggatcccattatatagtatgtatagctgaaatctgtaattcaatcactttttctcttttatcctctaaccaaaaaattgtttaattttgcatcccaaatgtttttaatctttgtatattttttaaaaatccttttctcctcatcattgccttttttgtggttgtaaatagacttacttgcactttgaagatgagttactccttgtcatcttacaaatatgtgatatggtaattttcataacagatgtcagttttgaaccaagaattggtgatttgtttataagaaaaaaactggcttcatttctgtgaaattgctctttgaaaatttctttttacacgtgtaagccaactgagataccgtgatggtgttgatttctttcaatgatgcttaccatctattttagccactgagccttttattatttgtctatttgtaaagtttatttgtcttaactcatttaataaa

SEQ ID NO: 109700 - DNA, 607 bp, Homo sapiens
  Payload ID: 1544
  Gene Symbol: ATP2B1
  Gene Name: ATPase, Ca++ transporting, plasma membrane 1
  ENST ID: ENST00000551310
  CDS Start-End: 304-607
gtggcagcgggagcagctgcgccgccagcgtggagcgggaggcgtgtgggtgtggagaaaagggagcgccagaccggaacggatgtgtatatctcatgattgatatggagaaactagtcatgggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtgagttttattatgcttgtttttggttctttgtgcaaagagttctatatatttggcttataaatgagcatgcttatattatcttggcgattgtat

SEQ ID NO: 109701 - DNA, 486 bp, Homo sapiens
  Payload ID: 1544
  Gene Symbol: ATP2B1
  Gene Name: ATPase, Ca++ transporting, plasma membrane 1
  ENST ID: ENST00000550716
  CDS Start-End: 1-486
ttttcaacgaaataaatgcccggaaaattcatggtgaaagaaatgtattcgaaggaatctttaacaatgccatcttctgcacaattgttttaggcacttttgtggtacagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccct

SEQ ID NO: 109702 - DNA, 1358 bp, Homo sapiens
  Payload ID: 1544
  Gene Symbol: ATP2B1
  Gene Name: ATPase, Ca++ transporting, plasma membrane 1
  ENST ID: ENST00000635033
  CDS Start-End: 1-902
gagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagataataattgtgcagtttggtggaaaacctttcagttgttcagaactttcaatagaacagtggctatggtcaatattcctaggaatgggaacattactctggggccagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagatggatgtagtgaatgctttccagagtggaagttccattcagggggctctaaggcggcaaccctccatcgccagccagcatcatgatattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaagg

SEQ ID NO: 109703 - DNA, 8593 bp, Homo sapiens
  Payload ID: 1545
  Gene Symbol: ATP2B2
  Gene Name: ATPase, Ca++ transporting, plasma membrane 2
  Uniprot ID: Q01814
  ENST ID: ENST00000352432
  CDS Start-End: 71-3802
agccatcacccggcagcctcttgtccagcgctgacccttgggcccagcccgagcaaggaccgcagcaaacatgggtgacatgaccaacagcgacttttactccaaaaaccaaagaaatgagtcgagccatgggggcgagttcgggtgcacaatggaggagctccgctccctcatggagctgcggggcactgaggctgtggtcaagatcaaggagacttatggggacaccgaagccatctgccggcgcctcaaaacctcacctgttgaaggtttgccgggcaccgctccagacctggaaaagagaaagcaaatttttgggcaaaactttatacctccaaagaagccaaaaaccttcctgcagctcgtgtgggaggcgctgcaggacgtgacgctcatcatcctggagattgccgccatcatctccctggggctgtccttctaccacccgcccggcgagggcaacgaaggatgtgcgacggcccagggtggggcagaggatgaaggagaggcagaggcaggttggatcgagggggccgccattctcctctcagttatctgtgtggtcctggtcacggccttcaatgactggagcaaagagaaacagttccggggcctgcagagccgcatcgagcaggaacagaaatttaccgtggtccgggctggccaggtggtccagatccctgtggctgagatcgtggttggggacatagcccaggtcaaatatggtgacctcctccctgccgacggcctcttcatccagggcaatgacctcaagattgatgaaagctccctaactggagagtctgaccaggtgcgcaagtccgtggacaaggaccccatgctgctgtcaggaacccacgtgatggagggctcaggacggatgttggtgactgctgtgggtgtgaactctcagactggcatcatctttaccctcctgggggctggtggtgaagaggaagagaagaaagacaaaaaaggtgtgaagaagggggatggccttcagctaccagcagcagacggtgcggcagcttcaaatgctgcagatagtgcgaatgccagcctagtcaatggtaaaatgcaggatggcaatgtggacgccagccagagcaaagccaaacaacaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaagaaaatgatgaaggacaacaacctggtacgccacctggatgcctgtgagaccatgggcaatgccacagccatctgctcagacaagacaggcacgctgaccaccaatcgcatgacagtggtacaggcctatgtcggcgacgtccactataaagagatccccgaccccagctccatcaacaccaagaccatggagctgctgatcaatgccatcgccatcaacagcgcctacaccaccaagattctgcccccagagaaggagggcgccctgcctcggcaggtgggcaacaagacggagtgcggcctgctgggcttcgtgctggacctgaagcaggactacgagcccgtgcgcagccagatgccagaggagaagttgtacaaagtgtacaccttcaactccgtgcgcaagtccatgagcactgtcatcaagctgcccgacgagagcttccgcatgtacagcaagggggcttctgagatcgtgctcaagaagtgctgcaaaatcctcaatggggcgggagagcctcgtgtcttccggccccgcgaccgggacgagatggtaaagaaggtgattgagcccatggcttgcgatgggctccgcactatctgcgtggcctaccgcgacttccccagcagcccggagccggactgggacaatgagaatgacatcctcaacgaactcacctgcatctgcgtggtgggcatcgaggacccggtgcggccagaggtcccagaagccatccgcaagtgccagcgggcaggcatcacggtccgcatggtcactggcgacaatatcaacacggctcgggccatcgccatcaagtgtggcatcatccatcctggggaggactttctgtgcctcgagggcaaggagttcaacaggaggatccgcaacgagaagggggagattgagcaggagcgaattgacaagatctggccaaagctgcgggtgctggctcgctcctccccaacggacaagcataccctggttaaaggcatcatcgacagcacacacactgagcagcggcaggtggtggccgtgacgggggacgggaccaacgacgggcctgcactcaagaaggccgacgtgggcttcgccatgggcatcgcaggcactgacgtggccaaggaggcctcagacatcatcctgacagacgacaatttcagcagcatcgtcaaggcagtgatgtggggccgcaacgtctatgacagcatctccaaattcttgcagttccagctcaccgtcaacgtggtggccgtgattgtggccttcacaggcgcctgcatcacgcaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctgggccatgctgtctaccagcttgccctcatcttcaccctgctctttgttggcgagaagatgttccagatcgacagcgggaggaacgcgcccctgcattcgccaccctcagaacattacaccatcatcttcaacaccttcgtcatgatgcagctcttcaacgagatcaacgcccgcaagatccacggcgagcgcaatgtctttgacggcatcttccggaaccccatcttctgcaccatcgtgctgggcacctttgccatccagatagtgatcgtgcagtttggagggaagccattcagctgctctccactgcagctggaccagtggatgtggtgcatattcattgggttaggagagctcgtttggggccaggtcatcgccaccatcccgaccagcagactcaagttcctcaaggaggcaggcaggctcacacagaaggaggagatcccggaggaggagctcaacgaggacgtggaggagatcgaccacgcggagcgggagctgcggcggggccagatcctgtggttccgaggcctgaatcggatccagacacagatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctctcgcctgcccgcccgccctcatggaccccgctgccacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatatataaagtttctttgccggcatgttgccttgtttccgcttaaattgctctattttaacttatttatgtcctaaaagaagaatgtaatttgtttacaaacctgtagataacgtctttggctatttgtatggtttaagaacactggtggctgagatgctataaaaacagctcggcccaacagacacttcccctgggttgcatcctggatgttttatgatagccatgctctgatttttgcctgctatttccgttcaataatgtcactaccgtgagaggctcaggcagaagccaaatgctaccgagttgccatcctgaggggtttaacaacatgctccgtagacgaagggagaggaggagagaaggcttcctgggtttgcaacactaacggccatccggcccaaggatgccaggatctgcaaagcactgctcgaagacttttctctcaatgaaactcgcttgagtttactaagagcatttcaaaaataggttctctttggcactgtctgtacagagattgaggtagtgttgaaatattataaatggtattgtgttgatttttttttttatttagtaacttacaggtttgtttccttattaatggcagcatctgagctgttggcatattggatgaggatcagtatggcttgctgcttttatttttatttttgaagaagaatagcctttttctctgcactatttagatccgaatgaaccttatgatgtgtatattgagatgtactcagtgtgattttaaaccaaattgtcttcctgtagtcacaatatatactgtagccttttaacagcaagtcttgctttcccaaacagaaagccattctgaaaccctacagtatcacaggtgagaaaaggtggttattttttccccaagacaacagcactagtaatcccacttaataagagcttatttaattggatgtcagcctcttaactgctaagcactttgtgggtctcagcgtttttcataaaagaacttttgtatttaatacaaagtttgctttgagacttttcagcatatgatcttttttccataaacttgtacagtgcaaaagacattttgaataccatgatcgatgatgtcccatgcttcgaggaaaaccaaacactttccgcctctcttgcaaaatccattcctcatgctgaccctcctcacgatggctgtgtcagcccagccccttcccttctccaggcccagagaactcttccacaaacaagatgagagccactcgggaaaagagccatagtcaactgggagggcctacatctggatggcggtggaaaaacttgagggtttggggttcaaagtcagcccatcccacctggcaaaatcctcctggaaggaggaccttcaagagcgcatcacctgaatgtcgtgaagaagtatctctgaatgtatccaggagaggaactgcataaccaaaggggtgaccagccctcagatgtgcttattggattccagtacaaacgccaccaaagccagcccactgctctcctacaaggaaggaaagatctgcacgtgtaaaacatggggcagccttggaacatggtgttttttggagtttcctttctcacagttttccatctccccacttctttgatcagtcatgtgtccgtgacctcgttccatgacatcaggatagctgtgtttgcacaccatgctccatgttcattcggagccaggaggggttctcagtggagcctggcttagggaacagggagcgatggaagaatgccaacattagcgttggtcttctcttgtcaggaatgaaggatgcttgcacacatgcaccccctcactctcacacttgcacacatacacacacacacacacgaaatggttggtttgtcaaaactcactgtagtacataaagcttgcactctgcgtcctatatctagcagcatggggtacgtttggcagttcactccattagggggtaaataatttatgaccattcatctgtttttatgaatttttttatctagacaataatgtaaataaagaactcaccatctctgttcatttaatactatgcaatggttatgctttcaatcgctggctcttctgactcgtgcagtgtggttctgaaatgtttgtggtttaaaaaaaaaagcaaaaaacaacatcaaacagaacatagtaaatatatctgtaatgtatacttttttctactttgggactgcatcatccacatagcttcttttctgtcctctagacaagggctccaggagtaagtggcagatttggttctgagagctaagctcaccaacttgtctccccctcaacagatgagggaagggcagggagcccgttcagtgactcctggcgctgcagaatcactcatctttggaggtgagcagagagagctctgaggagtttccttcttgcaactcaggcggagctttctttaactcaggagcagcctccattgctcccgccaacccctcaccatggccccttgtccccttgtcccaaccatagcatagagatgacaagagagaggcagtcctatttctgagactggaccaattaaaatgactgcactggctcaaaggactctgaacctgtcttgtcctgggtcctccagttgttggaagccactcttttccccaaccatgctgaaatgccacctttaccacacactgatgtcttacatagacttagatctatttctggaacttctcttctcttcgcttacttgggtgtctcatctggcaccagccatacaattttaactattgtcaatttctaatgtcttattatgtggtgggatgagtcccttcactcttcttttacaaaatttcctagttattctctcacatctattcttccacataaactttaaattgtgcccagtcctccaccccctgtcccattcccacccccaaattctgggctctgtcattccctgtgccatcatcttccccccattgtaattactgtccactcagggctgtgaaatagactatgttctgtaaagagggacaaaaagggcatcctgatcttgagagaagcctgctgttcctcccatcatttcacctgccccctaagcccaggagttgtcatgagaggtcaccaggcccccactcaatctcagcttgggaaccaaagtcacccaccttggttgtgttggggtggacccgccatctgtccctggtccagacgagaaagaggagtctctcctaggcctggagctgggaaagaatgtgtggcccagttgtctgcacttctaattctcatcatggagaaacctttattcctatctccctttcctgaactggttttttgttgtttttgtttcattttgttttggggggatagtttcttgctctttaatttggagtctccagtacctttgggatgcaggcagttcttgcctgggccttctcggaaccctcactcccctagcccactcttgcgctacctgcaggaggctgccaacctggtgcattctgacaagcctcccacccaaatctctctcctgccattgtgtccaaaatcccaccattagaggctcttgtagggaagagcgtttcttgaaggcttttaggccttccagagccaggagggaagtcagacaatagcaggaagtccccaggccttttcaaagttccaaaccaagctctcctgattttaatgtagagatcataccaacccaggtgggggaggagggtccccagccccaggcagcagccatcaccccctccactgaaaacaatattggaggctgctttgggactgcccttctcagccccctaagtctgttttgtaatgcctgtggtgctctccctcctggacctttcctctcgggggtcaccacactttgctaactcttgtgtgcacatattttataatagagtagcgagggaatggtgccgcctccagcttccgtaagctgcccgggctctggggggctctgggacaatcggggctgggaagtgactgtgctcttattgtacactctttatttctctgtatctttggcttgtgctctttgtaattaatgggatttgtctgccttttcaacactatactgagcaataacaataaatgcacacgtggaaatgca

SEQ ID NO: 109704 - DNA, 8962 bp, Homo sapiens
  Payload ID: 1545
  Gene Symbol: ATP2B2
  Gene Name: ATPase, Ca++ transporting, plasma membrane 2
  Uniprot ID: Q01814
  ENST ID: ENST00000360273
  CDS Start-End: 440-4171
agtctgcagaggggcccgggcacgctggctgggctcagccgcggcaccagctgccgcaccgcgattacggggctgcccgccgggaaaccgtgcaggattggtggtgattttcatagccaagagccaccacccctgaccatgtagatgccagttccagggagcagcatgggccccactgaatggagactcctgggtctacagccctgagcccctccggcccctggacctcgtcccacaccggaggacacctcttggagctcaccaccactgtcaccagcccgcctcggccacccccaccccccgggacccggagtcggccgcctggtgccacagctgaccagtgagggtgtgctgaggacagccacaagcagccatcacccggcagcctcttgtccagcgctgacccttgggcccagcccgagcaaggaccgcagcaaacatgggtgacatgaccaacagcgacttttactccaaaaaccaaagaaatgagtcgagccatgggggcgagttcgggtgcacaatggaggagctccgctccctcatggagctgcggggcactgaggctgtggtcaagatcaaggagacttatggggacaccgaagccatctgccggcgcctcaaaacctcacctgttgaaggtttgccgggcaccgctccagacctggaaaagagaaagcaaatttttgggcaaaactttatacctccaaagaagccaaaaaccttcctgcagctcgtgtgggaggcgctgcaggacgtgacgctcatcatcctggagattgccgccatcatctccctggggctgtccttctaccacccgcccggcgagggcaacgaaggatgtgcgacggcccagggtggggcagaggatgaaggagaggcagaggcaggttggatcgagggggccgccattctcctctcagttatctgtgtggtcctggtcacggccttcaatgactggagcaaagagaaacagttccggggcctgcagagccgcatcgagcaggaacagaaatttaccgtggtccgggctggccaggtggtccagatccctgtggctgagatcgtggttggggacatagcccaggtcaaatatggtgacctcctccctgccgacggcctcttcatccagggcaatgacctcaagattgatgaaagctccctaactggagagtctgaccaggtgcgcaagtccgtggacaaggaccccatgctgctgtcaggaacccacgtgatggagggctcaggacggatgttggtgactgctgtgggtgtgaactctcagactggcatcatctttaccctcctgggggctggtggtgaagaggaagagaagaaagacaaaaaaggtgtgaagaagggggatggccttcagctaccagcagcagacggtgcggcagcttcaaatgctgcagatagtgcgaatgccagcctagtcaatggtaaaatgcaggatggcaatgtggacgccagccagagcaaagccaaacaacaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaagaaaatgatgaaggacaacaacctggtacgccacctggatgcctgtgagaccatgggcaatgccacagccatctgctcagacaagacaggcacgctgaccaccaatcgcatgacagtggtacaggcctatgtcggcgacgtccactataaagagatccccgaccccagctccatcaacaccaagaccatggagctgctgatcaatgccatcgccatcaacagcgcctacaccaccaagattctgcccccagagaaggagggcgccctgcctcggcaggtgggcaacaagacggagtgcggcctgctgggcttcgtgctggacctgaagcaggactacgagcccgtgcgcagccagatgccagaggagaagttgtacaaagtgtacaccttcaactccgtgcgcaagtccatgagcactgtcatcaagctgcccgacgagagcttccgcatgtacagcaagggggcttctgagatcgtgctcaagaagtgctgcaaaatcctcaatggggcgggagagcctcgtgtcttccggccccgcgaccgggacgagatggtaaagaaggtgattgagcccatggcttgcgatgggctccgcactatctgcgtggcctaccgcgacttccccagcagcccggagccggactgggacaatgagaatgacatcctcaacgaactcacctgcatctgcgtggtgggcatcgaggacccggtgcggccagaggtcccagaagccatccgcaagtgccagcgggcaggcatcacggtccgcatggtcactggcgacaatatcaacacggctcgggccatcgccatcaagtgtggcatcatccatcctggggaggactttctgtgcctcgagggcaaggagttcaacaggaggatccgcaacgagaagggggagattgagcaggagcgaattgacaagatctggccaaagctgcgggtgctggctcgctcctccccaacggacaagcataccctggttaaaggcatcatcgacagcacacacactgagcagcggcaggtggtggccgtgacgggggacgggaccaacgacgggcctgcactcaagaaggccgacgtgggcttcgccatgggcatcgcaggcactgacgtggccaaggaggcctcagacatcatcctgacagacgacaatttcagcagcatcgtcaaggcagtgatgtggggccgcaacgtctatgacagcatctccaaattcttgcagttccagctcaccgtcaacgtggtggccgtgattgtggccttcacaggcgcctgcatcacgcaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctgggccatgctgtctaccagcttgccctcatcttcaccctgctctttgttggcgagaagatgttccagatcgacagcgggaggaacgcgcccctgcattcgccaccctcagaacattacaccatcatcttcaacaccttcgtcatgatgcagctcttcaacgagatcaacgcccgcaagatccacggcgagcgcaatgtctttgacggcatcttccggaaccccatcttctgcaccatcgtgctgggcacctttgccatccagatagtgatcgtgcagtttggagggaagccattcagctgctctccactgcagctggaccagtggatgtggtgcatattcattgggttaggagagctcgtttggggccaggtcatcgccaccatcccgaccagcagactcaagttcctcaaggaggcaggcaggctcacacagaaggaggagatcccggaggaggagctcaacgaggacgtggaggagatcgaccacgcggagcgggagctgcggcggggccagatcctgtggttccgaggcctgaatcggatccagacacagatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctctcgcctgcccgcccgccctcatggaccccgctgccacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatatataaagtttctttgccggcatgttgccttgtttccgcttaaattgctctattttaacttatttatgtcctaaaagaagaatgtaatttgtttacaaacctgtagataacgtctttggctatttgtatggtttaagaacactggtggctgagatgctataaaaacagctcggcccaacagacacttcccctgggttgcatcctggatgttttatgatagccatgctctgatttttgcctgctatttccgttcaataatgtcactaccgtgagaggctcaggcagaagccaaatgctaccgagttgccatcctgaggggtttaacaacatgctccgtagacgaagggagaggaggagagaaggcttcctgggtttgcaacactaacggccatccggcccaaggatgccaggatctgcaaagcactgctcgaagacttttctctcaatgaaactcgcttgagtttactaagagcatttcaaaaataggttctctttggcactgtctgtacagagattgaggtagtgttgaaatattataaatggtattgtgttgatttttttttttatttagtaacttacaggtttgtttccttattaatggcagcatctgagctgttggcatattggatgaggatcagtatggcttgctgcttttatttttatttttgaagaagaatagcctttttctctgcactatttagatccgaatgaaccttatgatgtgtatattgagatgtactcagtgtgattttaaaccaaattgtcttcctgtagtcacaatatatactgtagccttttaacagcaagtcttgctttcccaaacagaaagccattctgaaaccctacagtatcacaggtgagaaaaggtggttattttttccccaagacaacagcactagtaatcccacttaataagagcttatttaattggatgtcagcctcttaactgctaagcactttgtgggtctcagcgtttttcataaaagaacttttgtatttaatacaaagtttgctttgagacttttcagcatatgatcttttttccataaacttgtacagtgcaaaagacattttgaataccatgatcgatgatgtcccatgcttcgaggaaaaccaaacactttccgcctctcttgcaaaatccattcctcatgctgaccctcctcacgatggctgtgtcagcccagccccttcccttctccaggcccagagaactcttccacaaacaagatgagagccactcgggaaaagagccatagtcaactgggagggcctacatctggatggcggtggaaaaacttgagggtttggggttcaaagtcagcccatcccacctggcaaaatcctcctggaaggaggaccttcaagagcgcatcacctgaatgtcgtgaagaagtatctctgaatgtatccaggagaggaactgcataaccaaaggggtgaccagccctcagatgtgcttattggattccagtacaaacgccaccaaagccagcccactgctctcctacaaggaaggaaagatctgcacgtgtaaaacatggggcagccttggaacatggtgttttttggagtttcctttctcacagttttccatctccccacttctttgatcagtcatgtgtccgtgacctcgttccatgacatcaggatagctgtgtttgcacaccatgctccatgttcattcggagccaggaggggttctcagtggagcctggcttagggaacagggagcgatggaagaatgccaacattagcgttggtcttctcttgtcaggaatgaaggatgcttgcacacatgcaccccctcactctcacacttgcacacatacacacacacacacacgaaatggttggtttgtcaaaactcactgtagtacataaagcttgcactctgcgtcctatatctagcagcatggggtacgtttggcagttcactccattagggggtaaataatttatgaccattcatctgtttttatgaatttttttatctagacaataatgtaaataaagaactcaccatctctgttcatttaatactatgcaatggttatgctttcaatcgctggctcttctgactcgtgcagtgtggttctgaaatgtttgtggtttaaaaaaaaaagcaaaaaacaacatcaaacagaacatagtaaatatatctgtaatgtatacttttttctactttgggactgcatcatccacatagcttcttttctgtcctctagacaagggctccaggagtaagtggcagatttggttctgagagctaagctcaccaacttgtctccccctcaacagatgagggaagggcagggagcccgttcagtgactcctggcgctgcagaatcactcatctttggaggtgagcagagagagctctgaggagtttccttcttgcaactcaggcggagctttctttaactcaggagcagcctccattgctcccgccaacccctcaccatggccccttgtccccttgtcccaaccatagcatagagatgacaagagagaggcagtcctatttctgagactggaccaattaaaatgactgcactggctcaaaggactctgaacctgtcttgtcctgggtcctccagttgttggaagccactcttttccccaaccatgctgaaatgccacctttaccacacactgatgtcttacatagacttagatctatttctggaacttctcttctcttcgcttacttgggtgtctcatctggcaccagccatacaattttaactattgtcaatttctaatgtcttattatgtggtgggatgagtcccttcactcttcttttacaaaatttcctagttattctctcacatctattcttccacataaactttaaattgtgcccagtcctccaccccctgtcccattcccacccccaaattctgggctctgtcattccctgtgccatcatcttccccccattgtaattactgtccactcagggctgtgaaatagactatgttctgtaaagagggacaaaaagggcatcctgatcttgagagaagcctgctgttcctcccatcatttcacctgccccctaagcccaggagttgtcatgagaggtcaccaggcccccactcaatctcagcttgggaaccaaagtcacccaccttggttgtgttggggtggacccgccatctgtccctggtccagacgagaaagaggagtctctcctaggcctggagctgggaaagaatgtgtggcccagttgtctgcacttctaattctcatcatggagaaacctttattcctatctccctttcctgaactggttttttgttgtttttgtttcattttgttttggggggatagtttcttgctctttaatttggagtctccagtacctttgggatgcaggcagttcttgcctgggccttctcggaaccctcactcccctagcccactcttgcgctacctgcaggaggctgccaacctggtgcattctgacaagcctcccacccaaatctctctcctgccattgtgtccaaaatcccaccattagaggctcttgtagggaagagcgtttcttgaaggcttttaggccttccagagccaggagggaagtcagacaatagcaggaagtccccaggccttttcaaagttccaaaccaagctctcctgattttaatgtagagatcataccaacccaggtgggggaggagggtccccagccccaggcagcagccatcaccccctccactgaaaacaatattggaggctgctttgggactgcccttctcagccccctaagtctgttttgtaatgcctgtggtgctctccctcctggacctttcctctcgggggtcaccacactttgctaactcttgtgtgcacatattttataatagagtagcgagggaatggtgccgcctccagcttccgtaagctgcccgggctctggggggctctgggacaatcggggctgggaagtgactgtgctcttattgtacactctttatttctctgtatctttggcttgtgctctttgtaattaatgggatttgtctgccttttcaacactatactgagcaataacaataaatgcacacgtggaaatgca

SEQ ID NO: 109705 - DNA, 8900 bp, Homo sapiens
  Payload ID: 1545
  Gene Symbol: ATP2B2
  Gene Name: ATPase, Ca++ transporting, plasma membrane 2
  Uniprot ID: Q01814
  ENST ID: ENST00000383800
  CDS Start-End: 513-4109
ggcgagatgctctcctagaaccggcgccggcgcctccgccccccgccccccacccgctcgggcaggatggtacagtctgcagaggggcccgggcacgctggctgggctcagccgcggcaccagctgccgcaccgcgattacggggctgcccgccgggaaaccgtgcaggattggtggtgattttcatagccaagagccaccacccctgaccatgtagatgccagttccagggagcagcatgggccccactgaatggagactcctgggtctacagccctgagcccctccggcccctggacctcgtcccacaccggaggacacctcttggagctcaccaccactgtcaccagcccgcctcggccacccccaccccccgggacccggagtcggccgcctggtgccacagctgaccagtgagggtgtgctgaggacagccacaagcagccatcacccggcagcctcttgtccagcgctgacccttgggcccagcccgagcaaggaccgcagcaaacatgggtgacatgaccaacagcgacttttactccaaaaaccaaagaaatgagtcgagccatgggggcgagttcgggtgcacaatggaggagctccgctccctcatggagctgcggggcactgaggctgtggtcaagatcaaggagacttatggggacaccgaagccatctgccggcgcctcaaaacctcacctgttgaaggtttgccgggcaccgctccagacctggaaaagagaaagcaaatttttgggcaaaactttatacctccaaagaagccaaaaaccttcctgcagctcgtgtgggaggcgctgcaggacgtgacgctcatcatcctggagattgccgccatcatctccctggggctgtccttctaccacccgcccggcgagggcaacgaaggatgtgcgacggcccagggtggggcagaggatgaaggagaggcagaggcaggttggatcgagggggccgccattctcctctcagttatctgtgtggtcctggtcacggccttcaatgactggagcaaagagaaacagttccggggcctgcagagccgcatcgagcaggaacagaaatttaccgtggtccgggctggccaggtggtccagatccctgtggctgagatcgtggttggggacatagcccaggtcaaatatggtgacctcctccctgccgacggcctcttcatccagggcaatgacctcaagattgatgaaagctccctaactggagagtctgaccaggtgcgcaagtccgtggacaaggaccccatgctgctgtcaggaacccacgtgatggagggctcaggacggatgttggtgactgctgtgggtgtgaactctcagactggcatcatctttaccctcctgggggctggtggtgaagaggaagagaagaaagacaaaaaagccaaacaacaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaagaaaatgatgaaggacaacaacctggtacgccacctggatgcctgtgagaccatgggcaatgccacagccatctgctcagacaagacaggcacgctgaccaccaatcgcatgacagtggtacaggcctatgtcggcgacgtccactataaagagatccccgaccccagctccatcaacaccaagaccatggagctgctgatcaatgccatcgccatcaacagcgcctacaccaccaagattctgcccccagagaaggagggcgccctgcctcggcaggtgggcaacaagacggagtgcggcctgctgggcttcgtgctggacctgaagcaggactacgagcccgtgcgcagccagatgccagaggagaagttgtacaaagtgtacaccttcaactccgtgcgcaagtccatgagcactgtcatcaagctgcccgacgagagcttccgcatgtacagcaagggggcttctgagatcgtgctcaagaagtgctgcaaaatcctcaatggggcgggagagcctcgtgtcttccggccccgcgaccgggacgagatggtaaagaaggtgattgagcccatggcttgcgatgggctccgcactatctgcgtggcctaccgcgacttccccagcagcccggagccggactgggacaatgagaatgacatcctcaacgaactcacctgcatctgcgtggtgggcatcgaggacccggtgcggccagaggtcccagaagccatccgcaagtgccagcgggcaggcatcacggtccgcatggtcactggcgacaatatcaacacggctcgggccatcgccatcaagtgtggcatcatccatcctggggaggactttctgtgcctcgagggcaaggagttcaacaggaggatccgcaacgagaagggggagattgagcaggagcgaattgacaagatctggccaaagctgcgggtgctggctcgctcctccccaacggacaagcataccctggttaaaggcatcatcgacagcacacacactgagcagcggcaggtggtggccgtgacgggggacgggaccaacgacgggcctgcactcaagaaggccgacgtgggcttcgccatgggcatcgcaggcactgacgtggccaaggaggcctcagacatcatcctgacagacgacaatttcagcagcatcgtcaaggcagtgatgtggggccgcaacgtctatgacagcatctccaaattcttgcagttccagctcaccgtcaacgtggtggccgtgattgtggccttcacaggcgcctgcatcacgcaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctgggccatgctgtctaccagcttgccctcatcttcaccctgctctttgttggcgagaagatgttccagatcgacagcgggaggaacgcgcccctgcattcgccaccctcagaacattacaccatcatcttcaacaccttcgtcatgatgcagctcttcaacgagatcaacgcccgcaagatccacggcgagcgcaatgtctttgacggcatcttccggaaccccatcttctgcaccatcgtgctgggcacctttgccatccagatagtgatcgtgcagtttggagggaagccattcagctgctctccactgcagctggaccagtggatgtggtgcatattcattgggttaggagagctcgtttggggccaggtcatcgccaccatcccgaccagcagactcaagttcctcaaggaggcaggcaggctcacacagaaggaggagatcccggaggaggagctcaacgaggacgtggaggagatcgaccacgcggagcgggagctgcggcggggccagatcctgtggttccgaggcctgaatcggatccagacacagatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctctcgcctgcccgcccgccctcatggaccccgctgccacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatatataaagtttctttgccggcatgttgccttgtttccgcttaaattgctctattttaacttatttatgtcctaaaagaagaatgtaatttgtttacaaacctgtagataacgtctttggctatttgtatggtttaagaacactggtggctgagatgctataaaaacagctcggcccaacagacacttcccctgggttgcatcctggatgttttatgatagccatgctctgatttttgcctgctatttccgttcaataatgtcactaccgtgagaggctcaggcagaagccaaatgctaccgagttgccatcctgaggggtttaacaacatgctccgtagacgaagggagaggaggagagaaggcttcctgggtttgcaacactaacggccatccggcccaaggatgccaggatctgcaaagcactgctcgaagacttttctctcaatgaaactcgcttgagtttactaagagcatttcaaaaataggttctctttggcactgtctgtacagagattgaggtagtgttgaaatattataaatggtattgtgttgatttttttttttatttagtaacttacaggtttgtttccttattaatggcagcatctgagctgttggcatattggatgaggatcagtatggcttgctgcttttatttttatttttgaagaagaatagcctttttctctgcactatttagatccgaatgaaccttatgatgtgtatattgagatgtactcagtgtgattttaaaccaaattgtcttcctgtagtcacaatatatactgtagccttttaacagcaagtcttgctttcccaaacagaaagccattctgaaaccctacagtatcacaggtgagaaaaggtggttattttttccccaagacaacagcactagtaatcccacttaataagagcttatttaattggatgtcagcctcttaactgctaagcactttgtgggtctcagcgtttttcataaaagaacttttgtatttaatacaaagtttgctttgagacttttcagcatatgatcttttttccataaacttgtacagtgcaaaagacattttgaataccatgatcgatgatgtcccatgcttcgaggaaaaccaaacactttccgcctctcttgcaaaatccattcctcatgctgaccctcctcacgatggctgtgtcagcccagccccttcccttctccaggcccagagaactcttccacaaacaagatgagagccactcgggaaaagagccatagtcaactgggagggcctacatctggatggcggtggaaaaacttgagggtttggggttcaaagtcagcccatcccacctggcaaaatcctcctggaaggaggaccttcaagagcgcatcacctgaatgtcgtgaagaagtatctctgaatgtatccaggagaggaactgcataaccaaaggggtgaccagccctcagatgtgcttattggattccagtacaaacgccaccaaagccagcccactgctctcctacaaggaaggaaagatctgcacgtgtaaaacatggggcagccttggaacatggtgttttttggagtttcctttctcacagttttccatctccccacttctttgatcagtcatgtgtccgtgacctcgttccatgacatcaggatagctgtgtttgcacaccatgctccatgttcattcggagccaggaggggttctcagtggagcctggcttagggaacagggagcgatggaagaatgccaacattagcgttggtcttctcttgtcaggaatgaaggatgcttgcacacatgcaccccctcactctcacacttgcacacatacacacacacacacacgaaatggttggtttgtcaaaactcactgtagtacataaagcttgcactctgcgtcctatatctagcagcatggggtacgtttggcagttcactccattagggggtaaataatttatgaccattcatctgtttttatgaatttttttatctagacaataatgtaaataaagaactcaccatctctgttcatttaatactatgcaatggttatgctttcaatcgctggctcttctgactcgtgcagtgtggttctgaaatgtttgtggtttaaaaaaaaaagcaaaaaacaacatcaaacagaacatagtaaatatatctgtaatgtatacttttttctactttgggactgcatcatccacatagcttcttttctgtcctctagacaagggctccaggagtaagtggcagatttggttctgagagctaagctcaccaacttgtctccccctcaacagatgagggaagggcagggagcccgttcagtgactcctggcgctgcagaatcactcatctttggaggtgagcagagagagctctgaggagtttccttcttgcaactcaggcggagctttctttaactcaggagcagcctccattgctcccgccaacccctcaccatggccccttgtccccttgtcccaaccatagcatagagatgacaagagagaggcagtcctatttctgagactggaccaattaaaatgactgcactggctcaaaggactctgaacctgtcttgtcctgggtcctccagttgttggaagccactcttttccccaaccatgctgaaatgccacctttaccacacactgatgtcttacatagacttagatctatttctggaacttctcttctcttcgcttacttgggtgtctcatctggcaccagccatacaattttaactattgtcaatttctaatgtcttattatgtggtgggatgagtcccttcactcttcttttacaaaatttcctagttattctctcacatctattcttccacataaactttaaattgtgcccagtcctccaccccctgtcccattcccacccccaaattctgggctctgtcattccctgtgccatcatcttccccccattgtaattactgtccactcagggctgtgaaatagactatgttctgtaaagagggacaaaaagggcatcctgatcttgagagaagcctgctgttcctcccatcatttcacctgccccctaagcccaggagttgtcatgagaggtcaccaggcccccactcaatctcagcttgggaaccaaagtcacccaccttggttgtgttggggtggacccgccatctgtccctggtccagacgagaaagaggagtctctcctaggcctggagctgggaaagaatgtgtggcccagttgtctgcacttctaattctcatcatggagaaacctttattcctatctccctttcctgaactggttttttgttgtttttgtttcattttgttttggggggatagtttcttgctctttaatttggagtctccagtacctttgggatgcaggcagttcttgcctgggccttctcggaaccctcactcccctagcccactcttgcgctacctgcaggaggctgccaacctggtgcattctgacaagcctcccacccaaatctctctcctgccattgtgtccaaaatcccaccattagaggctcttgtagggaagagcgtttcttgaaggcttttaggccttccagagccaggagggaagtcagacaatagcaggaagtccccaggccttttcaaagttccaaaccaagctctcctgattttaatgtagagatcataccaacccaggtgggggaggagggtccccagccccaggcagcagccatcaccccctccactgaaaacaatattggaggctgctttgggactgcccttctcagccccctaagtctgttttgtaatgcctgtggtgctctccctcctggacctttcctctcgggggtcaccacactttgctaactcttgtgtgcacatattttataatagagtagcgagggaatggtgccgcctccagcttccgtaagctgcccgggctctggggggctctgggacaatcggggctgggaagtgactgtgctcttattgtacactctttatttctctgtatctttggcttgtgctctttgtaattaatgggatttgtctgccttttcaacactatactgagcaataacaataaatgcacacgtggaaatgca

SEQ ID NO: 109706 - DNA, 8964 bp, Homo sapiens
  Payload ID: 1545
  Gene Symbol: ATP2B2
  Gene Name: ATPase, Ca++ transporting, plasma membrane 2
  Uniprot ID: Q01814
  ENST ID: ENST00000397077
  CDS Start-End: 577-4173
gggcagccgcggcagaggagccgcagccgcagcggggccgggccgggccgggcgcgcaccagcggcagcggcggcggcagcggcggcggcagcatctcgctctcggagccggcgcaggtttccctgtacttagagcgtggactgtgaacccccaagcagacgagctgaacttcgtcacccagtccctagagccagcaagacatgggccccagtttccagaccctgacacctctcatttaaccagaagacgtggaggggagccaccacccctgaccatgtagatgccagttccagggagcagcatgggccccactgaatggagactcctgggtctacagccctgagcccctccggcccctggacctcgtcccacaccggaggacacctcttggagctcaccaccactgtcaccagcccgcctcggccacccccaccccccgggacccggagtcggccgcctggtgccacagctgaccagtgagggtgtgctgaggacagccacaagcagccatcacccggcagcctcttgtccagcgctgacccttgggcccagcccgagcaaggaccgcagcaaacatgggtgacatgaccaacagcgacttttactccaaaaaccaaagaaatgagtcgagccatgggggcgagttcgggtgcacaatggaggagctccgctccctcatggagctgcggggcactgaggctgtggtcaagatcaaggagacttatggggacaccgaagccatctgccggcgcctcaaaacctcacctgttgaaggtttgccgggcaccgctccagacctggaaaagagaaagcaaatttttgggcaaaactttatacctccaaagaagccaaaaaccttcctgcagctcgtgtgggaggcgctgcaggacgtgacgctcatcatcctggagattgccgccatcatctccctggggctgtccttctaccacccgcccggcgagggcaacgaaggatgtgcgacggcccagggtggggcagaggatgaaggagaggcagaggcaggttggatcgagggggccgccattctcctctcagttatctgtgtggtcctggtcacggccttcaatgactggagcaaagagaaacagttccggggcctgcagagccgcatcgagcaggaacagaaatttaccgtggtccgggctggccaggtggtccagatccctgtggctgagatcgtggttggggacatagcccaggtcaaatatggtgacctcctccctgccgacggcctcttcatccagggcaatgacctcaagattgatgaaagctccctaactggagagtctgaccaggtgcgcaagtccgtggacaaggaccccatgctgctgtcaggaacccacgtgatggagggctcaggacggatgttggtgactgctgtgggtgtgaactctcagactggcatcatctttaccctcctgggggctggtggtgaagaggaagagaagaaagacaaaaaagccaaacaacaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaagaaaatgatgaaggacaacaacctggtacgccacctggatgcctgtgagaccatgggcaatgccacagccatctgctcagacaagacaggcacgctgaccaccaatcgcatgacagtggtacaggcctatgtcggcgacgtccactataaagagatccccgaccccagctccatcaacaccaagaccatggagctgctgatcaatgccatcgccatcaacagcgcctacaccaccaagattctgcccccagagaaggagggcgccctgcctcggcaggtgggcaacaagacggagtgcggcctgctgggcttcgtgctggacctgaagcaggactacgagcccgtgcgcagccagatgccagaggagaagttgtacaaagtgtacaccttcaactccgtgcgcaagtccatgagcactgtcatcaagctgcccgacgagagcttccgcatgtacagcaagggggcttctgagatcgtgctcaagaagtgctgcaaaatcctcaatggggcgggagagcctcgtgtcttccggccccgcgaccgggacgagatggtaaagaaggtgattgagcccatggcttgcgatgggctccgcactatctgcgtggcctaccgcgacttccccagcagcccggagccggactgggacaatgagaatgacatcctcaacgaactcacctgcatctgcgtggtgggcatcgaggacccggtgcggccagaggtcccagaagccatccgcaagtgccagcgggcaggcatcacggtccgcatggtcactggcgacaatatcaacacggctcgggccatcgccatcaagtgtggcatcatccatcctggggaggactttctgtgcctcgagggcaaggagttcaacaggaggatccgcaacgagaagggggagattgagcaggagcgaattgacaagatctggccaaagctgcgggtgctggctcgctcctccccaacggacaagcataccctggttaaaggcatcatcgacagcacacacactgagcagcggcaggtggtggccgtgacgggggacgggaccaacgacgggcctgcactcaagaaggccgacgtgggcttcgccatgggcatcgcaggcactgacgtggccaaggaggcctcagacatcatcctgacagacgacaatttcagcagcatcgtcaaggcagtgatgtggggccgcaacgtctatgacagcatctccaaattcttgcagttccagctcaccgtcaacgtggtggccgtgattgtggccttcacaggcgcctgcatcacgcaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctgggccatgctgtctaccagcttgccctcatcttcaccctgctctttgttggcgagaagatgttccagatcgacagcgggaggaacgcgcccctgcattcgccaccctcagaacattacaccatcatcttcaacaccttcgtcatgatgcagctcttcaacgagatcaacgcccgcaagatccacggcgagcgcaatgtctttgacggcatcttccggaaccccatcttctgcaccatcgtgctgggcacctttgccatccagatagtgatcgtgcagtttggagggaagccattcagctgctctccactgcagctggaccagtggatgtggtgcatattcattgggttaggagagctcgtttggggccaggtcatcgccaccatcccgaccagcagactcaagttcctcaaggaggcaggcaggctcacacagaaggaggagatcccggaggaggagctcaacgaggacgtggaggagatcgaccacgcggagcgggagctgcggcggggccagatcctgtggttccgaggcctgaatcggatccagacacagatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctctcgcctgcccgcccgccctcatggaccccgctgccacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatatataaagtttctttgccggcatgttgccttgtttccgcttaaattgctctattttaacttatttatgtcctaaaagaagaatgtaatttgtttacaaacctgtagataacgtctttggctatttgtatggtttaagaacactggtggctgagatgctataaaaacagctcggcccaacagacacttcccctgggttgcatcctggatgttttatgatagccatgctctgatttttgcctgctatttccgttcaataatgtcactaccgtgagaggctcaggcagaagccaaatgctaccgagttgccatcctgaggggtttaacaacatgctccgtagacgaagggagaggaggagagaaggcttcctgggtttgcaacactaacggccatccggcccaaggatgccaggatctgcaaagcactgctcgaagacttttctctcaatgaaactcgcttgagtttactaagagcatttcaaaaataggttctctttggcactgtctgtacagagattgaggtagtgttgaaatattataaatggtattgtgttgatttttttttttatttagtaacttacaggtttgtttccttattaatggcagcatctgagctgttggcatattggatgaggatcagtatggcttgctgcttttatttttatttttgaagaagaatagcctttttctctgcactatttagatccgaatgaaccttatgatgtgtatattgagatgtactcagtgtgattttaaaccaaattgtcttcctgtagtcacaatatatactgtagccttttaacagcaagtcttgctttcccaaacagaaagccattctgaaaccctacagtatcacaggtgagaaaaggtggttattttttccccaagacaacagcactagtaatcccacttaataagagcttatttaattggatgtcagcctcttaactgctaagcactttgtgggtctcagcgtttttcataaaagaacttttgtatttaatacaaagtttgctttgagacttttcagcatatgatcttttttccataaacttgtacagtgcaaaagacattttgaataccatgatcgatgatgtcccatgcttcgaggaaaaccaaacactttccgcctctcttgcaaaatccattcctcatgctgaccctcctcacgatggctgtgtcagcccagccccttcccttctccaggcccagagaactcttccacaaacaagatgagagccactcgggaaaagagccatagtcaactgggagggcctacatctggatggcggtggaaaaacttgagggtttggggttcaaagtcagcccatcccacctggcaaaatcctcctggaaggaggaccttcaagagcgcatcacctgaatgtcgtgaagaagtatctctgaatgtatccaggagaggaactgcataaccaaaggggtgaccagccctcagatgtgcttattggattccagtacaaacgccaccaaagccagcccactgctctcctacaaggaaggaaagatctgcacgtgtaaaacatggggcagccttggaacatggtgttttttggagtttcctttctcacagttttccatctccccacttctttgatcagtcatgtgtccgtgacctcgttccatgacatcaggatagctgtgtttgcacaccatgctccatgttcattcggagccaggaggggttctcagtggagcctggcttagggaacagggagcgatggaagaatgccaacattagcgttggtcttctcttgtcaggaatgaaggatgcttgcacacatgcaccccctcactctcacacttgcacacatacacacacacacacacgaaatggttggtttgtcaaaactcactgtagtacataaagcttgcactctgcgtcctatatctagcagcatggggtacgtttggcagttcactccattagggggtaaataatttatgaccattcatctgtttttatgaatttttttatctagacaataatgtaaataaagaactcaccatctctgttcatttaatactatgcaatggttatgctttcaatcgctggctcttctgactcgtgcagtgtggttctgaaatgtttgtggtttaaaaaaaaaagcaaaaaacaacatcaaacagaacatagtaaatatatctgtaatgtatacttttttctactttgggactgcatcatccacatagcttcttttctgtcctctagacaagggctccaggagtaagtggcagatttggttctgagagctaagctcaccaacttgtctccccctcaacagatgagggaagggcagggagcccgttcagtgactcctggcgctgcagaatcactcatctttggaggtgagcagagagagctctgaggagtttccttcttgcaactcaggcggagctttctttaactcaggagcagcctccattgctcccgccaacccctcaccatggccccttgtccccttgtcccaaccatagcatagagatgacaagagagaggcagtcctatttctgagactggaccaattaaaatgactgcactggctcaaaggactctgaacctgtcttgtcctgggtcctccagttgttggaagccactcttttccccaaccatgctgaaatgccacctttaccacacactgatgtcttacatagacttagatctatttctggaacttctcttctcttcgcttacttgggtgtctcatctggcaccagccatacaattttaactattgtcaatttctaatgtcttattatgtggtgggatgagtcccttcactcttcttttacaaaatttcctagttattctctcacatctattcttccacataaactttaaattgtgcccagtcctccaccccctgtcccattcccacccccaaattctgggctctgtcattccctgtgccatcatcttccccccattgtaattactgtccactcagggctgtgaaatagactatgttctgtaaagagggacaaaaagggcatcctgatcttgagagaagcctgctgttcctcccatcatttcacctgccccctaagcccaggagttgtcatgagaggtcaccaggcccccactcaatctcagcttgggaaccaaagtcacccaccttggttgtgttggggtggacccgccatctgtccctggtccagacgagaaagaggagtctctcctaggcctggagctgggaaagaatgtgtggcccagttgtctgcacttctaattctcatcatggagaaacctttattcctatctccctttcctgaactggttttttgttgtttttgtttcattttgttttggggggatagtttcttgctctttaatttggagtctccagtacctttgggatgcaggcagttcttgcctgggccttctcggaaccctcactcccctagcccactcttgcgctacctgcaggaggctgccaacctggtgcattctgacaagcctcccacccaaatctctctcctgccattgtgtccaaaatcccaccattagaggctcttgtagggaagagcgtttcttgaaggcttttaggccttccagagccaggagggaagtcagacaatagcaggaagtccccaggccttttcaaagttccaaaccaagctctcctgattttaatgtagagatcataccaacccaggtgggggaggagggtccccagccccaggcagcagccatcaccccctccactgaaaacaatattggaggctgctttgggactgcccttctcagccccctaagtctgttttgtaatgcctgtggtgctctccctcctggacctttcctctcgggggtcaccacactttgctaactcttgtgtgcacatattttataatagagtagcgagggaatggtgccgcctccagcttccgtaagctgcccgggctctggggggctctgggacaatcggggctgggaagtgactgtgctcttattgtacactctttatttctctgtatctttggcttgtgctctttgtaattaatgggatttgtctgccttttcaacactatactgagcaataacaataaatgcacacgtggaaatgca

SEQ ID NO: 109707 - DNA, 4016 bp, Homo sapiens
  Payload ID: 1545
  Gene Symbol: ATP2B2
  Gene Name: ATPase, Ca++ transporting, plasma membrane 2
  ENST ID: ENST00000452124
  CDS Start-End: 1-3300
gccgccatcatctccctggggctgtccttctaccacccgcccggcgagggcaacgaaggatgtgcgacggcccagggtggggcagaggatgaaggagaggcagaggcaggttggatcgagggggccgccattctcctctcagttatctgtgtggtcctggtcacggccttcaatgactggagcaaagagaaacagttccggggcctgcagagccgcatcgagcaggaacagaaatttaccgtggtccgggctggccaggtggtccagatccctgtggctgagatcgtggttggggacatagcccaggtcaaatatggtgacctcctccctgccgacggcctcttcatccagggcaatgacctcaagattgatgaaagctccctaactggagagtctgaccaggtgcgcaagtccgtggacaaggaccccatgctgctgtcaggaacccacgtgatggagggctcaggacggatgttggtgactgctgtgggtgtgaactctcagactggcatcatctttaccctcctgggggctggtggtgaagaggaagagaagaaagacaaaaaaggtaaaatgcaggatggcaatgtggacgccagccagagcaaagccaaacaacaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaagaaaatgatgaaggacaacaacctggtacgccacctggatgcctgtgagaccatgggcaatgccacagccatctgctcagacaagacaggcacgctgaccaccaatcgcatgacagtggtacaggcctatgtcggcgacgtccactataaagagatccccgaccccagctccatcaacaccaagaccatggagctgctgatcaatgccatcgccatcaacagcgcctacaccaccaagattctgcccccagagaaggagggcgccctgcctcggcaggtgggcaacaagacggagtgcggcctgctgggcttcgtgctggacctgaagcaggactacgagcccgtgcgcagccagatgccagaggagaagttgtacaaagtgtacaccttcaactccgtgcgcaagtccatgagcactgtcatcaagctgcccgacgagagcttccgcatgtacagcaagggggcttctgagatcgtgctcaagaagtgctgcaaaatcctcaatggggcgggagagcctcgtgtcttccggccccgcgaccgggacgagatggtaaagaaggtgattgagcccatggcttgcgatgggctccgcactatctgcgtggcctaccgcgacttccccagcagcccggagccggactgggacaatgagaatgacatcctcaacgaactcacctgcatctgcgtggtgggcatcgaggacccggtgcggccagaggtcccagaagccatccgcaagtgccagcgggcaggcatcacggtccgcatggtcactggcgacaatatcaacacggctcgggccatcgccatcaagtgtggcatcatccatcctggggaggactttctgtgcctcgagggcaaggagttcaacaggaggatccgcaacgagaagggggagattgagcaggagcgaattgacaagatctggccaaagctgcgggtgctggctcgctcctccccaacggacaagcataccctggttaaaggcatcatcgacagcacacacactgagcagcggcaggtggtggccgtgacgggggacgggaccaacgacgggcctgcactcaagaaggccgacgtgggcttcgccatgggcatcgcaggcactgacgtggccaaggaggcctcagacatcatcctgacagacgacaatttcagcagcatcgtcaaggcagtgatgtggggccgcaacgtctatgacagcatctccaaattcttgcagttccagctcaccgtcaacgtggtggccgtgattgtggccttcacaggcgcctgcatcacgcaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctgggccatgctgtctaccagcttgccctcatcttcaccctgctctttgttggcgagaagatgttccagatcgacagcgggaggaacgcgcccctgcattcgccaccctcagaacattacaccatcatcttcaacaccttcgtcatgatgcagctcttcaacgagatcaacgcccgcaagatccacggcgagcgcaatgtctttgacggcatcttccggaaccccatcttctgcaccatcgtgctgggcacctttgccatccagatagtgatcgtgcagtttggagggaagccattcagctgctctccactgcagctggaccagtggatgtggtgcatattcattgggttaggagagctcgtttggggccaggtcatcgccaccatcccgaccagcagactcaagttcctcaaggaggcaggcaggctcacacagaaggaggagatcccggaggaggagctcaacgaggacgtggaggagatcgaccacgcggagcgggagctgcggcggggccagatcctgtggttccgaggcctgaatcggatccagacacagatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctctcgcctgcccgcccgccctcatggaccccgctgccacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatatataaa

SEQ ID NO: 109708 - DNA, 9101 bp, Homo sapiens
  Payload ID: 1545
  Gene Symbol: ATP2B2
  Gene Name: ATPase, Ca++ transporting, plasma membrane 2
  Uniprot ID: Q01814
  ENST ID: ENST00000460129
  CDS Start-End: 415-3879
agctgaacttcgtcacccagtccctagagccagcaagacatgggccccagtttccagaccctgacacctctcatttaaccagaagacgtggaggggagccaccacccctgaccatgtagatgccagttccagggagcagcatgggccccactgaatggagactcctgggtctacagccctgagcccctccggcccctggacctcgtcccacaccggaggacacctcttggagctcaccaccactgtcaccagcccgcctcggccacccccaccccccgggacccggagtcggccgcctggtgccacagctgaccagtgagggtgtgctgaggacagccacaagcagccatcacccggcagcctcttgtccagcgctgacccttgggcccagcccgagcaaggaccgcagcaaacatgggtgacatgaccaacagcgacttttactccaaaaaccaaagaaatgagtcgagccatgggggcgagttcgggtgcacaatggaggagctccgctccctcatggagctgcggggcactgaggctgtggtcaagatcaaggagacttatggggacaccgaagccatctgccggcgcctcaaaacctcacctgttgaaggtttgccgggcaccgctccagacctggaaaagagaaagcaaatttttgggcaaaactttatacctccaaagaagccaaaaaccttcctgcagctcgtgtgggaggcgctgcaggacgtgacgctcatcatcctggagattgccgccatcatctccctggggctgtccttctaccacccgcccggcgagggcaacgaaggatgtgcgacggcccagggtggggcagaggatgaaggagaggcagaggcaggttggatcgagggggccgccattctcctctcagttatctgtgtggtcctggtcacggccttcaatgactggagcaaagagaaacagttccggggcctgcagagccgcatcgagcaggaacagaaatttaccgtggtccgggctggccaggtggtccagatccctgtggctgagatcgtggttggggacatagcccaggtcaaatatggtgacctcctccctgccgacggcctcttcatccagggcaatgacctcaagattgatgaaagctccctaactggagagtctgaccaggtgcgcaagtccgtggacaaggaccccatgctgctgtcaggaacccacgtgatggagggctcaggacggatgttggtgactgctgtgggtgtgaactctcagactggcatcatctttaccctcctgggggctggtggtgaagaggaagagaagaaagacaaaaaagccaaacaacaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaagaaaatgatgaaggacaacaacctggtacgccacctggatgcctgtgagaccatgggcaatgccacagccatctgctcagacaagacaggcacgctgaccaccaatcgcatgacagtggtacaggcctatgtcggcgacgtccactataaagagatccccgaccccagctccatcaacaccaagaccatggagctgctgatcaatgccatcgccatcaacagcgcctacaccaccaagattctgcccccagagaaggagggcgccctgcctcggcaggtgggcaacaagacggagtgcggcctgctgggcttcgtgctggacctgaagcaggactacgagcccgtgcgcagccagatgccagaggagaagttgtacaaagtgtacaccttcaactccgtgcgcaagtccatgagcactgtcatcaagctgcccgacgagagcttccgcatgtacagcaagggggcttctgagatcgtgctcaagaagtgctgcaaaatcctcaatggggcgggagagcctcgtgtcttccggccccgcgaccgggacgagatggtaaagaaggtgattgagcccatggcttgcgatgggctccgcactatctgcgtggcctaccgcgacttccccagcagcccggagccggactgggacaatgagaatgacatcctcaacgaactcacctgcatctgcgtggtgggcatcgaggacccggtgcggccagaggtcccagaagccatccgcaagtgccagcgggcaggcatcacggtccgcatggtcactggcgacaatatcaacacggctcgggccatcgccatcaagtgtggcatcatccatcctggggaggactttctgtgcctcgagggcaaggagttcaacaggaggatccgcaacgagaagggggagattgagcaggagcgaattgacaagatctggccaaagctgcgggtgctggctcgctcctccccaacggacaagcataccctggttaaaggcatcatcgacagcacacacactgagcagcggcaggtggtggccgtgacgggggacgggaccaacgacgggcctgcactcaagaaggccgacgtgggcttcgccatgggcatcgcaggcactgacgtggccaaggaggcctcagacatcatcctgacagacgacaatttcagcagcatcgtcaaggcagtgatgtggggccgcaacgtctatgacagcatctccaaattcttgcagttccagctcaccgtcaacgtggtggccgtgattgtggccttcacaggcgcctgcatcacgcaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctgggccatgctgtctaccagcttgccctcatcttcaccctgctctttgttggcgagaagatgttccagatcgacagcgggaggaacgcgcccctgcattcgccaccctcagaacattacaccatcatcttcaacaccttcgtcatgatgcagctcttcaacgagatcaacgcccgcaagatccacggcgagcgcaatgtctttgacggcatcttccggaaccccatcttctgcaccatcgtgctgggcacctttgccatccagatagtgatcgtgcagtttggagggaagccattcagctgctctccactgcagctggaccagtggatgtggtgcatattcattgggttaggagagctcgtttggggccaggtcatcgccaccatcccgaccagcagactcaagttcctcaaggaggcaggcaggctcacacagaaggaggagatcccggaggaggagctcaacgaggacgtggaggagatcgaccacgcggagcgggagctgcggcggggccagatcctgtggttccgaggcctgaatcggatccagacacagattgaagtagtcaatactttcaagagcggggcctcctttcagggggccctgcggagacagtcctcggtcaccagccagagccaggatgtagccaatctctctagccctagtcgcgtgtcgttgtccaatgctctttcctctccgaccagccttcctcctgctgcagccgggcagggctagagaaccctggacacagagttcagcaagagagagtgaaattaaaagaggttgtgagtctttaaccttgagcctgaaatgaatgtgaatcaatcccagactcttggcttccttgaagccggatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctctcgcctgcccgcccgccctcatggaccccgctgccacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatatataaagtttctttgccggcatgttgccttgtttccgcttaaattgctctattttaacttatttatgtcctaaaagaagaatgtaatttgtttacaaacctgtagataacgtctttggctatttgtatggtttaagaacactggtggctgagatgctataaaaacagctcggcccaacagacacttcccctgggttgcatcctggatgttttatgatagccatgctctgatttttgcctgctatttccgttcaataatgtcactaccgtgagaggctcaggcagaagccaaatgctaccgagttgccatcctgaggggtttaacaacatgctccgtagacgaagggagaggaggagagaaggcttcctgggtttgcaacactaacggccatccggcccaaggatgccaggatctgcaaagcactgctcgaagacttttctctcaatgaaactcgcttgagtttactaagagcatttcaaaaataggttctctttggcactgtctgtacagagattgaggtagtgttgaaatattataaatggtattgtgttgatttttttttttatttagtaacttacaggtttgtttccttattaatggcagcatctgagctgttggcatattggatgaggatcagtatggcttgctgcttttatttttatttttgaagaagaatagcctttttctctgcactatttagatccgaatgaaccttatgatgtgtatattgagatgtactcagtgtgattttaaaccaaattgtcttcctgtagtcacaatatatactgtagccttttaacagcaagtcttgctttcccaaacagaaagccattctgaaaccctacagtatcacaggtgagaaaaggtggttattttttccccaagacaacagcactagtaatcccacttaataagagcttatttaattggatgtcagcctcttaactgctaagcactttgtgggtctcagcgtttttcataaaagaacttttgtatttaatacaaagtttgctttgagacttttcagcatatgatcttttttccataaacttgtacagtgcaaaagacattttgaataccatgatcgatgatgtcccatgcttcgaggaaaaccaaacactttccgcctctcttgcaaaatccattcctcatgctgaccctcctcacgatggctgtgtcagcccagccccttcccttctccaggcccagagaactcttccacaaacaagatgagagccactcgggaaaagagccatagtcaactgggagggcctacatctggatggcggtggaaaaacttgagggtttggggttcaaagtcagcccatcccacctggcaaaatcctcctggaaggaggaccttcaagagcgcatcacctgaatgtcgtgaagaagtatctctgaatgtatccaggagaggaactgcataaccaaaggggtgaccagccctcagatgtgcttattggattccagtacaaacgccaccaaagccagcccactgctctcctacaaggaaggaaagatctgcacgtgtaaaacatggggcagccttggaacatggtgttttttggagtttcctttctcacagttttccatctccccacttctttgatcagtcatgtgtccgtgacctcgttccatgacatcaggatagctgtgtttgcacaccatgctccatgttcattcggagccaggaggggttctcagtggagcctggcttagggaacagggagcgatggaagaatgccaacattagcgttggtcttctcttgtcaggaatgaaggatgcttgcacacatgcaccccctcactctcacacttgcacacatacacacacacacacacgaaatggttggtttgtcaaaactcactgtagtacataaagcttgcactctgcgtcctatatctagcagcatggggtacgtttggcagttcactccattagggggtaaataatttatgaccattcatctgtttttatgaatttttttatctagacaataatgtaaataaagaactcaccatctctgttcatttaatactatgcaatggttatgctttcaatcgctggctcttctgactcgtgcagtgtggttctgaaatgtttgtggtttaaaaaaaaaagcaaaaaacaacatcaaacagaacatagtaaatatatctgtaatgtatacttttttctactttgggactgcatcatccacatagcttcttttctgtcctctagacaagggctccaggagtaagtggcagatttggttctgagagctaagctcaccaacttgtctccccctcaacagatgagggaagggcagggagcccgttcagtgactcctggcgctgcagaatcactcatctttggaggtgagcagagagagctctgaggagtttccttcttgcaactcaggcggagctttctttaactcaggagcagcctccattgctcccgccaacccctcaccatggccccttgtccccttgtcccaaccatagcatagagatgacaagagagaggcagtcctatttctgagactggaccaattaaaatgactgcactggctcaaaggactctgaacctgtcttgtcctgggtcctccagttgttggaagccactcttttccccaaccatgctgaaatgccacctttaccacacactgatgtcttacatagacttagatctatttctggaacttctcttctcttcgcttacttgggtgtctcatctggcaccagccatacaattttaactattgtcaatttctaatgtcttattatgtggtgggatgagtcccttcactcttcttttacaaaatttcctagttattctctcacatctattcttccacataaactttaaattgtgcccagtcctccaccccctgtcccattcccacccccaaattctgggctctgtcattccctgtgccatcatcttccccccattgtaattactgtccactcagggctgtgaaatagactatgttctgtaaagagggacaaaaagggcatcctgatcttgagagaagcctgctgttcctcccatcatttcacctgccccctaagcccaggagttgtcatgagaggtcaccaggcccccactcaatctcagcttgggaaccaaagtcacccaccttggttgtgttggggtggacccgccatctgtccctggtccagacgagaaagaggagtctctcctaggcctggagctgggaaagaatgtgtggcccagttgtctgcacttctaattctcatcatggagaaacctttattcctatctccctttcctgaactggttttttgttgtttttgtttcattttgttttggggggatagtttcttgctctttaatttggagtctccagtacctttgggatgcaggcagttcttgcctgggccttctcggaaccctcactcccctagcccactcttgcgctacctgcaggaggctgccaacctggtgcattctgacaagcctcccacccaaatctctctcctgccattgtgtccaaaatcccaccattagaggctcttgtagggaagagcgtttcttgaaggcttttaggccttccagagccaggagggaagtcagacaatagcaggaagtccccaggccttttcaaagttccaaaccaagctctcctgattttaatgtagagatcataccaacccaggtgggggaggagggtccccagccccaggcagcagccatcaccccctccactgaaaacaatattggaggctgctttgggactgcccttctcagccccctaagtctgttttgtaatgcctgtggtgctctccctcctggacctttcctctcgggggtcaccacactttgctaactcttgtgtgcacatattttataatagagtagcgagggaatggtgccgcctccagcttccgtaagctgcccgggctctggggggctctgggacaatcggggctgggaagtgactgtgctcttattgtacactctttatttctctgtatctttggcttgtgctctttgtaattaatgggatttgtctgccttttcaacactatactgagcaataacaataaatgcacacgtggaaatgca

SEQ ID NO: 109709 - DNA, 6420 bp, Homo sapiens
  Payload ID: 1546
  Gene Symbol: ATP2B3
  Gene Name: ATPase, Ca++ transporting, plasma membrane 3
  Uniprot ID: Q16720
  ENST ID: ENST00000263519
  CDS Start-End: 127-3789
gtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaaggcaagcagcaggatggggccatggagagtagccagaccaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactatccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgtctcagcacatgcgcacacgcacactcggactcacacgaagtcacacgcacacatgcacgcacacacacatatggggacctgcacacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggaggaaggagaagaagtagaaagtgcgaagagctgagttccccacctttttttctattgatgcttcttttttaacaaactacagttttaccgtgtgtttgccatttgagctgtgtggtgggcagggggctggtttgggtttatggggagcttttgttgcacccatgcaggggcaatcagatcagcatcttcatgcaaaaaaaaaaaaaaagttgagtgctctgcaggcctgtgaagggtgccacctgagggagccgcctgcaagcggccctgcagccacaaagcaacccgccctctgcaaaaactaggcacatccgcagtgcgcatgtgtgtgcgtgcatgcacatatgtgtatgtgtgtggatctgtacacacacacgtatatatggccagatgcgtatttcaataaggaactatttactggcatgatatttgcattcctcttatcaggcattttcatttggaaatttcattattgaatgtagcaaggttgtagttgtttttttttttttttcagggaactagactgcaagaatatctttctggtcaacccatttttgtccctcatcaccccgcccccacctttcgctcctgccctctgcccggccctactgagattcccaaggagaaggccgagagggggcgctccaggtctggagcaggtataattggagcatttgcactgagacccctgccagagaggagaaaaccctttcaagggaaattttaatctaaaaggaaaaaaccaaaatattgatgagaaggagtcctccagttagtgaaaggggagtttcgttttcagctttctttggttcctactccaattccacatccttcatcctggccatgcccccaccttcaagagcatgaagcactcttggagttgtgggtcctgcccagagtccagagagcagcctcagctgagcacaggtccgagggggcgggggcagggccaagagttcaaaagaagccaatggagggagagggagcgtcagaagcccggaggagctggtggtgggagaatgacggcagggacgcagccacagttcagaccctgtcccctcagcacctggatggactcccactgtttgctttggcaaatgccgaggagtcctcggtagaccaccttgatgtctgctgtgacatcagaggtgccaccaccaaagcactcttcccaccctagtctttgtgtccagcggccaagcttaagccatgaagtcatggatttgtggctcagcaccaggtcctgaggggagcgtatcctggcagtgtgggcacctggtggccaagcctcagtttcccccaaatgagcaaaggggataaagaggggcccgacttttgccaccctcctgaggaagcccctaggtccacacagtgatgccatgggggacccttgccttccacacttgcaggtgtcacgttttgcagggaggtgtttgggccttgggctcagccactgggagacagttgggacctgagggacagaggatcggaatggaaaccaccaacgtgcactggcaccctcagaaggcttgtctcacctccaccggcatccacacaaaaccaaacaggagcaggcgtcatccccactattcccatgaatgccatgtcacccctgagcagaagcagtcaaatcttgggcaaaagaatttcggttagaaaagaaaatcccactttaaaatgccagctgcagataactcaaagccatcccttttttctaaagggcacattgagaatgtcacccatttgtaaactgttccctgatgtccttgtttaaacgataataagaaaaagggcaactccatttgttgagggtctttgtgttcttcaatgagaaatcaaatttgagacgttgaaattggagctgcgtgctgctgcactcaccggcttcttctcactctctgtcgtagacacaccgataggaccaatggccaatagatattaaaagcaaaccctcactgctgctgtataaagttgcctaatgtaaatgtctattgtttagtccctaggtcacctttgtgctgtgctgtggagttcagaaacggggtaccatgacctggaatcttttgctcttgtttttgcagtcttcaaggctgggggccctgtctcattgggaagcccctctttataaagcattatattacttggaatggcttggtcaactgtgttcagttcataaatatgttttacatttttatctgcctgttataaagatgaacaaaaaaacttaatgagaaagatcacagatacgtaataatttaaagtctgtagttgaatttcctaacttaaagaatagaccaaaatttctgtgtataaaaaaaaatgaaaggctccttacatcctg

SEQ ID NO: 109710 - DNA, 4280 bp, Homo sapiens
  Payload ID: 1546
  Gene Symbol: ATP2B3
  Gene Name: ATPase, Ca++ transporting, plasma membrane 3
  Uniprot ID: Q16720
  ENST ID: ENST00000349466
  CDS Start-End: 327-3989
ccgccgccggtgcagagcgtggggagcactcggccgcagccctcgcccgccgcagagggtcgcgtcccgcgccgccggccaggccgccccgtgcccaggcctttccatccttggagcggatcgttgcccgcctgacgcccgcccgcagcgacagcgcccgccggagccgaggccgcggcggcggccgtgcccatgcccgggtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaaggcaagcagcaggatggggccatggagagtagccagaccaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactatccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgtctcagcacatgcgcacacgcacactcggactcacacgaagtcacacgcacacatgcacgcacacacacatatggggacctgcacacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggag

SEQ ID NO: 109711 - DNA, 4234 bp, Homo sapiens
  Payload ID: 1546
  Gene Symbol: ATP2B3
  Gene Name: ATPase, Ca++ transporting, plasma membrane 3
  Uniprot ID: Q16720
  ENST ID: ENST00000359149
  CDS Start-End: 127-3648
gtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaaggcaagcagcaggatggggccatggagagtagccagaccaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactatccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagatggaggtagtgagtaccttcaagagaagcggttcagttcagggtgctgtgcgccggcggtcttcggtcctcagccagcttcatgacgtaaccaatctttctacccctactcacgcaattctctctgctgccaatcctaccagtgctgctgggaatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgtctcagcacatgcgcacacgcacactcggactcacacgaagtcacacgcacacatgcacgcacacacacatatggggacctgcacacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggag

SEQ ID NO: 109712 - DNA, 6742 bp, Homo sapiens
  Payload ID: 1546
  Gene Symbol: ATP2B3
  Gene Name: ATPase, Ca++ transporting, plasma membrane 3
  Uniprot ID: Q16720
  ENST ID: ENST00000370186
  CDS Start-End: 327-3806
ccgccgccggtgcagagcgtggggagcactcggccgcagccctcgcccgccgcagagggtcgcgtcccgcgccgccggccaggccgccccgtgcccaggcctttccatccttggagcggatcgttgcccgcctgacgcccgcccgcagcgacagcgcccgccggagccgaggccgcggcggcggccgtgcccatgcccgggtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactatccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagatggaggtagtgagtaccttcaagagaagcggttcagttcagggtgctgtgcgccggcggtcttcggtcctcagccagcttcatgacgtaaccaatctttctacccctactcacgcaattctctctgctgccaatcctaccagtgctgctgggaatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgtctcagcacatgcgcacacgcacactcggactcacacgaagtcacacgcacacatgcacgcacacacacatatggggacctgcacacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggaggaaggagaagaagtagaaagtgcgaagagctgagttccccacctttttttctattgatgcttcttttttaacaaactacagttttaccgtgtgtttgccatttgagctgtgtggtgggcagggggctggtttgggtttatggggagcttttgttgcacccatgcaggggcaatcagatcagcatcttcatgcaaaaaaaaaaaaaaagttgagtgctctgcaggcctgtgaagggtgccacctgagggagccgcctgcaagcggccctgcagccacaaagcaacccgccctctgcaaaaactaggcacatccgcagtgcgcatgtgtgtgcgtgcatgcacatatgtgtatgtgtgtggatctgtacacacacacgtatatatggccagatgcgtatttcaataaggaactatttactggcatgatatttgcattcctcttatcaggcattttcatttggaaatttcattattgaatgtagcaaggttgtagttgtttttttttttttttcagggaactagactgcaagaatatctttctggtcaacccatttttgtccctcatcaccccgcccccacctttcgctcctgccctctgcccggccctactgagattcccaaggagaaggccgagagggggcgctccaggtctggagcaggtataattggagcatttgcactgagacccctgccagagaggagaaaaccctttcaagggaaattttaatctaaaaggaaaaaaccaaaatattgatgagaaggagtcctccagttagtgaaaggggagtttcgttttcagctttctttggttcctactccaattccacatccttcatcctggccatgcccccaccttcaagagcatgaagcactcttggagttgtgggtcctgcccagagtccagagagcagcctcagctgagcacaggtccgagggggcgggggcagggccaagagttcaaaagaagccaatggagggagagggagcgtcagaagcccggaggagctggtggtgggagaatgacggcagggacgcagccacagttcagaccctgtcccctcagcacctggatggactcccactgtttgctttggcaaatgccgaggagtcctcggtagaccaccttgatgtctgctgtgacatcagaggtgccaccaccaaagcactcttcccaccctagtctttgtgtccagcggccaagcttaagccatgaagtcatggatttgtggctcagcaccaggtcctgaggggagcgtatcctggcagtgtgggcacctggtggccaagcctcagtttcccccaaatgagcaaaggggataaagaggggcccgacttttgccaccctcctgaggaagcccctaggtccacacagtgatgccatgggggacccttgccttccacacttgcaggtgtcacgttttgcagggaggtgtttgggccttgggctcagccactgggagacagttgggacctgagggacagaggatcggaatggaaaccaccaacgtgcactggcaccctcagaaggcttgtctcacctccaccggcatccacacaaaaccaaacaggagcaggcgtcatccccactattcccatgaatgccatgtcacccctgagcagaagcagtcaaatcttgggcaaaagaatttcggttagaaaagaaaatcccactttaaaatgccagctgcagataactcaaagccatcccttttttctaaagggcacattgagaatgtcacccatttgtaaactgttccctgatgtccttgtttaaacgataataagaaaaagggcaactccatttgttgagggtctttgtgttcttcaatgagaaatcaaatttgagacgttgaaattggagctgcgtgctgctgcactcaccggcttcttctcactctctgtcgtagacacaccgataggaccaatggccaatagatattaaaagcaaaccctcactgctgctgtataaagttgcctaatgtaaatgtctattgtttagtccctaggtcacctttgtgctgtgctgtggagttcagaaacggggtaccatgacctggaatcttttgctcttgtttttgcagtcttcaaggctgggggccctgtctcattgggaagcccctctttataaagcattatattacttggaatggcttggtcaactgtgttcagttcataaatatgttttacatttttatctgcctgttataaagatgaacaaaaaaacttaatgagaaagatcacagatacgtaataatttaaagtctgtagttgaatttcctaacttaaagaatagaccaaaatttctgtgtataaaaaaaaatgaaaggctccttacatcctggtctgggtaa

SEQ ID NO: 109713 - DNA, 4064 bp, Homo sapiens
  Payload ID: 1546
  Gene Symbol: ATP2B3
  Gene Name: ATPase, Ca++ transporting, plasma membrane 3
  Uniprot ID: Q16720
  ENST ID: ENST00000393842
  CDS Start-End: 405-3869
cagccaacagtcgctctaaatgggccttactctaactgatggatcctgtctgccctatagcctgttgcattcatgaagacagtgagggttagcagagcaccccgaccccaccctgtcctccaggatggagactccacctcccaggactccaagttcctcccctgtgggccaggcccccattcactcattcctccaggcccccggccacatgcgggactgaccacgcggtagacttcctgccgactccataccacgtgtctcaaagagcttagggcccagtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactatccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagatggaggtagtgagtaccttcaagagaagcggttcagttcagggtgctgtgcgccggcggtcttcggtcctcagccagcttcatgacgtaaccaatctttctacccctactcacgcaattctctctgctgccaatcctaccagtgctgctgggagtgagtcttgacttcccttttctctcataaatggcatctctggggaagaataagcctccccagctcggccttctctcttttgcagtcttgcattccgctcaccgtggcttttctgttctttctttaccgccctgtccagtccttcccgcccagacggtgtctctcgaaagccatattcttttatgaaacgtattcaacccatggca

SEQ ID NO: 109714 - DNA, 4658 bp, Homo sapiens
  Payload ID: 1547
  Gene Symbol: ATP2B4
  Gene Name: ATPase, Ca++ transporting, plasma membrane 4
  Uniprot ID: P23634
  ENST ID: ENST00000341360
  CDS Start-End: 398-3910
gctggttgttgctaaggttgctgccatggtaacatgcacatcctgtttacaccttcatctgggcaagttggtctaagctaggaacctacctaccctggacaactactatcatcaccacctggggacaccaatcatcgtgacacggagtccaccttccactcagttcccccatcctcttcctcctctcgctgccagacttcatacggaagaaaggatctagacttcggacggctactcgggagcttattgcacaagatatattcaatctattccctcactgggcccccagagaagcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcaagggatgcactgacccagattaatgtccactatggaggtgtacagaatctctgcagtagactgaaaacctcccctgtggaaggtctgtctgggaaccctgcagatctggagaaacgtaggcaggtgtttggacacaacgtgatcccccccaaaaagcccaagactttcttagaattagtgtgggaagctcttcaagatgtcacgcttatcatcctggagattgcagccatcatctccctggtcctgtccttttatcgccctgctggtgaagaaaatgaactgtgtggtcaagtcgcaactaccccagaagatgaaaatgaggcacaagctggctggattgagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgatctgctgcctgcagatggaatcctgatccaagggaatgatctgaagattgatgagagctctctgacaggggaatctgaccatgtcaagaagtccctggacaaagaccccatgttgctctcagggacccatgtcatggaaggttctggccggatggtggtgacagctgttggtgtcaactctcagactggaatcatccttactctcttgggggtcaatgaggatgacgaaggggagaaaaagaagaaaggtaaaaaacaaggagtccctgaaaatcgcaacaaagcaaagacccaagacggagtggccctggaaatccagccactcaacagccaggagggaatcgacaatgaggaaaaggacaagaaggcagtcaaggtgcctaaaaaggagaagtcagtgctgcagggcaagctgactcgcctggctgttcagattgggaaagccggtctgctcatgtctgctctcacggttttcatcctgattctatactttgtgattgacaactttgtgataaatcgcagaccatggctccctgagtgtactcccatctacatccagtactttgtcaagttcttcatcatcggcatcactgtactggtggtggctgtgccagaggggctgcctctggctgtcaccatctcactggcctactctgtgaagaaaatgatgaaagacaataacctagtacggcacttggatgcttgtgagaccatgggcaacgccaccgccatctgctctgataagacaggcacgttgaccatgaaccgcatgactgtggtacaagcttatattgggggcatccattaccgtcaaatcccaagccctgatgtcttcctgcccaaagtcctggacctcattgtcaatggcatttctatcaacagtgcttatacctccaagattctgcctccagagaaggagggaggcctgcctcggcaggtgggcaacaagaccgagtgtgctctgctaggctttgtcacagatctgaagcaggattatcaggctgtgcgtaatgaagtgcccgaggagaagctctacaaggtgtacacctttaactcagtgcgcaagtcaatgagcaccgtcatcaggaatcccaacggtggcttccgtatgtacagcaagggcgcctctgagatcatcttgcgcaagtgtaatcgaatcctggaccggaaaggggaagcagtgccattcaagaataaagacagagatgatatggtacgcactgtcatcgagcccatggcctgtgatggactccggactatctgcatagcttaccgggacttcgatgacacagagccctcttgggacaatgagaatgagatcctcaccgaactgacctgtatcgcggtggtgggcattgaggaccctgtgcgcccagaggtgccagatgctattgccaaatgcaaacaagctggcattactgtcagaatggtgacaggtgacaacatcaacacagcccgggccattgccaccaaatgtggcattctgacacctggggatgacttcctgtgcttagaaggcaaagaattcaaccggctcatccgcaacgagaaaggcgaggtagagcaagaaaagctggacaagatctggcctaagcttcgggtcctggcgcgatcttctcccactgacaagcacaccctggtgaaaggcataattgacagcactgttggggaacaccggcaggtcgtggctgtcactggtgatggcacaaatgacgggcctgctctgaagaaagcggatgttggttttgccatgggcatcgcaggcacagatgtagcaaaggaggcttcagacatcatcctaacagatgacaacttcaccagcattgtgaaggcagtgatgtggggacgaaatgtctatgacagcatctccaagttcctgcagttccagctcactgtcaatgtggtggccgtgattgtagccttcactggagcctgtatcactcaggattccccattgaaagctgtgcagatgttgtgggttaatctgatcatggacacttttgcttcattggccctggccacagagccccctacggaatctctgttgaagcggcgcccctatggccgaaataagcctctgatctcacgcactatgatgaagaacatcttgggccatgcattctatcagctcattgtcatctttatccttgtctttgcgggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccagattttcatcgtggaatttgggggtaaacccttcagttgtacaagcctcagcctgtctcagtggctgtggtgtctcttcattgggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagatcgacgtaattaacacattccagacgggagcctcttttaagggagtcctaaggcgacagaacatgggtcaacaccttgatgtaaaacttgttcctagttcatcctatgtagcagttgcaccagtcaaatcttcccccaccacttctgttcctgctgtttcatctcctcctatgggcaatcaaagtggtcaaagcgttccatagttccctccacgaaagcattcagaaaccctacaaccaaaagtccatccacagcttcatgacccaccctgaattcgccatagaggaggagttgccacgaacaccactcctggatgaggaagaggaggaaaatcctgacaaggcttctaagtttgggactagggtgctcctgttggatggtgaggtcactccatatgccaatacaaacaacaatgcggtggattgcaaccaagtgcagctcccccagtcggacagctctctacagagcctagagacatcagtttgaattttctttctctgactctcatccctattttacctatttccattttcgtctatcccatctatgaggtgatgatgggacttttcattgtcacgtcagctgctgtgttaacagcagtgtgtgtgaagtgaacctctacctgaccatgaagaggcaagagcacagacttacaaggatttcaacttaagcttgacttggggtttgtagcgggacccagtcaaaccccattcaggtcatggtagaatctactccttggtagtcacttgtcatttttaaagaaatgatgacaatcctcttggcatcaccccaccccacattctccccgatgttcctctcctgaattctggattttgtcctacaagtctgtgccatttataagctaagttgagggttcagagggagacaaatatccccaagtgaaatatgttgcggtagagatggaatgtataaaatccgccagtagtgtga

SEQ ID NO: 109715 - DNA, 613 bp, Homo sapiens
  Payload ID: 1547
  Gene Symbol: ATP2B4
  Gene Name: ATPase, Ca++ transporting, plasma membrane 4
  ENST ID: ENST00000356729
  CDS Start-End: 1-389
ggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagatcgacgtaattaacacattccagacgggagcctcttttaagggagtcctaaggcgacagaacatgggtcaacaccttgatgtaaaacttgttcctagttcatcctatgtagcagttgcaccagtcaaatcttcccccaccacttctgttcctgctgtttcatctcctcctatgggcagtgagtgatagtctattatgatgcatgatttgctaaaatgaccacaagagagcacgtggcatccactttaaccaaccatggttatcttttccttttggtttttccctttgatattttgacttaagggaagaaaaagacaaaaatcctactctaaaaccagactgtgtgcccttgtattttatttttgtaatgtagaaaagctattaaaccttaactgttttaaagacaataa

SEQ ID NO: 109716 - DNA, 8968 bp, Homo sapiens
  Payload ID: 1547
  Gene Symbol: ATP2B4
  Gene Name: ATPase, Ca++ transporting, plasma membrane 4
  Uniprot ID: P23634
  ENST ID: ENST00000357681
  CDS Start-End: 1124-4741
caccctcacccctcctccacccctactcagctttctattcaacaagtgagagcaagggcggggaagaaagccgacaggggagaggattgcttccctttcttttcccattcccccttaagacgaaccaggaagtaaccgcaagaatcgggccaccttaacagtagagtaatggtttggcctcgcgccaagtcccacctctgttccagctcctgctcctcccctctctcttcccgcactgcttggggagagctggtgagcaagagtctggcccgagttagctagagctgttgccatgacaagcattttcttaagaaagctctgctgttgagatcgtccaaagctgggggctgggagggggggcacgaacttcgtggggcaccatccctccgaagagagcaagatcagagacacccgcccagctctcctgcaccctttttctttcaggaacctgagaggtccttcccattggaggggcagggggaggagacccagcccactccccggccttagccagaaaggcaagagagcaaagccagcgtctctagcttggttgccacactggggagactggtgggtggtcaccccaccctaccctcatccatggaaacccggagggagagtcccgcctgaagaaacctggatctttgctagaaagagagagatccagttgtcatcggtatccaggaagctctcctcttcctcctcctgacgtctactactacagttgctggttgttgctaaggttgctgccatggtaacatgcacatcctgtttacaccttcatctgggcaagttggtctaagctaggaacctacctaccctggacaactactatcatcaccacctggggacaccaatcatcgtgacacggagtccaccttccactcagttcccccatcctcttcctcctctcgctgccagacttcatacggaagaaaggatctagacttcggacggctactcgggagcttattgcacaagatatattcaatctattccctcactgggcccccagagaagcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcaagggatgcactgacccagattaatgtccactatggaggtgtacagaatctctgcagtagactgaaaacctcccctgtggaaggtctgtctgggaaccctgcagatctggagaaacgtaggcaggtgtttggacacaacgtgatcccccccaaaaagcccaagactttcttagaattagtgtgggaagctcttcaagatgtcacgcttatcatcctggagattgcagccatcatctccctggtcctgtccttttatcgccctgctggtgaagaaaatgaactgtgtggtcaagtcgcaactaccccagaagatgaaaatgaggcacaagctggctggattgagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgatctgctgcctgcagatggaatcctgatccaagggaatgatctgaagattgatgagagctctctgacaggggaatctgaccatgtcaagaagtccctggacaaagaccccatgttgctctcagggacccatgtcatggaaggttctggccggatggtggtgacagctgttggtgtcaactctcagactggaatcatccttactctcttgggggtcaatgaggatgacgaaggggagaaaaagaagaaaggtaaaaaacaaggagtccctgaaaatcgcaacaaagcaaagacccaagacggagtggccctggaaatccagccactcaacagccaggagggaatcgacaatgaggaaaaggacaagaaggcagtcaaggtgcctaaaaaggagaagtcagtgctgcagggcaagctgactcgcctggctgttcagattgggaaagccggtctgctcatgtctgctctcacggttttcatcctgattctatactttgtgattgacaactttgtgataaatcgcagaccatggctccctgagtgtactcccatctacatccagtactttgtcaagttcttcatcatcggcatcactgtactggtggtggctgtgccagaggggctgcctctggctgtcaccatctcactggcctactctgtgaagaaaatgatgaaagacaataacctagtacggcacttggatgcttgtgagaccatgggcaacgccaccgccatctgctctgataagacaggcacgttgaccatgaaccgcatgactgtggtacaagcttatattgggggcatccattaccgtcaaatcccaagccctgatgtcttcctgcccaaagtcctggacctcattgtcaatggcatttctatcaacagtgcttatacctccaagattctgcctccagagaaggagggaggcctgcctcggcaggtgggcaacaagaccgagtgtgctctgctaggctttgtcacagatctgaagcaggattatcaggctgtgcgtaatgaagtgcccgaggagaagctctacaaggtgtacacctttaactcagtgcgcaagtcaatgagcaccgtcatcaggaatcccaacggtggcttccgtatgtacagcaagggcgcctctgagatcatcttgcgcaagtgtaatcgaatcctggaccggaaaggggaagcagtgccattcaagaataaagacagagatgatatggtacgcactgtcatcgagcccatggcctgtgatggactccggactatctgcatagcttaccgggacttcgatgacacagagccctcttgggacaatgagaatgagatcctcaccgaactgacctgtatcgcggtggtgggcattgaggaccctgtgcgcccagaggtgccagatgctattgccaaatgcaaacaagctggcattactgtcagaatggtgacaggtgacaacatcaacacagcccgggccattgccaccaaatgtggcattctgacacctggggatgacttcctgtgcttagaaggcaaagaattcaaccggctcatccgcaacgagaaaggcgaggtagagcaagaaaagctggacaagatctggcctaagcttcgggtcctggcgcgatcttctcccactgacaagcacaccctggtgaaaggcataattgacagcactgttggggaacaccggcaggtcgtggctgtcactggtgatggcacaaatgacgggcctgctctgaagaaagcggatgttggttttgccatgggcatcgcaggcacagatgtagcaaaggaggcttcagacatcatcctaacagatgacaacttcaccagcattgtgaaggcagtgatgtggggacgaaatgtctatgacagcatctccaagttcctgcagttccagctcactgtcaatgtggtggccgtgattgtagccttcactggagcctgtatcactcaggattccccattgaaagctgtgcagatgttgtgggttaatctgatcatggacacttttgcttcattggccctggccacagagccccctacggaatctctgttgaagcggcgcccctatggccgaaataagcctctgatctcacgcactatgatgaagaacatcttgggccatgcattctatcagctcattgtcatctttatccttgtctttgcgggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccagattttcatcgtggaatttgggggtaaacccttcagttgtacaagcctcagcctgtctcagtggctgtggtgtctcttcattgggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagatcaaagtggtcaaagcgttccatagttccctccacgaaagcattcagaaaccctacaaccaaaagtccatccacagcttcatgacccaccctgaattcgccatagaggaggagttgccacgaacaccactcctggatgaggaagaggaggaaaatcctgacaaggcttctaagtttgggactagggtgctcctgttggatggtgaggtcactccatatgccaatacaaacaacaatgcggtggattgcaaccaagtgcagctcccccagtcggacagctctctacagagcctagagacatcagtttgaattttctttctctgactctcatccctattttacctatttccattttcgtctatcccatctatgaggtgatgatgggacttttcattgtcacgtcagctgctgtgttaacagcagtgtgtgtgaagtgaacctctacctgaccatgaagaggcaagagcacagacttacaaggatttcaacttaagcttgacttggggtttgtagcgggacccagtcaaaccccattcaggtcatggtagaatctactccttggtagtcacttgtcatttttaaagaaatgatgacaatcctcttggcatcaccccaccccacattctccccgatgttcctctcctgaattctggattttgtcctacaagtctgtgccatttataagctaagttgagggttcagagggagacaaatatccccaagtgaaatatgttgcggtagagatggaatgtataaaatccgccagtagtgtgattgtttttcaatttttcccactttgaaaacttacacctaaaggcctgtaggcctctaactctttctgccctttcattcaaacctctccaaagttctttgtcttttgtcttcccttcctttccttttttttttttttttttatgatgattaagaaaatggaaaggatatggatgaattgtgtaaacttagatccttctcccttttggcccaaaagaacccttgatttagttccagaatccaaccagtttctttgttaaaagggtccttttgaagcaattaagtgctggtaagaatatttctctgttgttgccaggttaccttctgcttttaaattgccatcttgtaaagtgtatgtggttcttaagtgccagggagatcagccttgcccatgaaggttgcatatgtgtggtatacagtttttacctgaaagcctgagctttctcttattcctaaagtggtggcaaaagaatgaactgggtatgaccctgcccccttactgggcttggatattgaggaccagacgctgccaaatctaggacaagacagaccatcaaagcagacttttgtgggctcctctttggggtgaccactgctttcaaagccatctgccaaggctctccagggcaggacctgactggtggggaatgagtgttcagaagccttgggagaggccaaagagccattctagcatgatctgagaaaaccttcctgcagaggccagaaaccttgagcttaggtgcctggggaccagcttcgacattctctccagtttctgattctaatttttgccacgtgtcacaacttttccagtctctgagaaggtcccagcctttctcaaatattctgattttgaaaatatgtatccaaagtgggaggcccctgtgacattttgccaacttaaacgagaaaaagaccccccgcacccggcacactcccccttcctccagccccgcttcagccacatgctccagctgctgcccagtaaagccctgtgcctttttttcccctgaatactgcccaaagcatccccttcccatctgcctctcaggagttggggactttgctaggagattttttaagtgttccttactgggacaacgtggagccacgtttgcaggagctccatttgtatccctgctggtgttgacttctgtgtaggggccagttcatgtccctgactctcacctcccattagataaatgaagcccacccccctttctagagtgatgagagtcaagaagaggggatgtatgaacggccaaattcccatgtgagaggaagatgacctgatccacctagccttttcttctggatctgtcctccctcacccctttcacctgagctgtccacagtaggaaacataaagaaacaatgtcccctacatatccccatgactacataatccatcatcgtaggaaataggaaagcaaatttgattttggttttgtaaaacgtacatgcttcaataattcttttttgtgtcttaaatactcataggggaaaaaaacagctcacccaaggtgttaggtttcacatatatattcatcaactattttagaagatttaattctatcaaatcttgtattacctcagatcattttaaatagcaagccaataacgagctttgaaggctattttaccattcctgttcacaaaaggttctcatggtgcctgacaggttacccttgagggcttgtgtctactttttaaaagtcaatggttttttttcttgtgttctagtttccataataggagagaaaatatagaaatatatgcaaaaattatagttttctttagatcagaaactgatatttttgggtcagccatatgtattttgtttaaaggatttaaaataaagtgccgtcatgtagccctgtggaagggagcacataaccagctgtttggcatgacaggtgacttagtatatttgtaattggttttaaaaccaatacaccatactttctttctgcaaacagccatctttatacttagggaagaaaaattgttgggttctagacttttttaatataaattttgttgatatggaattaggtaagtttaagtgtctatgtgcatatgttttttatataagttttttctattcagtttcactgatccaactggcagtgggtaaatatggcataagttaataacacttttccccaaaatggtgctttggatttgaaaagggtctgatggggagaaggagaacgtatcatcctagcttcctctcttaataaacctagaaaaacgggtagtaaactgtggatagtcaggaaaacacccagcaagggacacagctgtcaggaaatgaatcttccccccaacccccaccatgcagatggatagacagaatctttcctgactagtcattaggatcaggggcctctgttggatttgtgtttcttgaagaatagctggcagagtggtataaaagacacgaatatctcctggtctataaggatactctgatttggggtttgcatttttcatggtttttatttcctgttccccctggagttttccattagtgagtttttgtgcaaggatcttatttgtgatgccttccctcccctagaaagattttgtgcaatatattaaatggggacagaattctaaatggataaaacaatggctggttctagccctgagtgacagtcttaaggctagatccttcccatagtatcatctgtcctctggaatgactctcctgtccctaaaggggttaagagagagatcacctagaaatccctctggacacttgtgggttctttagggtttgagtttcttcttccccttgagcttcagagaggagagttggcatggttaaatctgaatggttacctcactgctgaaaacccagaggggcgtggcacactcgcttgtgtggaaaagcctctaaatgcatcccttcctttctttcctgcttcctttgccttacaattgaagcagcccgtggtaccatcacagtatgcagagacttcctcacctttcatatctagggaccacccccgatgcattggtgagggtgggcacttataaatgcctgctattgttaagccattccagcctcttcctctgaatagaccagacgccctttcacttagttcagtgccagtccttttgccttcccaaccctgctgttaggcctgctgttccctttgctcttgattaggagagatggaaggagatgagctcccataactgaattggcctttggttcatgttttctccccatatgtatatatgccatatgtgaatatgccatatatatgtgccaacaaatctatctacgttgttcttttcaaattagcacgcagataggaattttgagtttcttcttcttttagtaactagtataacaagcactggtatttttgtacaaaaaagaaaaacaaaagattgactattgtggtctgcatgacataaacaaacaaatggtgatatcaaagcaacgtataccccagtccagtgtgtgttgccataatttgcaattcagcttaacagtgcacccaatctatatttgcattttgatattatttaagctctatgtacaaggttttgcatgtatttatatggttcttagggaaaaaaaatgctataaactgcaaatctgaaattcaaatgtgttgttccactgagaccagaagaagaagaggagttttaaaagggataatttgttggagccaataaagctttttgctgatgaacagaaaccaatactgctgtgcactgagaataaaaactcatgcccacttgtaa

SEQ ID NO: 109717 - DNA, 8918 bp, Homo sapiens
  Payload ID: 1547
  Gene Symbol: ATP2B4
  Gene Name: ATPase, Ca++ transporting, plasma membrane 4
  Uniprot ID: P23634
  ENST ID: ENST00000367218
  CDS Start-End: 898-4410
cttcccgcactgcttggggagagctggtgagcaagagtctggcccgagttagctagagctgttgccatgacaagcattttcttaagaaagctctgctgttgagatcgtccaaagctgggggctgggagggggggcacgaacttcgtggggcaccatccctccgaagagagcaagatcagagacacccgcccagctctcctgcaccctttttctttcaggaacctgagaggtccttcccattggaggggcagggggaggagacccagcccactccccggccttagccagaaaggcaagagagcaaagccagcgtctctagcttggttgccacactggggagactggtgggtggtcaccccaccctaccctcatccatggaaacccggagggagagtcccgcctgaagaaacctggatctttgctagaaagagagagatccagttgtcatcggtatccaggaagctctcctcttcctcctcctgacgtctactactacagttgctggttgttgctaaggttgctgccatggtaacatgcacatcctgtttacaccttcatctgggcaagttggtctaagctaggaacctacctaccctggacaactactatcatcaccacctggggacaccaatcatcgtgacacggagtccaccttccactcagttcccccatcctcttcctcctctcgctgccagacttcatacggaagaaaggatctagacttcggacggctactcgggagcttattgcacaagatatattcaatctattccctcactgggcccccagagaagcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcaagggatgcactgacccagattaatgtccactatggaggtgtacagaatctctgcagtagactgaaaacctcccctgtggaaggtctgtctgggaaccctgcagatctggagaaacgtaggcaggtgtttggacacaacgtgatcccccccaaaaagcccaagactttcttagaattagtgtgggaagctcttcaagatgtcacgcttatcatcctggagattgcagccatcatctccctggtcctgtccttttatcgccctgctggtgaagaaaatgaactgtgtggtcaagtcgcaactaccccagaagatgaaaatgaggcacaagctggctggattgagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgatctgctgcctgcagatggaatcctgatccaagggaatgatctgaagattgatgagagctctctgacaggggaatctgaccatgtcaagaagtccctggacaaagaccccatgttgctctcagggacccatgtcatggaaggttctggccggatggtggtgacagctgttggtgtcaactctcagactggaatcatccttactctcttgggggtcaatgaggatgacgaaggggagaaaaagaagaaaggtaaaaaacaaggagtccctgaaaatcgcaacaaagcaaagacccaagacggagtggccctggaaatccagccactcaacagccaggagggaatcgacaatgaggaaaaggacaagaaggcagtcaaggtgcctaaaaaggagaagtcagtgctgcagggcaagctgactcgcctggctgttcagattgggaaagccggtctgctcatgtctgctctcacggttttcatcctgattctatactttgtgattgacaactttgtgataaatcgcagaccatggctccctgagtgtactcccatctacatccagtactttgtcaagttcttcatcatcggcatcactgtactggtggtggctgtgccagaggggctgcctctggctgtcaccatctcactggcctactctgtgaagaaaatgatgaaagacaataacctagtacggcacttggatgcttgtgagaccatgggcaacgccaccgccatctgctctgataagacaggcacgttgaccatgaaccgcatgactgtggtacaagcttatattgggggcatccattaccgtcaaatcccaagccctgatgtcttcctgcccaaagtcctggacctcattgtcaatggcatttctatcaacagtgcttatacctccaagattctgcctccagagaaggagggaggcctgcctcggcaggtgggcaacaagaccgagtgtgctctgctaggctttgtcacagatctgaagcaggattatcaggctgtgcgtaatgaagtgcccgaggagaagctctacaaggtgtacacctttaactcagtgcgcaagtcaatgagcaccgtcatcaggaatcccaacggtggcttccgtatgtacagcaagggcgcctctgagatcatcttgcgcaagtgtaatcgaatcctggaccggaaaggggaagcagtgccattcaagaataaagacagagatgatatggtacgcactgtcatcgagcccatggcctgtgatggactccggactatctgcatagcttaccgggacttcgatgacacagagccctcttgggacaatgagaatgagatcctcaccgaactgacctgtatcgcggtggtgggcattgaggaccctgtgcgcccagaggtgccagatgctattgccaaatgcaaacaagctggcattactgtcagaatggtgacaggtgacaacatcaacacagcccgggccattgccaccaaatgtggcattctgacacctggggatgacttcctgtgcttagaaggcaaagaattcaaccggctcatccgcaacgagaaaggcgaggtagagcaagaaaagctggacaagatctggcctaagcttcgggtcctggcgcgatcttctcccactgacaagcacaccctggtgaaaggcataattgacagcactgttggggaacaccggcaggtcgtggctgtcactggtgatggcacaaatgacgggcctgctctgaagaaagcggatgttggttttgccatgggcatcgcaggcacagatgtagcaaaggaggcttcagacatcatcctaacagatgacaacttcaccagcattgtgaaggcagtgatgtggggacgaaatgtctatgacagcatctccaagttcctgcagttccagctcactgtcaatgtggtggccgtgattgtagccttcactggagcctgtatcactcaggattccccattgaaagctgtgcagatgttgtgggttaatctgatcatggacacttttgcttcattggccctggccacagagccccctacggaatctctgttgaagcggcgcccctatggccgaaataagcctctgatctcacgcactatgatgaagaacatcttgggccatgcattctatcagctcattgtcatctttatccttgtctttgcgggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccagattttcatcgtggaatttgggggtaaacccttcagttgtacaagcctcagcctgtctcagtggctgtggtgtctcttcattgggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagatcgacgtaattaacacattccagacgggagcctcttttaagggagtcctaaggcgacagaacatgggtcaacaccttgatgtaaaacttgttcctagttcatcctatgtagcagttgcaccagtcaaatcttcccccaccacttctgttcctgctgtttcatctcctcctatgggcaatcaaagtggtcaaagcgttccatagttccctccacgaaagcattcagaaaccctacaaccaaaagtccatccacagcttcatgacccaccctgaattcgccatagaggaggagttgccacgaacaccactcctggatgaggaagaggaggaaaatcctgacaaggcttctaagtttgggactagggtgctcctgttggatggtgaggtcactccatatgccaatacaaacaacaatgcggtggattgcaaccaagtgcagctcccccagtcggacagctctctacagagcctagagacatcagtttgaattttctttctctgactctcatccctattttacctatttccattttcgtctatcccatctatgaggtgatgatgggacttttcattgtcacgtcagctgctgtgttaacagcagtgtgtgtgaagtgaacctctacctgaccatgaagaggcaagagcacagacttacaaggatttcaacttaagcttgacttggggtttgtagcgggacccagtcaaaccccattcaggtcatggtagaatctactccttggtagtcacttgtcatttttaaagaaatgatgacaatcctcttggcatcaccccaccccacattctccccgatgttcctctcctgaattctggattttgtcctacaagtctgtgccatttataagctaagttgagggttcagagggagacaaatatccccaagtgaaatatgttgcggtagagatggaatgtataaaatccgccagtagtgtgattgtttttcaatttttcccactttgaaaacttacacctaaaggcctgtaggcctctaactctttctgccctttcattcaaacctctccaaagttctttgtcttttgtcttcccttcctttccttttttttttttttttttatgatgattaagaaaatggaaaggatatggatgaattgtgtaaacttagatccttctcccttttggcccaaaagaacccttgatttagttccagaatccaaccagtttctttgttaaaagggtccttttgaagcaattaagtgctggtaagaatatttctctgttgttgccaggttaccttctgcttttaaattgccatcttgtaaagtgtatgtggttcttaagtgccagggagatcagccttgcccatgaaggttgcatatgtgtggtatacagtttttacctgaaagcctgagctttctcttattcctaaagtggtggcaaaagaatgaactgggtatgaccctgcccccttactgggcttggatattgaggaccagacgctgccaaatctaggacaagacagaccatcaaagcagacttttgtgggctcctctttggggtgaccactgctttcaaagccatctgccaaggctctccagggcaggacctgactggtggggaatgagtgttcagaagccttgggagaggccaaagagccattctagcatgatctgagaaaaccttcctgcagaggccagaaaccttgagcttaggtgcctggggaccagcttcgacattctctccagtttctgattctaatttttgccacgtgtcacaacttttccagtctctgagaaggtcccagcctttctcaaatattctgattttgaaaatatgtatccaaagtgggaggcccctgtgacattttgccaacttaaacgagaaaaagaccccccgcacccggcacactcccccttcctccagccccgcttcagccacatgctccagctgctgcccagtaaagccctgtgcctttttttcccctgaatactgcccaaagcatccccttcccatctgcctctcaggagttggggactttgctaggagattttttaagtgttccttactgggacaacgtggagccacgtttgcaggagctccatttgtatccctgctggtgttgacttctgtgtaggggccagttcatgtccctgactctcacctcccattagataaatgaagcccacccccctttctagagtgatgagagtcaagaagaggggatgtatgaacggccaaattcccatgtgagaggaagatgacctgatccacctagccttttcttctggatctgtcctccctcacccctttcacctgagctgtccacagtaggaaacataaagaaacaatgtcccctacatatccccatgactacataatccatcatcgtaggaaataggaaagcaaatttgattttggttttgtaaaacgtacatgcttcaataattcttttttgtgtcttaaatactcataggggaaaaaaacagctcacccaaggtgttaggtttcacatatatattcatcaactattttagaagatttaattctatcaaatcttgtattacctcagatcattttaaatagcaagccaataacgagctttgaaggctattttaccattcctgttcacaaaaggttctcatggtgcctgacaggttacccttgagggcttgtgtctactttttaaaagtcaatggttttttttcttgtgttctagtttccataataggagagaaaatatagaaatatatgcaaaaattatagttttctttagatcagaaactgatatttttgggtcagccatatgtattttgtttaaaggatttaaaataaagtgccgtcatgtagccctgtggaagggagcacataaccagctgtttggcatgacaggtgacttagtatatttgtaattggttttaaaaccaatacaccatactttctttctgcaaacagccatctttatacttagggaagaaaaattgttgggttctagacttttttaatataaattttgttgatatggaattaggtaagtttaagtgtctatgtgcatatgttttttatataagttttttctattcagtttcactgatccaactggcagtgggtaaatatggcataagttaataacacttttccccaaaatggtgctttggatttgaaaagggtctgatggggagaaggagaacgtatcatcctagcttcctctcttaataaacctagaaaaacgggtagtaaactgtggatagtcaggaaaacacccagcaagggacacagctgtcaggaaatgaatcttccccccaacccccaccatgcagatggatagacagaatctttcctgactagtcattaggatcaggggcctctgttggatttgtgtttcttgaagaatagctggcagagtggtataaaagacacgaatatctcctggtctataaggatactctgatttggggtttgcatttttcatggtttttatttcctgttccccctggagttttccattagtgagtttttgtgcaaggatcttatttgtgatgccttccctcccctagaaagattttgtgcaatatattaaatggggacagaattctaaatggataaaacaatggctggttctagccctgagtgacagtcttaaggctagatccttcccatagtatcatctgtcctctggaatgactctcctgtccctaaaggggttaagagagagatcacctagaaatccctctggacacttgtgggttctttagggtttgagtttcttcttccccttgagcttcagagaggagagttggcatggttaaatctgaatggttacctcactgctgaaaacccagaggggcgtggcacactcgcttgtgtggaaaagcctctaaatgcatcccttcctttctttcctgcttcctttgccttacaattgaagcagcccgtggtaccatcacagtatgcagagacttcctcacctttcatatctagggaccacccccgatgcattggtgagggtgggcacttataaatgcctgctattgttaagccattccagcctcttcctctgaatagaccagacgccctttcacttagttcagtgccagtccttttgccttcccaaccctgctgttaggcctgctgttccctttgctcttgattaggagagatggaaggagatgagctcccataactgaattggcctttggttcatgttttctccccatatgtatatatgccatatgtgaatatgccatatatatgtgccaacaaatctatctacgttgttcttttcaaattagcacgcagataggaattttgagtttcttcttcttttagtaactagtataacaagcactggtatttttgtacaaaaaagaaaaacaaaagattgactattgtggtctgcatgacataaacaaacaaatggtgatatcaaagcaacgtataccccagtccagtgtgtgttgccataatttgcaattcagcttaacagtgcacccaatctatatttgcattttgatattatttaagctctatgtacaaggttttgcatgtatttatatggttcttagggaaaaaaaatgctataaactgcaaatctgaaattcaaatgtgttgttccactgagaccagaagaagaagaggagttttaaaagggataatttgttggagccaataaagctttttgctgatgaacagaaaccaatactgctgtgcactgagaataaaaactcatgcccacttgt

SEQ ID NO: 109718 - DNA, 429 bp, Homo sapiens
  Payload ID: 1547
  Gene Symbol: ATP2B4
  Gene Name: ATPase, Ca++ transporting, plasma membrane 4
  ENST ID: ENST00000458092
  CDS Start-End: 1-353
ttgggggtaaacccttcagttgtacaagcctcagcctgtctcagtggctgtggtgtctcttcattgggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagcatcttttgcaggattcagacttgcttcctgacaaggaggaagcaataatttcttcaagcctcttcccttcttgcaatttctgaaatgggatagaagccacccctgctgctcttatgtcccctgtctatagccccacaataacttttattttttccactt

SEQ ID NO: 109719 - DNA, 4697 bp, Homo sapiens
  Payload ID: 1547
  Gene Symbol: ATP2B4
  Gene Name: ATPase, Ca++ transporting, plasma membrane 4
  ENST ID: ENST00000484746
  CDS Start-End: 1-308
tcaccaaggatgccgagggactggatgagattgaccatgctgagatggagctgcgccgaggccagatcctctggttccggggcctgaaccgtatccagactcagatcgacgtaattaacacattccagacgggagcctcttttaagggagtcctaaggcgacagaacatgggtcaacaccttgatgtaaaacttgttcctagttcatcctatgtagcagttgcaccagtcaaatcttcccccaccacttctgttcctgctgtttcatctcctcctatgggcaatcaaagtggtcaaagcgttccatagttccctccacgaaagcattcagaaaccctacaaccaaaagtccatccacagcttcatgacccaccctgaattcgccaatacaaacaacaatgcggtggattgcaaccaagtgcagctcccccagtcggacagctctctacagagcctagagacatcagtttgaattttctttctctgactctcatccctattttacctatttccattttcgtctatcccatctatgaggtgatgatgggacttttcattgtcacgtcagctgctgtgttaacagcagtgtgtgtgaagtgaacctctacctgaccatgaagaggcaagagcacagacttacaaggatttcaacttaagcttgacttggggtttgtagcgggacccagtcaaaccccattcaggtcatggtagaatctactccttggtagtcacttgtcatttttaaagaaatgatgacaatcctcttggcatcaccccaccccacattctccccgatgttcctctcctgaattctggattttgtcctacaagtctgtgccatttataagctaagttgagggttcagagggagacaaatatccccaagtgaaatatgttgcggtagagatggaatgtataaaatccgccagtagtgtgattgtttttcaatttttcccactttgaaaacttacacctaaaggcctgtaggcctctaactctttctgccctttcattcaaacctctccaaagttctttgtcttttgtcttcccttcctttccttttttttttttttttttatgatgattaagaaaatggaaaggatatggatgaattgtgtaaacttagatccttctcccttttggcccaaaagaacccttgatttagttccagaatccaaccagtttctttgttaaaagggtccttttgaagcaattaagtgctggtaagaatatttctctgttgttgccaggttaccttctgcttttaaattgccatcttgtaaagtgtatgtggttcttaagtgccagggagatcagccttgcccatgaaggttgcatatgtgtggtatacagtttttacctgaaagcctgagctttctcttattcctaaagtggtggcaaaagaatgaactgggtatgaccctgcccccttactgggcttggatattgaggaccagacgctgccaaatctaggacaagacagaccatcaaagcagacttttgtgggctcctctttggggtgaccactgctttcaaagccatctgccaaggctctccagggcaggacctgactggtggggaatgagtgttcagaagccttgggagaggccaaagagccattctagcatgatctgagaaaaccttcctgcagaggccagaaaccttgagcttaggtgcctggggaccagcttcgacattctctccagtttctgattctaatttttgccacgtgtcacaacttttccagtctctgagaaggtcccagcctttctcaaatattctgattttgaaaatatgtatccaaagtgggaggcccctgtgacattttgccaacttaaacgagaaaaagaccccccgcacccggcacactcccccttcctccagccccgcttcagccacatgctccagctgctgcccagtaaagccctgtgcctttttttcccctgaatactgcccaaagcatccccttcccatctgcctctcaggagttggggactttgctaggagattttttaagtgttccttactgggacaacgtggagccacgtttgcaggagctccatttgtatccctgctggtgttgacttctgtgtaggggccagttcatgtccctgactctcacctcccattagataaatgaagcccacccccctttctagagtgatgagagtcaagaagaggggatgtatgaacggccaaattcccatgtgagaggaagatgacctgatccacctagccttttcttctggatctgtcctccctcacccctttcacctgagctgtccacagtaggaaacataaagaaacaatgtcccctacatatccccatgactacataatccatcatcgtaggaaataggaaagcaaatttgattttggttttgtaaaacgtacatgcttcaataattcttttttgtgtcttaaatactcataggggaaaaaaacagctcacccaaggtgttaggtttcacatatatattcatcaactattttagaagatttaattctatcaaatcttgtattacctcagatcattttaaatagcaagccaataacgagctttgaaggctattttaccattcctgttcacaaaaggttctcatggtgcctgacaggttacccttgagggcttgtgtctactttttaaaagtcaatggttttttttcttgtgttctagtttccataataggagagaaaatatagaaatatatgcaaaaattatagttttctttagatcagaaactgatatttttgggtcagccatatgtattttgtttaaaggatttaaaataaagtgccgtcatgtagccctgtggaagggagcacataaccagctgtttggcatgacaggtgacttagtatatttgtaattggttttaaaaccaatacaccatactttctttctgcaaacagccatctttatacttagggaagaaaaattgttgggttctagacttttttaatataaattttgttgatatggaattaggtaagtttaagtgtctatgtgcatatgttttttatataagttttttctattcagtttcactgatccaactggcagtgggtaaatatggcataagttaataacacttttccccaaaatggtgctttggatttgaaaagggtctgatggggagaaggagaacgtatcatcctagcttcctctcttaataaacctagaaaaacgggtagtaaactgtggatagtcaggaaaacacccagcaagggacacagctgtcaggaaatgaatcttccccccaacccccaccatgcagatggatagacagaatctttcctgactagtcattaggatcaggggcctctgttggatttgtgtttcttgaagaatagctggcagagtggtataaaagacacgaatatctcctggtctataaggatactctgatttggggtttgcatttttcatggtttttatttcctgttccccctggagttttccattagtgagtttttgtgcaaggatcttatttgtgatgccttccctcccctagaaagattttgtgcaatatattaaatggggacagaattctaaatggataaaacaatggctggttctagccctgagtgacagtcttaaggctagatccttcccatagtatcatctgtcctctggaatgactctcctgtccctaaaggggttaagagagagatcacctagaaatccctctggacacttgtgggttctttagggtttgagtttcttcttccccttgagcttcagagaggagagttggcatggttaaatctgaatggttacctcactgctgaaaacccagaggggcgtggcacactcgcttgtgtggaaaagcctctaaatgcatcccttcctttctttcctgcttcctttgccttacaattgaagcagcccgtggtaccatcacagtatgcagagacttcctcacctttcatatctagggaccacccccgatgcattggtgagggtgggcacttataaatgcctgctattgttaagccattccagcctcttcctctgaatagaccagacgccctttcacttagttcagtgccagtccttttgccttcccaaccctgctgttaggcctgctgttccctttgctcttgattaggagagatggaaggagatgagctcccataactgaattggcctttggttcatgttttctccccatatgtatatatgccatatgtgaatatgccatatatatgtgccaacaaatctatctacgttgttcttttcaaattagcacgcagataggaattttgagtttcttcttcttttagtaactagtataacaagcactggtatttttgtacaaaaaagaaaaacaaaagattgactattgtggtctgcatgacataaacaaacaaatggtgatatcaaagcaacgtataccccagtccagtgtgtgttgccataatttgcaattcagcttaacagtgcacccaatctatatttgcattttgatattatttaagctctatgtacaaggttttgcatgtatttatatggttcttagggaaaaaaaatgctataaactgcaaatctgaaattcaaatgtgttgttccactgagaccagaagaagaagaggagttttaaaagggataatttgttggagccaataaagctttttgctgatgaacagaaaccaatactgctgtgcactgagaataaaaactcatgcccacttgta

SEQ ID NO: 109720 - DNA, 3484 bp, Homo sapiens
  Payload ID: 1548
  Gene Symbol: ATP2C1
  Gene Name: ATPase, Ca++ transporting, type 2C, member 1
  Uniprot ID: P98194
  ENST ID: ENST00000328560
  CDS Start-End: 323-2989
gctggcgtgagctggggacgttgcgggcacacgacggggcgggtgcgggatcttggggaggggggctcccgagatagtggctgggcggggaactccttcctcagcctctcgtcagcgccgcttctcctggtttctcttgcagatgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactgggtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatatta

SEQ ID NO: 109721 - DNA, 3401 bp, Homo sapiens
  Payload ID: 1548
  Gene Symbol: ATP2C1
  Gene Name: ATPase, Ca++ transporting, type 2C, member 1
  Uniprot ID: P98194
  ENST ID: ENST00000359644
  CDS Start-End: 130-2979
gggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaat

SEQ ID NO: 109722 - DNA, 4795 bp, Homo sapiens
  Payload ID: 1548
  Gene Symbol: ATP2C1
  Gene Name: ATPase, Ca++ transporting, type 2C, member 1
  Uniprot ID: P98194
  ENST ID: ENST00000428331
  CDS Start-End: 236-2995
gggaactccttcctcagcctctcgtcagcgccgcttctcctggtttctcttgcagatgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaacatgtcttcctttttgaggtaaagatatatactttgtcaaatatcattttgtcatcctctaaatataaatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttctttttgtttcattgggcatgctagggaaataggtggattttgtgtgtaatgccatcagtttttatgaaagcttgatgaggtataggtcatttgttttgagtatgtgggccagaaatttaaaattagaaatttgtttttctgttgagtatataaacaaaaattggtcccaattctaacaggtttaatccttcttgaagccaataagttttatcttttataatctgtcaggatgaaccactccttagcttttatccaatattaaactgcaagtgttagcactgaaatattgtcattgatagggaaaatatctattctttgagtcattgttactgaggcagttgagtgtaaggagctggctgcagtttattctacttaaccctttaaggctgaattgtcaaatgtacattgttccatgtcgttagatggaacatggaagccattgtctaatcaactctatcattagtgacttgatgtctcataccttaattttgtaatgatttttattctctgttacaaagacttgaaatacgtattaaatgcacgttaatgttttgctttgcattttaggttcagattatgacttgattgaaataaatgtgcctatacattcatttgctttgtactataaaaataaaaatgatttcttaagttaa

SEQ ID NO: 109723 - DNA, 3386 bp, Homo sapiens
  Payload ID: 1548
  Gene Symbol: ATP2C1
  Gene Name: ATPase, Ca++ transporting, type 2C, member 1
  Uniprot ID: P98194
  ENST ID: ENST00000422190
  CDS Start-End: 130-2949
gggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatatta

SEQ ID NO: 109724 - DNA, 540 bp, Homo sapiens
  Payload ID: 1548
  Gene Symbol: ATP2C1
  Gene Name: ATPase, Ca++ transporting, type 2C, member 1
  ENST ID: ENST00000508297
  CDS Start-End: 295-540
gactgactaagaggagtagttaaaatggagaaagcttagctgtactttgtcttgcatgttaaacgtaatgagtttagaggattatgattatttgtaatcatcaggatctgctagacaggacatctgttttactttttactcttatgttggtggagaaatagcgtgcttttcattcaatgtgaaaattttgtgttctagctgggcaccgatggcttagtttttgaaatgtaatttcttgagaagtagcatgtggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcat

SEQ ID NO: 109725 - DNA, 3579 bp, Homo sapiens
  Payload ID: 1548
  Gene Symbol: ATP2C1
  Gene Name: ATPase, Ca++ transporting, type 2C, member 1
  Uniprot ID: P98194
  ENST ID: ENST00000507488
  CDS Start-End: 221-3142
tttctggacgcttctagacagtgttcatacttggctgtctggtttcaccaggaactctacccaaaagaggaaacagcaaggagaacatttgctttgtttgtaggagggaagttgtcgagctacaaacaaatctttaggcatctgaggaattgctaagtttctaatttcatatggttgctgacaaggaggtgcagacaaggaccctcttgctttcctcactatggatagtctgttgcctccatctagattctcttatttcaaaaaatatcctctccatgcaattaggagatatttatcgacgctgagaaaccaaagagccgaagaacaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatatta

SEQ ID NO: 109726 - DNA, 786 bp, Homo sapiens
  Payload ID: 1548
  Gene Symbol: ATP2C1
  Gene Name: ATPase, Ca++ transporting, type 2C, member 1
  ENST ID: ENST00000504571
  CDS Start-End: 1-648
gtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagtgtatcttgtattttaacaggttgcagtattttacagagctagcccaaggcacaagatgaaaattattaagtcgctacagaagaacggttcagttgtagccatgacaggagatggagtaaatgatgcagttgctctgaaggctgcagacattgga

SEQ ID NO: 109727 - DNA, 3439 bp, Homo sapiens
  Payload ID: 1548
  Gene Symbol: ATP2C1
  Gene Name: ATPase, Ca++ transporting, type 2C, member 1
  Uniprot ID: P98194
  ENST ID: ENST00000513801
  CDS Start-End: 203-2974
cttcctccctcccgctcgcttcttctcacgccgggagcaggctcccgcctcgcaccgctgccccgcgagcagctcctcttctcccgaggcgcgcggggcgcccccgcgagccccgcggctgagaccccgcagcctggaggagggctgtccggggctttgggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatattattctctttactgttctctttcaccgaaa

SEQ ID NO: 109728 - DNA, 561 bp, Homo sapiens
  Payload ID: 1548
  Gene Symbol: ATP2C1
  Gene Name: ATPase, Ca++ transporting, type 2C, member 1
  ENST ID: ENST00000515854
  CDS Start-End: 169-561
gataccaaaagggaaaaattggaaaagcaagtgagagagcagctgatggtaatgaagtcctgcagtggttggtaggagggagaacagatttttcctcaaaaggaagcatagagagaacggaccttttcaaataataaacaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgtt

SEQ ID NO: 109729 - DNA, 4714 bp, Homo sapiens
  Payload ID: 1548
  Gene Symbol: ATP2C1
  Gene Name: ATPase, Ca++ transporting, type 2C, member 1
  Uniprot ID: P98194
  ENST ID: ENST00000504948
  CDS Start-End: 203-2914
cttcctccctcccgctcgcttcttctcacgccgggagcaggctcccgcctcgcaccgctgccccgcgagcagctcctcttctcccgaggcgcgcggggcgcccccgcgagccccgcggctgagaccccgcagcctggaggagggctgtccggggctttgggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaacatgtcttcctttttgaggtaaagatatatactttgtcaaatatcattttgtcatcctctaaatataaatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttctttttgtttcattgggcatgctagggaaataggtggattttgtgtgtaatgccatcagtttttatgaaagcttgatgaggtataggtcatttgttttgagtatgtgggccagaaatttaaaattagaaatttgtttttctgttgagtatataaacaaaaattggtcccaattctaacaggtttaatccttcttgaagccaataagttttatcttttataatctgtcaggatgaaccactccttagcttttatccaatattaaactgcaagtgttagcactgaaatattgtcattgatagggaaaatatctattctttgagtcattgttactgaggcagttgagtgtaaggagctggctgcagtttattctacttaaccctttaaggctgaattgtcaaatgtacattgttccatgtcgttagatggaacatggaagccattgtctaatcaactctatcattagtgacttgatgtctcataccttaattttgtaatgatttttattctctgttacaaagacttgaaatacgtattaaatgcacgttaatgttttgctttgcattttaggttcagattatgacttgattgaaataaatgtgcctatacattcatttgctttgtactataaaaataaaaatgatttcttaagttaa

SEQ ID NO: 109730 - DNA, 4888 bp, Homo sapiens
  Payload ID: 1548
  Gene Symbol: ATP2C1
  Gene Name: ATPase, Ca++ transporting, type 2C, member 1
  ENST ID: ENST00000505330
  CDS Start-End: 227-3088
attgcatttctggacgcttctagacagtgttcatacttggctgtctggtttcaccaggaactctacccaaaagaggaaacagcaaggagaacatttgctttgtttgtaggagggaagttgtcgagctacaaacaaatctttaggcatctgaggaattgctaagtttctaatttcatatggttgctgacaaggaggtgcagacaaggaccctcttgctttcctcactatggatagtctgttgcctccatctagattctcttatttcaaaaaatatcctctccatgcaattaggagatatttatcgacgctgagaaaccaaagagccgaagaacaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaacatgtcttcctttttgaggtaaagatatatactttgtcaaatatcattttgtcatcctctaaatataaatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttctttttgtttcattgggcatgctagggaaataggtggattttgtgtgtaatgccatcagtttttatgaaagcttgatgaggtataggtcatttgttttgagtatgtgggccagaaatttaaaattagaaatttgtttttctgttgagtatataaacaaaaattggtcccaattctaacaggtttaatccttcttgaagccaataagttttatcttttataatctgtcaggatgaaccactccttagcttttatccaatattaaactgcaagtgttagcactgaaatattgtcattgatagggaaaatatctattctttgagtcattgttactgaggcagttgagtgtaaggagctggctgcagtttattctacttaaccctttaaggctgaattgtcaaatgtacattgttccatgtcgttagatggaacatggaagccattgtctaatcaactctatcattagtgacttgatgtctcataccttaattttgtaatgatttttattctctgttacaaagacttgaaatacgtattaaatgcacgttaatgttttgctttgcattttaggttcagattatgacttgattgaaataaatgtgcctatacattcatttgctttgtactataaaaataaaaatgatttcttaagttaa

SEQ ID NO: 109731 - DNA, 4969 bp, Homo sapiens
  Payload ID: 1548
  Gene Symbol: ATP2C1
  Gene Name: ATPase, Ca++ transporting, type 2C, member 1
  Uniprot ID: P98194
  ENST ID: ENST00000508532
  CDS Start-End: 410-3169
caaagctgggttcgcggctggcccaggagtgcggggcgcgactgggcggccggcggcggggaggggcggagcgcaggagtcggaggcgggagcagaccagcacggcctcgcggagccggcccggcggaccgtgacgggtcccctcacctcctcttctctcccctccccgcccgccctctctccctcccttcctccctcccgctcgcttcttctcacgccgggagcaggctcccgcctcgcaccgctgccccgcgagcagctcctcttctcccgaggcgcgcggggcgcccccgcgagccccgcggctgagaccccgcagcctggaggagggctgtccggggctttggtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaacatgtcttcctttttgaggtaaagatatatactttgtcaaatatcattttgtcatcctctaaatataaatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttctttttgtttcattgggcatgctagggaaataggtggattttgtgtgtaatgccatcagtttttatgaaagcttgatgaggtataggtcatttgttttgagtatgtgggccagaaatttaaaattagaaatttgtttttctgttgagtatataaacaaaaattggtcccaattctaacaggtttaatccttcttgaagccaataagttttatcttttataatctgtcaggatgaaccactccttagcttttatccaatattaaactgcaagtgttagcactgaaatattgtcattgatagggaaaatatctattctttgagtcattgttactgaggcagttgagtgtaaggagctggctgcagtttattctacttaaccctttaaggctgaattgtcaaatgtacattgttccatgtcgttagatggaacatggaagccattgtctaatcaactctatcattagtgacttgatgtctcataccttaattttgtaatgatttttattctctgttacaaagacttgaaatacgtattaaatgcacgttaatgttttgctttgcattttaggttcagattatgacttgattgaaataaatgtgcctatacattcatttgctttgtactataaaaataaaaatgatttcttaagttaa

SEQ ID NO: 109732 - DNA, 943 bp, Homo sapiens
  Payload ID: 1548
  Gene Symbol: ATP2C1
  Gene Name: ATPase, Ca++ transporting, type 2C, member 1
  ENST ID: ENST00000508660
  CDS Start-End: 1-943
cagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtga

SEQ ID NO: 109733 - DNA, 3148 bp, Homo sapiens
  Payload ID: 1548
  Gene Symbol: ATP2C1
  Gene Name: ATPase, Ca++ transporting, type 2C, member 1
  ENST ID: ENST00000504612
  CDS Start-End: 1-2711
acaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatatta

SEQ ID NO: 109734 - DNA, 3498 bp, Homo sapiens
  Payload ID: 1548
  Gene Symbol: ATP2C1
  Gene Name: ATPase, Ca++ transporting, type 2C, member 1
  Uniprot ID: P98194
  ENST ID: ENST00000504381
  CDS Start-End: 227-3061
attgcatttctggacgcttctagacagtgttcatacttggctgtctggtttcaccaggaactctacccaaaagaggaaacagcaaggagaacatttgctttgtttgtaggagggaagttgtcgagctacaaacaaatctttaggcatctgaggaattgctaagtttctaatttcatatggttgctgacaaggaggtgcagacaaggaccctcttgctttcctcactatggatagtctgttgcctccatctagattctcttatttcaaaaaatatcctctccatgcaattaggagatatttatcgacgctgagaaaccaaagagccgaagaacaggttgcacgttttcaaaaaatacctaatggtgaaaatgagacaatgattcctgtattgacatcaaaaaaagcaagtgaattaccagtcagtgaagttgcaagcattctccaatttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatatta

SEQ ID NO: 109735 - DNA, 559 bp, Homo sapiens
  Payload ID: 1548
  Gene Symbol: ATP2C1
  Gene Name: ATPase, Ca++ transporting, type 2C, member 1
  ENST ID: ENST00000509662
  CDS Start-End: 253-559
aggttctgaaggaaggggaggttcgggtatcccctggatgggggggcatctctagggcgccgccccgctggcatgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatg

SEQ ID NO: 109736 - DNA, 651 bp, Homo sapiens
  Payload ID: 1548
  Gene Symbol: ATP2C1
  Gene Name: ATPase, Ca++ transporting, type 2C, member 1
  ENST ID: ENST00000507194
  CDS Start-End: 1-153
ctagtggatgatgattttcaaaccataatgtctgcaatcgaagagggtaaagggatttataataacattaaaaatttcgttagattccagctgagcacattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttg

SEQ ID NO: 109737 - DNA, 5067 bp, Homo sapiens
  Payload ID: 1548
  Gene Symbol: ATP2C1
  Gene Name: ATPase, Ca++ transporting, type 2C, member 1
  Uniprot ID: P98194
  ENST ID: ENST00000510168
  CDS Start-End: 551-3310
tctctcagcggaagtaatagtgacaaagctgggttcgcggctggcccaggagtgcggggcgcgactgggcggccggcggcggggaggggcggagcgcaggagtcggaggcgggagcagaccagcacggcctcgcggagccggcccggcggaccgtgacgggtcccctcacctcctcttctctcccctccccgcccgccctctctccctcccttcctccctcccgctcgcttcttctcacgccgggagcaggctcccgcctcgcaccgctgccccgcgagcagctcctcttctcccgaggcgcgcggggcgcccccgcgagccccgcggctgagaccccgcagcctggaggagggctgtccggggctttggatgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaacatgtcttcctttttgaggtaaagatatatactttgtcaaatatcattttgtcatcctctaaatataaatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttctttttgtttcattgggcatgctagggaaataggtggattttgtgtgtaatgccatcagtttttatgaaagcttgatgaggtataggtcatttgttttgagtatgtgggccagaaatttaaaattagaaatttgtttttctgttgagtatataaacaaaaattggtcccaattctaacaggtttaatccttcttgaagccaataagttttatcttttataatctgtcaggatgaaccactccttagcttttatccaatattaaactgcaagtgttagcactgaaatattgtcattgatagggaaaatatctattctttgagtcattgttactgaggcagttgagtgtaaggagctggctgcagtttattctacttaaccctttaaggctgaattgtcaaatgtacattgttccatgtcgttagatggaacatggaagccattgtctaatcaactctatcattagtgacttgatgtctcataccttaattttgtaatgatttttattctctgttacaaagacttgaaatacgtattaaatgcacgttaatgttttgctttgcattttaggttcagattatgacttgattgaaataaatgtgcctatacattc

SEQ ID NO: 109738 - DNA, 556 bp, Homo sapiens
  Payload ID: 1548
  Gene Symbol: ATP2C1
  Gene Name: ATPase, Ca++ transporting, type 2C, member 1
  ENST ID: ENST00000505072
  CDS Start-End: 196-556
ctccctcccgctcgcttcttctcacgccgggagcaggctcccgcctcgcaccgctgccccgcgagcagctcctcttctcccgaggcgcgcggggcgcccccgcgagccccgcggctgagaccccgcagcctggaggagggctgtccggggctttggactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcagg

SEQ ID NO: 109739 - DNA, 3690 bp, Homo sapiens
  Payload ID: 1548
  Gene Symbol: ATP2C1
  Gene Name: ATPase, Ca++ transporting, type 2C, member 1
  Uniprot ID: P98194
  ENST ID: ENST00000533801
  CDS Start-End: 504-3170
aggagtgcggggcgcgactgggcggccggcggcggggaggggcggagcgcaggagtcggaggcgggagcagaccagcacggcctcgcggagccggcccggcggaccgtgacgggtcccctcacctcctcttctctcccctccccgcccgccctctctccctcccttcctccctcccgctcgcttcttctcacgccgggagcaggctcccgcctcgcaccgctgccccgcgagcagctcctcttctcccgaggcgcgcggggcgcccccgcgagccccgcggctgagaccccgcagcctggaggagggctgtccggggctttggatgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactgggtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatattattctctttactgttctctttcaccg

SEQ ID NO: 109740 - DNA, 3376 bp, Homo sapiens
  Payload ID: 1549
  Gene Symbol: ATP2C2
  Gene Name: ATPase, Ca++ transporting, type 2C, member 2
  Uniprot ID: O75185
  ENST ID: ENST00000262429
  CDS Start-End: 90-2930
gggtccggcccaggaggcttgggcgcgcgcagccatcccgggcctcgccggggacctagggacgcaggcaacgcctgcgcccgctcaccatggtcgagggacgcgtctccgagttcctgaagaaactcggcttctcgggcgggggccgccagtaccaggcgctggagaaggacgaagaggaagccttgattgatgaacagagtgagctgaaagccatcgagaaagagaagaaggtgacagccctgccccccaaggaagcgtgcaaatgccagaaagaggatttggccagagcgttttgtgtggacttacacactgggctgtcggagttctcggtgacgcagcgccggctggcccatggctggaatgagtttgttgctgacaacagcgaacctgtgtggaagaaatacctggatcagtttaagaaccccctgatcctgctgctgctgggctctgccctggtgagtgtcctcaccaaggagtatgaggacgccgtcagcatcgccacggcagtgcttgtcgtggtcactgtcgccttcatccaggagtacaggtcggagaaatctctggaagagctgaccaagctggttcctccagaatgtaactgcctaagagaaggaaaactccagcacctgcttgctcgagaactggttcctggtgatgtcgtatctctctcgatcggagaccggatccctgcagacatccgactcactgaggtcacggacctcttggtggatgaatccagtttcaccggggaagccgagccatgtagtaaaacagacagccccttgacaggcggtggggacctcaccaccctcagcaacatcgtcttcatggggaccctggtgcagtatgggaggggccagggggtcgtgattggaacaggggaaagctctcagttcggagaagtgtttaagatgatgcaggctgaagagacacctaaaactcctttgcagaaaagcatggacaggctaggaaagcaactgacactcttctcctttggcataatcggtctcatcatgctcattggctggtcgcaagggaaacaactcctgagtatgttcacgatcggggtcagcctggctgtggcggccattccagagggtctgcccatcgtcgtcatggtgacgctggtcctgggagtgctgcggatggccaagaagcgggtcatcgtgaagaagttacccatcgtggagactttaggttgctgcagcgttctctgttctgacaagacggggactctgactgccaatgaaatgacagtgacccagcttgtaacgtcagatgggcttcgtgccgaggtcagcggagttgggtatgacggtcaagggactgtgtgtcttctaccatccaaggaagtcattaaggaattttccaatgtctcagtgggaaagttagtggaggcgggctgtgttgccaacaatgcggtcatcagaaagaacgccgtgatggggcagcccaccgagggtgcattgatggccctggcgatgaagatggacttaagtgatattaaaaattcatatataagaaaaaaagagattccattcagttcagagcagaagtggatggcggtgaaatgcagtctgaagactgaggatcaggaagacatttacttcatgaaaggggccttggaagaggtgatccgctactgcaccatgtacaacaacgggggcatccccctgccgctgacgccccagcagaggtcattctgcctgcaggaagagaagaggatggggtcgctcggtttgcgggtgctggccctggcttctgggcccgagctggggcggctgacgtttctcggtcttgtgggcatcattgaccccccgagagttggcgtgaaggaagcagtccaggttctctccgagtctggtgtgtctgtgaagatgataacgggggatgccctggagacggccttggccataggaagaaacatcggcctgtgcaacgggaagctgcaagccatgtccggggaggaggtggacagcgtggagaagggcgagctggccgaccgcgtggggaaggtgtccgtgttcttcaggaccagcccaaagcacaagctcaaaatcatcaaggctctgcaggagtcaggggcgatcgtggccatgactggggatggggtgaacgacgcagtggccctgaagtctgcagacattgggatcgccatggggcagacagggacggacgtcagcaaagaggccgccaacatgatcctggtggatgatgacttctcagccatcatgaatgcagtggaggaaggcaagggtattttttacaacatcaaaaactttgtccgattccagctgagcacgagcatctccgccctgagtctcatcactctgtccaccgtgttcaacctgcccagccccctcaacgccatgcagatcctatggatcaacatcatcatggatgggccaccggcgcagagcttgggggtagagcccgttgacaaagacgccttcaggcagccaccacggagtgtgcgggacaccatcctcagcagagccctcatcctgaagatcctcatgtccgcggccatcatcatcagcgggaccctctttatcttctggaaggagatgcctgaagacagagcaagcactccccgcaccacgacgatgacgttcacttgttttgtgtttttcgatctcttcaacgccttgacctgccgctctcagaccaagctgatatttgagatcggctttctcaggaaccacatgttcctctactccgtcctggggtccatcctggggcagctggcggtcatttacatccccccgctgcagagggtcttccagacggagaacctgggagcgcttgatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttattaaccatgtctaactacgtatctgtgccacagcttgcagtgaggcaggccactcgtggcagatacaaggggctcctgagaggcagtgggtaggatggtcacactctgcccattgccctcctggaggccccatttcctcatcataaaatgagggacttttaaataaagtgctatgccggg

SEQ ID NO: 109741 - DNA, 3472 bp, Homo sapiens
  Payload ID: 1549
  Gene Symbol: ATP2C2
  Gene Name: ATPase, Ca++ transporting, type 2C, member 2
  ENST ID: ENST00000416219
  CDS Start-End: 90-3017
gggtccggcccaggaggcttgggcgcgcgcagccatcccgggcctcgccggggacctagggacgcaggcaacgcctgcgcccgctcaccatggtcgagggacgcgtctccgagttcctgaagaaactcggcttctcgggcgggggccgccagtaccaggcgctggagaaggacgaagaggaagccttgattgatgaacagagtgagctgaaagccatcgagaaagagaagaaggtgacagccctgccccccaaggaagcgtgcaaatgccagaaagaggatttggccagagcgttttgtgtggacttacacactgggctgtcggagttctcggtgacgcagcgccggctggcccatggctggaatgagtttgttgctgacaacagcgaacctgtgtggaagaaatacctggatcagtttaagaaccccctgatcctgctgctgctgggctctgccctggtgagtgtcctcaccaaggagtatgaggacgccgtcagcatcgccacggcagtgcttgtcgtggtcactgtcgccttcatccaggagtacaggtcggagaaatctctggaagagctgaccaagctggttcctccagaatgtaactgcctaagagaaggaaaactccagcacctgcttgctcgagaactggttcctggtgatgtcgtatctctctcgatcggagaccggatccctgcagacatccgactcactgaggtcacggacctcttggtggatgaatccagtttcaccggggaagccgagccatgtagtaaaacagacagccccttgacaggcggtggggacctcaccaccctcagcaacatcgtcttcatggggaccctggtgcagtatgggaggggccagggggtcgtgattggaacaggggaaagctctcagttcggagaagtgtttaagatgatgcaggctgaagagacacctaaaactcctttgcagaaaagcatggacaggctaggaaagcaactgacactcttctcctttggcataatcggtctcatcatgctcattggctggtcgcaagggaaacaactcctgagtatgttcacgatcggggtcagcctggctgtggcggccattccagagggtctgcccatcgtcgtcatggtgacgctggtcctgggagtgctgcggatggccaagaagcgggtcatcgtgaagaagttacccatcgtggagactttaggttgctgcagcgttctctgttctgacaagacggggactctgactgccaatgaaatgacagtgacccagcttgtaacgtcagatgggcttcgtgccgaggtcagcggagttgggtatgacggtcaagggactgtgtgtcttctaccatccaaggaagtcattaaggaattttccaatgtctcagtgggaaagttagtggaggcgggctgtgttgccaacaatgcggtcatcagaaagaacgccgtgatggggcagcccaccgagggtgcattgatggccctggcgatgaagatggacttaagtgatattaaaaattcatatataagaaaaaaagagattccattcagttcagagcagaagtggatggcggtgaaatgcagtctgaagactgaggatcaggaagacatttacttcatgaaaggggccttggaagaggtgatccgctactgcaccatgtacaacaacgggggcatccccctgccgctgacgccccagcagaggtcattctgcctgcaggaagagaagaggatggggtcgctcggtttgcgggtgctggccctggcttctgggcccgagctggggcggctgacgtttctcggtcttgtgggcatcattgaccccccgagagttggcgtgaaggaagcagtccaggttctctccgagtctggtgtgtctgtgaagatgataacgggggatgccctggagacggccttggccataggaagaaacatcggcctgtgcaacgggaagctgcaagccatgtccggggaggaggtggacagcgtggagaagggcgagctggccgaccgcgtggggaaggtgtccgtgttcttcaggaccagcccaaagcacaagctcaaaatcatcaaggctctgcaggagtcaggggcgatcgtggccatgactggggatggggtgaacgacgcagtggccctgaagtctgcagacattgggatcgccatggggcagacagggacggacgtcagcaaagaggccgccaacatgatcctggtggatgatgacttctcagccatcatgaatgcagtggaggaaggcaagggtattttttacaacatcaaaaactttgtccgattccagctgagcacgagcatctccgccctgagtctcatcactctgtccaccgtgttcaacctgcccagccccctcaacgccatgcagatcctatggatcaacatcatcatggatgggccaccggcgcagaggagttcccagaaaactgaagtgtgttgcactgcagtgagactgggagtagaaggcagaggagaaagtacctgggccggcagagctggcttgggggtagagcccgttgacaaagacgccttcaggcagccaccacggagtgtgcgggacaccatcctcagcagagccctcatcctgaagatcctcatgtccgcggccatcatcatcagcgggaccctctttatcttctggaaggagatgcctgaagacagagcaagcactccccgcaccacgacgatgacgttcacttgttttgtgtttttcgatctcttcaacgccttgacctgccgctctcagaccaagctgatatttgagatcggctttctcaggaaccacatgttcctctactccgtcctggggtccatcctggggcagctggcggtcatttacatccccccgctgcagagggtcttccagacggagaacctgggagcgcttgatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttattaaccatgtctaactacgtatctgtgccacagcttgcagtgaggcaggccactcgtggcagatacaaggggctcctgagaggcagtgggtaggatggtcacactctgcccattgccctcctggaggccccatttcctcatcataaaatgagggacttttaaataaagtgctatgccgggggataatta

SEQ ID NO: 109742 - DNA, 355 bp, Homo sapiens
  Payload ID: 1549
  Gene Symbol: ATP2C2
  Gene Name: ATPase, Ca++ transporting, type 2C, member 2
  ENST ID: ENST00000569207
  CDS Start-End: 1-160
tgtgtggaagaaatacctggatcagtttaagaaccccctgatcctgctgctgctgggctctgccctggtgagtgtcctcaccaaggagtatgaggacgccgtcagcatcgccacggcagtgcttgtcgtggtcactgtcgccttcatccagcacatctgatgtgcttcctgccaggagtacaggtcggagaaatctctggaagagctgaccaagctggttcctccagaatgtaactgcctaagagaaggaaaactccagcacctgcttgctcgagaactggttcctggtgatgtcgtatctctctcgatcggagaccggatccctgcagacatccgactcactgaggtcacggac

SEQ ID NO: 109743 - DNA, 3274 bp, Homo sapiens
  Payload ID: 1550
  Gene Symbol: ATP2A3
  Gene Name: ATPase, Ca++ transporting, ubiquitous
  Uniprot ID: Q93084
  ENST ID: ENST00000352011
  CDS Start-End: 56-3187
ccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgcctgtctttatccaggccttctcaggacagtctcgcaggcctggagtaggcagccgctgaccacctcttggaccccagaccacaccggaagaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggc

SEQ ID NO: 109744 - DNA, 4826 bp, Homo sapiens
  Payload ID: 1550
  Gene Symbol: ATP2A3
  Gene Name: ATPase, Ca++ transporting, ubiquitous
  Uniprot ID: Q93084
  ENST ID: ENST00000309890
  CDS Start-End: 174-3263
atcctggcgcgggccggggccgccgccgccactgccgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgcctgtctttatccaggccttctcaggacagtctcgcaggcctggagtaggcagccgctgaccacctcttggaccccagaccacaccgggttggcctctttgaagaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggccactcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactgggggaacgg

SEQ ID NO: 109745 - DNA, 3290 bp, Homo sapiens
  Payload ID: 1550
  Gene Symbol: ATP2A3
  Gene Name: ATPase, Ca++ transporting, ubiquitous
  Uniprot ID: Q93084
  ENST ID: ENST00000359983
  CDS Start-End: 1-3159
atggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgcctgtctttatccaggccttctcaggacagtctcgcaggcctggagtaggcagccgctgaccacctcttggaccccagaccacaccgggttggcctctttgggccagggacacagcatcgtctcgctgtcagagctgctcagagagggaggaagcagggaagaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggc

SEQ ID NO: 109746 - DNA, 4182 bp, Homo sapiens
  Payload ID: 1550
  Gene Symbol: ATP2A3
  Gene Name: ATPase, Ca++ transporting, ubiquitous
  Uniprot ID: Q93084
  ENST ID: ENST00000397035
  CDS Start-End: 129-3218
ggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgcctgtctttatccaggccttctcaggacagtctcgcaggcctggagtaggcagccgctgaccacctcttggaccccagaccacaccgggttggcctctttgaagaaatgagccagaagtgagcgctgggaacagagtggagtctccgggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggccactcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactggggg

SEQ ID NO: 109747 - DNA, 4675 bp, Homo sapiens
  Payload ID: 1550
  Gene Symbol: ATP2A3
  Gene Name: ATPase, Ca++ transporting, ubiquitous
  Uniprot ID: Q93084
  ENST ID: ENST00000397041
  CDS Start-End: 129-3128
ggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgaagaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggccactcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactggggg

SEQ ID NO: 109748 - DNA, 3197 bp, Homo sapiens
  Payload ID: 1550
  Gene Symbol: ATP2A3
  Gene Name: ATPase, Ca++ transporting, ubiquitous
  Uniprot ID: Q93084
  ENST ID: ENST00000397043
  CDS Start-End: 125-3121
ccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgaaatgagccagaagtgagcgctgggaacagagtggagtctccggtgtgtacctcagactgatggtgcccatgtgttcgcctccgccccccacc

SEQ ID NO: 109749 - DNA, 429 bp, Homo sapiens
  Payload ID: 1550
  Gene Symbol: ATP2A3
  Gene Name: ATPase, Ca++ transporting, ubiquitous
  ENST ID: ENST00000572116
  CDS Start-End: 1-429
gagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgggccagggacacagcatcgtctcgctgtcagagctgctcagagagggaggaagcagggaagaaatgagccagaagtgagcgctgggaacagagtggagtctccggtgtgtacctcagactga

SEQ ID NO: 109750 - DNA, 604 bp, Homo sapiens
  Payload ID: 1550
  Gene Symbol: ATP2A3
  Gene Name: ATPase, Ca++ transporting, ubiquitous
  ENST ID: ENST00000570845
  CDS Start-End: 1-462
gagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgcctgtctttatccaggccttctcaggacagtctcgcaggcctggagtaggcagccgctgaccacctcttggaccccagaccacaccggggccagggacacagcatcgtctcgctgtcagagctgctcagagagggaggaagcagggaagaaatgagccagaagtgagcgctgggaacagagtggagtctccggtgtgtacctcagactgatggtgcccatgtgttcgcctccgccccccacccttgccaccacactcgcccacttgcccaccgggtcccgccggataaatgacaggc

SEQ ID NO: 109751 - DNA, 5676 bp, Homo sapiens
  Payload ID: 1551
  Gene Symbol: ATP8B4
  Gene Name: ATPase, class I, type 8B, member 4
  Uniprot ID: Q8TF62
  ENST ID: ENST00000284509
  CDS Start-End: 143-3721
gcttttctccttggcatggtcacggaatggatacctgtttgatcttcctgcactgctgagaaatcttccttttgggggagaggattaagtctgggttgaggtaggccacctgttgagacctggtgaaagatcaggtataataatgttctgcagtgaaaagaaattgcgtgaagtggaacggatagtgaaagccaatgaccgtgaatataatgaaaagttccagtatgcggataatcgtatccacacatcgaaatataatattctcaccttcttgccaattaatttatttgaacagttccaaagagtggcaaatgcctattttctttgccttctgattttacagctaattccagaaatttcctccttgacctggtttaccaccattgtgcctttggtcctggtgataactatgacagctgtcaaagatgccacagatgactattttcgccacaagagtgataatcaagtgaataatcggcagtctgaagtgctcatcaacagcaaactgcagaatgaaaaatggatgaatgtcaaagtgggagacatcattaaattagaaaataaccaatttgttgctgctgatttacttctcctatcaagtagtgagccacatggtctctgttatgttgaaactgctgagcttgatggggaaacgaacctaaaagtccgccatgcactatcagttacttcagaacttggagcagatatcagcagacttgcagggtttgatgggattgttgtctgtgaggtgcctaacaacaagttagataaattcatgggaatcctttcttggaaagacagcaagcattccctcaacaatgagaagataatcctgagaggctgcatcctgagaaataccagctggtgttttggaatggttatttttgcaggtcctgacactaaactaatgcagaatagtggtaagacaaagtttaaaaggacaagcattgatagattgatgaatactctagtactatggatttttgggtttctgatatgcttgggaattattcttgcaataggaaattcaatctgggagagtcaaactggggaccaattcagaactttcctcttttggaatgaaggagagaagagctctgtgttctccggattcttaacattctggtcatatattattattctcaatacagttgtacccatttccttatatgtgagtgtggaagtaattcgtctaggacacagttattttataaactgggaccggaagatgtattattctcgaaaagcaatacctgcagtggctcgaacgaccacgctcaatgaggaactggggcagattgagtacattttctccgacaaaacgggtaccctcactcaaaacatcatgacctttaaaagatgttccattaatgggagaatctatggtgaagtacatgatgacctggatcagaagacagaaataactcaggaaaaagagcctgtggatttctcagtcaaatctcaagcggatagagaatttcagttctttgaccaccatctgatggaatccattaaaatgggtgatcccaaagttcatgaattccttaggttacttgctctctgccacactgtaatgtcagaagagaatagcgcaggagagctgatttaccaagttcagtcacctgatgaaggggctctagtgactgccgctagaaattttgggttcatttttaaatcccggaccccagagaccataacaatagaagaattgggaacactagttacttatcaattacttgcctttttggatttcaacaacaccagaaaaaggatgtctgtcatagttcgaaacccagaaggacagataaagctttattccaaaggagcagatactattctgtttgaaaaacttcatccttccaatgaagtccttttgtctttgacgtcagaccacctcagtgaatttgcaggggaaggccttcggaccttggccatcgcatacagagacctggatgacaagtactttaaagagtggcataagatgcttgaagatgcgaatgctgccacagaagagagggatgaacgaatagctgggctatatgaagaaattgaaagagatttgatgctactaggtgccactgctgtagaagataagttacaggagggtgttattgaaacagttacaagtttatcactagccaatattaagatctgggtcctaacaggagacaaacaagaaactgccatcaacatcggttatgcctgcaacatgctgactgacgacatgaatgatgtgtttgtgatagcagggaataatgctgtggaagtgagagaagaactcaggaaagcaaaacaaaatttgtttggacaaaacagaaatttttccaatggccatgtagtttgtgaaaaaaagcagcagctggagttggattctattgtagaagaaaccataacaggagattatgccttaatcataaatggccacagtttggctcatgccctagaaagtgatgtcaagaatgatctcctagaacttgcttgcatgtgtaagactgtaatttgctgcagggtcactccactccagaaagcccaagtggtagagctggtgaagaagtacagaaatgctgttactttggccattggtgatggagccaatgatgtcagcatgattaaaagtgctcacattggtgttggcatcagcggccaggaaggattgcaagcagtcttagccagcgactattcatttgcacagtttagatatctccaaaggcttctccttgttcatggaaggtggtcttatttccgaatgtgcaaattcttatgctatttcttctataagaattttgcatttacacttgtgcatttctggtttggtttcttctgtggtttctcagcccagactgtttatgaccagtggttcatcaccctttttaacattgtttacacatcactgcctgttttagccatggggatttttgaccaggatgtgagtgaccagaacagcgtggactgtccccagctctacaaaccaggacagctgaatctgctttttaacaagcgtaaatttttcatttgcgtgttgcatggaatctacacctcattagtccttttcttcatcccctatggggccttttacaacgtggctggagaagatgggcaacatattgctgactaccagtcctttgcagttaccatggccacatctttggtcattgtggtcagtgtgcagatagccttggataccagttactggactttcattaatcacgtcttcatctgggggagcattgccatttatttctccattttatttacaatgcacagtaatggcatctttggcatcttcccaaaccagtttccatttgttggtaatgcacgacattccctgacccagaagtgcatctggcttgtaattctcttaacaacagtggcttcagttatgccagtggtggcattcagatttttgaaggtggatttatacccaaccctgagtgatcagatccgccggtggcagaaggctcaaaagaaggcaaggcctccaagtagccgaaggcctcggacccgcaggtcaagctcaagaaggtctggatatgcttttgctcaccaagaaggctatggagagcttatcacatctggaaaaaatatgcgagctaaaaatccacccccaacatcagggctggaaaagacacattataatagcactagctggattgaaaatttatgtaagaaaaccacagacaccgtgagcagctttagccaggataaaacagtgaaactgtgagtcaatatgaatttaaaccacgtagttatcttttcacttcaggtggagctgaaattctgctggctccagagtttgagatttgaggcaagaggtggggcaggcagattgcctcacttaacttaaatctgcggcagacaactgccagtgcccatcaaacaggagtgtgcgctatggaaaaccaggccagagggtcactgtctggtttgtgatttggtggacaaaacactcgctgttacaagtacagattttttttttttttaaatcaacctagataccaattgacctgaactttagaatcttatttatggagaaaaacttgtaaagctgcatattcactgaatggatcctcaggcggataaaagggtgcattttaaaggtatatatccaagctgaaaagcatgcctattgacagataaacatgtatctgtaagatcagcctttcccaaggtatacttttaaaatttaaagcgtgtactgtgttgctttcagactgagttgcatgtcactctttagtcttgatatctacctgtctgttcagccaggacaacaaatggcttccaagcctgaagaatacaaaagtgtgcttgtgtttctcatttttataccagtctagggacaaaggagactgaacatctttgcagcaggataggctggtaatttgatcaaatttattcaaaaagctctcagtctgtgtcatgtaaggacatgcttatgaaatgtgagagaggctcgccactaagtattctaaatacttttcaatggcttttctaacaacctcagtagtaatttgctgagcatcatccagaccattaatagaatcagcaaagcactggaatttcacactttaatgataatattccacatagtctatgggcaaatattttcaacatttccaatttttaaagcttcagaattgaagccaaacaaattaataaataattgttttaattactatttaaaaactcaggtttagattgtttaaaattagttgcttttgatactcagctgtcatgtttataattcaaacatgtagtaaacatatgtaggtaaggttgtttttttggagatgttgcagctcaaatttcagtccacatatgaatcatcagtgtattttccataaagtgattcgggcatatttgtgtgaaaacctcagttctgtcacttcttacctctataaacttggacgataatgtgccttctctgagactcagtttcttcctctgtaaaatgaggacatactacctacctcatgtggttggttgatgattgtctgtcaaagcacaaactctgaaattattaaaaacataattatttcataaacagatgagttaagttccagttaactcaacatcagtataacagagcaattggaagagaatatgaaaaaactggaatctaaatagtcagtgaggaaggctttgataaaatgaaattgccagaaagatataaaactggttagggtcctacagggaaataaaattataaccgtggaggtacatttctctaccagaaagcaaaaataaagcatcatgtcttaatggttttctacaaatcaacttctaattctacagagtccttaatctggtccctattaaattcttggtcagacaaagttacatttcccaagagagtcaggtgacacttgagtgagtttgatggataatgagctaatgtgatatctataggtcacaattttttaaaaccaaaattttcaagtctgggataatctttcctaaatgggatcaaatgaaataatatgtgtaaaagagtcaaatgcagtcctttaccatagtaactgcctatggacgttgtctttcccttacatgcctgcctacacttaaccagatgttggttttcaatgtctaatttgtcattagtttcaccacatttgctcactttttgtaacatttttgcaagatttgaaaactttcagtaaatgttttggcactattggt

SEQ ID NO: 109752 - DNA, 4179 bp, Homo sapiens
  Payload ID: 1551
  Gene Symbol: ATP8B4
  Gene Name: ATPase, class I, type 8B, member 4
  ENST ID: ENST00000558906
  CDS Start-End: 147-515
ccttgcttttctccttggcatggtcacggaatggatacctgtttgatcttcctgcactgctgagaaatcttccttttgggggagaggattaagtctgggttgaggtaggccacctgttgagacctggtgaaagatcaggtataataatgttctgcagtgaaaagaaattgcgtgaagtggaacggatagtgaaagccaatgaccgtgaatataatgaaaagttccagtatgcggataatcgtatccacacatcgaaatataatattctcaccttcttgccaattaatttatttgaacagttccaaagagtggcaaatgcctattttctttgccttctgattttacagctaattccagaaatttcctccttgacctggtttaccaccattgtgcctttggtcctggtgataactatgacagctgtcaaagatgccacagatgactattttcgccacaagagtgataatcaagtgaataatcggcagtctgaagtgctcatcaacagcaagtgctgaaggtacaaagctgagggtttaatgacaggaagtactctggtaattgtaaggaagaagatttatcctggtcctgagaaaaatactgcagaatgaaaaatggatgaatgtcaaagtgggagacatcattaaattagaaaataaccaatttgttgctgctgatttacttctcctatcaagtagtgagccacatggtctctgttatgttgaaactgctgagcttgatggggaaacgaacctaaaagtccgccatgcactatcagttacttcagaacttggagcagatatcagcagacttgcagggtttgatgggattgttgtctgtgaggtgcctaacaacaagttagataaattcatgggaatcctttcttggaaagacagcaagcattccctcaacaatgagaagataatcctgagaggctgcatcctgagaaataccagctggtgttttggaatggttatttttgcaggtcctgacactaaactaatgcagaatagtggtaagacaaagtttaaaaggacaagcattgatagattgatgaatactctagtactatggatttttgggtttctgatatgcttgggaattattcttgcaataggaaattcaatctgggagagtcaaactggggaccaattcagaactttcctcttttggaatgaaggagagaagagctctgtgttctccggattcttaacattctggtcatatattattattctcaatacagttgtacccatttccttatatgtgagtgtggaagtaattcgtctaggacacagttattttataaactgggaccggaagatgtattattctcgaaaagcaatacctgcagtggctcgaacgaccacgctcaatgaggaactggggcagattgagtacattttctccgacaaaacgggtaccctcactcaaaacatcatgacctttaaaagatgttccattaatgggagaatctatggtgaagtacatgatgacctggatcagaagacagaaataactcaggaaaaagagcctgtggatttctcagtcaaatctcaagcggatagagaatttcagttctttgaccaccatctgatggaatccattaaaatgggtgatcccaaagttcatgaattccttaggttacttgctctctgccacactgtaatgtcagaagagaatagcgcagttcgaaacccagaaggacagataaagctttattccaaaggagcagatactattctgtttgaaaaacttcatccttccaatgaagtccttttgtctttgacgtcagaccacctcagtgaatttgcaggggaaggccttcggaccttggccatcgcatacagagacctggatgacaagtactttaaagagtggcataagatgcttgaagatgcgaatgctgccacagaagagagggatgaacgaatagctgggctatatgaagaaattgaaagagatttgatgctactaggtgccactgctgtagaagataagttacaggagggtgttattgaaacagttacaagtttatcactagccaatattaagatctgggtcctaacaggagacaaacaagaaactgccatcaacatcggttatgcctgcaacatgctgactgacgacatgaatgatgtgtttgtgatagcagggaataatgctgtggaagtgagagaagaactcaggaaagcaaaacaaaatttgtttggacaaaacagaaatttttccaatggccatgtagtttgtgaaaaaaagcagcagctggagttggattctattgtagaagaaaccataacaggagattatgccttaatcataaatggccacagtttggctcatgccctagaaagtgatgtcaagaatgatctcctagaacttgcttgcatgtgtaagactgtaatttgctgcagggtcactccactccagaaagcccaagtggtagagctggtgaagaagtacagaaatgctgttactttggccattggtgatggagccaatgatgtcagcatgattaaaagtgctcacattggtgttggcatcagcggccaggaaggattgcaagcagtcttagccagcgactattcatttgcacagtttagatatctccaaaggcttctccttgttcatggaaggtggtcttatttccgaatgtgcaaattcttatgctatttcttctataagaattttgcatttacacttgtgcatttctggtttggtttcttctgtggtttctcagcccagactgtttatgaccagtggttcatcaccctttttaacattgtttacacatcactgcctgttttagccatggggatttttgaccaggatgtgagtgaccagaacagcgtggactgtccccagctctacaaaccaggacagctgaatctgctttttaacaagcgtaaatttttcatttgcgtgttgcatggaatctacacctcattagtccttttcttcatcccctatggggccttttacaacgtggctggagaagatgggcaacatattgctgactaccagtcctttgcagttaccatggccacatctttggtcattgtggtcagtgtgcagatagccttggataccagttactggactttcattaatcacgtcttcatctgggggagcattgccatttatttctccattttatttacaatgcacagtaatggcatctttggcatcttcccaaaccagtttccatttgttggtaatgcacgacattccctgacccagaagtgcatctggcttgtaattctcttaacaacagtggcttcagttatgccagtggtggcattcagatttttgaaggtggatttatacccaaccctgagtgatcagatccgccggtggcagaaggctcaaaagaaggcaaggcctccaagtagccgaaggcctcggacccgcaggtcaagctcaagaaggtctggatatgcttttgctcaccaagaaggctatggagagcttatcacatctggaaaaaatatgcgagctaaaaatccacccccaacatcagggctggaaaagacacattataatagcactagctggattgaaaatttatgtaagaaaaccacagacaccgtgagcagctttagccaggataaaacagtgaaactgtgagtcaatatgaatttaaaccacgtagttatcttttcacttcaggtggagctgaaattctgctggctccagagtttgagatttgaggcaagaggtggggcaggcagattgcctcacttaacttaaatctgcggcagacaactgccagtgcccatcaaacaggagtgtgcgctatggaaaaccaggccagagggtcactgtctggtttgtgatttggtggacaaaacactcgctgttacaagtacagattttttttttttttaaatcaacctagataccaattgacctgaactttagaatcttatttatggagaaaaacttgtaaagctgcatattcactgaatggatcctcaggcggataaaagggtgcattttaaaggtatatatccaagctgaaaagcatgcctattgacagataaacatgtatctgtaagatcagcctttcccaaggtatacttttaaaatttaaagcgtgtactgtgttgctttcagactgagttgcatgtcactctttagtcttgatatctacctgtctgttcagccaggacaacaaatggc

SEQ ID NO: 109753 - DNA, 676 bp, Homo sapiens
  Payload ID: 1551
  Gene Symbol: ATP8B4
  Gene Name: ATPase, class I, type 8B, member 4
  ENST ID: ENST00000558024
  CDS Start-End: 1-286
ggcaaatgcctattttctttgccttctgattttacagctaattccagaaatttcctccttgacctggtttaccaccattgtgcctttggtcctggtgataactatgacagctgtcaaagatgccacagatgactattttcgccacaagagtgataatcaagtgaataatcggcagtctgaagtgctcatcaacagcaaactgcagaatgaaaaatggatgaatgtcaaagtgggagacatcattaaattagaaaataaccaatttgttgctctcattaaagattaggaataataccctggaaggtggtgtctgttagaacatactctgtgcgtggaatcaaggtagctccagtgtaagggcactagatggggaactgggagagaactgagactttgcttcattctttcagtgacagtaaagactttatcttctttgtctttggtttgtccatgtgtcaaataagatgctagaccactacaggatctcaaaaatccgttccatgctgtgattctcttctaagctgacactagactatacgattcttgcaggcaaagcacctattgatttgcctgttctccaacacttggtgccatgttccatcaacaggggcatttggtaaatgttagctgaataattaagtgttgatctttgtaagaaagaagacaggaaaaaaaa

SEQ ID NO: 109754 - DNA, 4894 bp, Homo sapiens
  Payload ID: 1551
  Gene Symbol: ATP8B4
  Gene Name: ATPase, class I, type 8B, member 4
  Uniprot ID: Q8TF62
  ENST ID: ENST00000559829
  CDS Start-End: 122-3700
aaaatgagaaagagaccagcaagagcagactaggaaaggaagagaagggaaggagaaaaggaaactagaatgcatttctgtaggccacctgttgagacctggtgaaagatcaggtataataatgttctgcagtgaaaagaaattgcgtgaagtggaacggatagtgaaagccaatgaccgtgaatataatgaaaagttccagtatgcggataatcgtatccacacatcgaaatataatattctcaccttcttgccaattaatttatttgaacagttccaaagagtggcaaatgcctattttctttgccttctgattttacagctaattccagaaatttcctccttgacctggtttaccaccattgtgcctttggtcctggtgataactatgacagctgtcaaagatgccacagatgactattttcgccacaagagtgataatcaagtgaataatcggcagtctgaagtgctcatcaacagcaaactgcagaatgaaaaatggatgaatgtcaaagtgggagacatcattaaattagaaaataaccaatttgttgctgctgatttacttctcctatcaagtagtgagccacatggtctctgttatgttgaaactgctgagcttgatggggaaacgaacctaaaagtccgccatgcactatcagttacttcagaacttggagcagatatcagcagacttgcagggtttgatgggattgttgtctgtgaggtgcctaacaacaagttagataaattcatgggaatcctttcttggaaagacagcaagcattccctcaacaatgagaagataatcctgagaggctgcatcctgagaaataccagctggtgttttggaatggttatttttgcaggtcctgacactaaactaatgcagaatagtggtaagacaaagtttaaaaggacaagcattgatagattgatgaatactctagtactatggatttttgggtttctgatatgcttgggaattattcttgcaataggaaattcaatctgggagagtcaaactggggaccaattcagaactttcctcttttggaatgaaggagagaagagctctgtgttctccggattcttaacattctggtcatatattattattctcaatacagttgtacccatttccttatatgtgagtgtggaagtaattcgtctaggacacagttattttataaactgggaccggaagatgtattattctcgaaaagcaatacctgcagtggctcgaacgaccacgctcaatgaggaactggggcagattgagtacattttctccgacaaaacgggtaccctcactcaaaacatcatgacctttaaaagatgttccattaatgggagaatctatggtgaagtacatgatgacctggatcagaagacagaaataactcaggaaaaagagcctgtggatttctcagtcaaatctcaagcggatagagaatttcagttctttgaccaccatctgatggaatccattaaaatgggtgatcccaaagttcatgaattccttaggttacttgctctctgccacactgtaatgtcagaagagaatagcgcaggagagctgatttaccaagttcagtcacctgatgaaggggctctagtgactgccgctagaaattttgggttcatttttaaatcccggaccccagagaccataacaatagaagaattgggaacactagttacttatcaattacttgcctttttggatttcaacaacaccagaaaaaggatgtctgtcatagttcgaaacccagaaggacagataaagctttattccaaaggagcagatactattctgtttgaaaaacttcatccttccaatgaagtccttttgtctttgacgtcagaccacctcagtgaatttgcaggggaaggccttcggaccttggccatcgcatacagagacctggatgacaagtactttaaagagtggcataagatgcttgaagatgcgaatgctgccacagaagagagggatgaacgaatagctgggctatatgaagaaattgaaagagatttgatgctactaggtgccactgctgtagaagataagttacaggagggtgttattgaaacagttacaagtttatcactagccaatattaagatctgggtcctaacaggagacaaacaagaaactgccatcaacatcggttatgcctgcaacatgctgactgacgacatgaatgatgtgtttgtgatagcagggaataatgctgtggaagtgagagaagaactcaggaaagcaaaacaaaatttgtttggacaaaacagaaatttttccaatggccatgtagtttgtgaaaaaaagcagcagctggagttggattctattgtagaagaaaccataacaggagattatgccttaatcataaatggccacagtttggctcatgccctagaaagtgatgtcaagaatgatctcctagaacttgcttgcatgtgtaagactgtaatttgctgcagggtcactccactccagaaagcccaagtggtagagctggtgaagaagtacagaaatgctgttactttggccattggtgatggagccaatgatgtcagcatgattaaaagtgctcacattggtgttggcatcagcggccaggaaggattgcaagcagtcttagccagcgactattcatttgcacagtttagatatctccaaaggcttctccttgttcatggaaggtggtcttatttccgaatgtgcaaattcttatgctatttcttctataagaattttgcatttacacttgtgcatttctggtttggtttcttctgtggtttctcagcccagactgtttatgaccagtggttcatcaccctttttaacattgtttacacatcactgcctgttttagccatggggatttttgaccaggatgtgagtgaccagaacagcgtggactgtccccagctctacaaaccaggacagctgaatctgctttttaacaagcgtaaatttttcatttgcgtgttgcatggaatctacacctcattagtccttttcttcatcccctatggggccttttacaacgtggctggagaagatgggcaacatattgctgactaccagtcctttgcagttaccatggccacatctttggtcattgtggtcagtgtgcagatagccttggataccagttactggactttcattaatcacgtcttcatctgggggagcattgccatttatttctccattttatttacaatgcacagtaatggcatctttggcatcttcccaaaccagtttccatttgttggtaatgcacgacattccctgacccagaagtgcatctggcttgtaattctcttaacaacagtggcttcagttatgccagtggtggcattcagatttttgaaggtggatttatacccaaccctgagtgatcagatccgccggtggcagaaggctcaaaagaaggcaaggcctccaagtagccgaaggcctcggacccgcaggtcaagctcaagaaggtctggatatgcttttgctcaccaagaaggctatggagagcttatcacatctggaaaaaatatgcgagctaaaaatccacccccaacatcagggctggaaaagacacattataatagcactagctggattgaaaatttatgtaagaaaaccacagacaccgtgagcagctttagccaggataaaacagtgaaactgtgagtcaatatgaatttaaaccacgtagttatcttttcacttcaggtggagctgaaattctgctggctccagagtttgagatttgaggcaagaggtggggcaggcagattgcctcacttaacttaaatctgcggcagacaactgccagtgcccatcaaacaggagtgtgcgctatggaaaaccaggccagagggtcactgtctggtttgtgatttggtggacaaaacactcgctgttacaagtacagattttttttttttttaaatcaacctagataccaattgacctgaactttagaatcttatttatggagaaaaacttgtaaagctgcatattcactgaatggatcctcaggcggataaaagggtgcattttaaaggtatatatccaagctgaaaagcatgcctattgacagataaacatgtatctgtaagatcagcctttcccaaggtatacttttaaaatttaaagcgtgtactgtgttgctttcagactgagttgcatgtcactctttagtcttgatatctacctgtctgttcagccaggacaacaaatggcttccaagcctgaagaatacaaaagtgtgcttgtgtttctcatttttataccagtctagggacaaaggagactgaacatctttgcagcaggataggctggtaatttgatcaaatttattcaaaaagctctcagtctgtgtcatgtaaggacatgcttatgaaatgtgagagaggctcgccactaagtattctaaatacttttcaatggcttttctaacaacctcagtagtaatttgctgagcatcatccagaccattaatagaatcagcaaagcactggaatttcacactttaatgataatattccacatagtctatgggcaaatattttcaacatttccaatttttaaagcttcagaattgaagccaaacaaattaataaataattgttttaattactatttaaaaactcaggtttagattgtttaaaattagttgcttttgatactcagctgtcatgtttataattcaaacatgtagtaaacatatgtaggtaaggttgtttttttggagatgttgcagctcaaatttcagtccacatatgaatcatcagtgtattttccataaagtgattcgggcatatttgtgtgaaaacctcagttctgtcacttcttacctctataaacttggacgataatgtg

SEQ ID NO: 109755 - DNA, 5783 bp, Homo sapiens
  Payload ID: 1551
  Gene Symbol: ATP8B4
  Gene Name: ATPase, class I, type 8B, member 4
  ENST ID: ENST00000559726
  CDS Start-End: 162-530
cagctcccaaggctgagattactctgcttcatctggatcgcccatctctggggtctcatggctgagtttcagttccccaatcctacctgctcctcagggggccagcactggggctgcaggtaggccacctgttgagacctggtgaaagatcaggtataataatgttctgcagtgaaaagaaattgcgtgaagtggaacggatagtgaaagccaatgaccgtgaatataatgaaaagttccagtatgcggataatcgtatccacacatcgaaatataatattctcaccttcttgccaattaatttatttgaacagttccaaagagtggcaaatgcctattttctttgccttctgattttacagctaattccagaaatttcctccttgacctggtttaccaccattgtgcctttggtcctggtgataactatgacagctgtcaaagatgccacagatgactattttcgccacaagagtgataatcaagtgaataatcggcagtctgaagtgctcatcaacagcaagtgctgaaggtacaaagctgagggtttaatgacaggaagtactctggtaattgtaaggaagaagatttatcctggtcctgagaaaaatactgcagaatgaaaaatggatgaatgtcaaagtgggagacatcattaaattagaaaataaccaatttgttgctgctgatttacttctcctatcaagtagtgagccacatggtctctgttatgttgaaactgctgagcttgatggggaaacgaacctaaaagtccgccatgcactatcagttacttcagaacttggagcagatatcagcagacttgcagggtttgatgggattgttgtctgtgaggtgcctaacaacaagttagataaattcatgggaatcctttcttggaaagacagcaagcattccctcaacaatgagaagataatcctgagaggctgcatcctgagaaataccagctggtgttttggaatggttatttttgcaggtcctgacactaaactaatgcagaatagtggtaagacaaagtttaaaaggacaagcattgatagattgatgaatactctagtactatggatttttgggtttctgatatgcttgggaattattcttgcaataggaaattcaatctgggagagtcaaactggggaccaattcagaactttcctcttttggaatgaaggagagaagagctctgtgttctccggattcttaacattctggtcatatattattattctcaatacagttgtacccatttccttatatgtgagtgtggaagtaattcgtctaggacacagttattttataaactgggaccggaagatgtattattctcgaaaagcaatacctgcagtggctcgaacgaccacgctcaatgaggaactggggcagattgagtacattttctccgacaaaacgggtaccctcactcaaaacatcatgacctttaaaagatgttccattaatgggagaatctatggtgaagtacatgatgacctggatcagaagacagaaataactcaggaaaaagagcctgtggatttctcagtcaaatctcaagcggatagagaatttcagttctttgaccaccatctgatggaatccattaaaatgggtgatcccaaagttcatgaattccttaggttacttgctctctgccacactgtaatgtcagaagagaatagcgcaggagagctgatttaccaagttcagtcacctgatgaaggggctctagtgactgccgctagaaattttgggttcatttttaaatcccggaccccagagaccataacaatagaagaattgggaacactagttacttatcaattacttgcctttttggatttcaacaacaccagaaaaaggatgtctgtcatagttcgaaacccagaaggacagataaagctttattccaaaggagcagatactattctgtttgaaaaacttcatccttccaatgaagtccttttgtctttgacgtcagaccacctcagtgaatttgcaggggaaggccttcggaccttggccatcgcatacagagacctggatgacaagtactttaaagagtggcataagatgcttgaagatgcgaatgctgccacagaagagagggatgaacgaatagctgggctatatgaagaaattgaaagagatttgatgctactaggtgccactgctgtagaagataagttacaggagggtgttattgaaacagttacaagtttatcactagccaatattaagatctgggtcctaacaggagacaaacaagaaactgccatcaacatcggttatgcctgcaacatgctgactgacgacatgaatgatgtgtttgtgatagcagggaataatgctgtggaagtgagagaagaactcaggaaagcaaaacaaaatttgtttggacaaaacagaaatttttccaatggccatgtagtttgtgaaaaaaagcagcagctggagttggattctattgtagaagaaaccataacaggagattatgccttaatcataaatggccacagtttggctcatgccctagaaagtgatgtcaagaatgatctcctagaacttgcttgcatgtgtaagactgtaatttgctgcagggtcactccactccagaaagcccaagtggtagagctggtgaagaagtacagaaatgctgttactttggccattggtgatggagccaatgatgtcagcatgattaaaagtgctcacattggtgttggcatcagcggccaggaaggattgcaagcagtcttagccagcgactattcatttgcacagtttagatatctccaaaggcttctccttgttcatggaaggtggtcttatttccgaatgtgcaaattcttatgctatttcttctataagaattttgcatttacacttgtgcatttctggtttggtttcttctgtggtttctcagcccagactgtttatgaccagtggttcatcaccctttttaacattgtttacacatcactgcctgttttagccatggggatttttgaccaggatgtgagtgaccagaacagcgtggactgtccccagctctacaaaccaggacagctgaatctgctttttaacaagcgtaaatttttcatttgcgtgttgcatggaatctacacctcattagtccttttcttcatcccctatggggccttttacaacgtggctggagaagatgggcaacatattgctgactaccagtcctttgcagttaccatggccacatctttggtcattgtggtcagtgtgcagatagccttggataccagttactggactttcattaatcacgtcttcatctgggggagcattgccatttatttctccattttatttacaatgcacagtaatggcatctttggcatcttcccaaaccagtttccatttgttggtaatgcacgacattccctgacccagaagtgcatctggcttgtaattctcttaacaacagtggcttcagttatgccagtggtggcattcagatttttgaaggtggatttatacccaaccctgagtgatcagatccgccggtggcagaaggctcaaaagaaggcaaggcctccaagtagccgaaggcctcggacccgcaggtcaagctcaagaaggtctggatatgcttttgctcaccaagaaggctatggagagcttatcacatctggaaaaaatatgcgagctaaaaatccacccccaacatcagggctggaaaagacacattataatagcactagctggattgaaaatttatgtaagaaaaccacagacaccgtgagcagctttagccaggataaaacagtgaaactgtgagtcaatatgaatttaaaccacgtagttatcttttcacttcaggtggagctgaaattctgctggctccagagtttgagatttgaggcaagaggtggggcaggcagattgcctcacttaacttaaatctgcggcagacaactgccagtgcccatcaaacaggagtgtgcgctatggaaaaccaggccagagggtcactgtctggtttgtgatttggtggacaaaacactcgctgttacaagtacagattttttttttttttaaatcaacctagataccaattgacctgaactttagaatcttatttatggagaaaaacttgtaaagctgcatattcactgaatggatcctcaggcggataaaagggtgcattttaaaggtatatatccaagctgaaaagcatgcctattgacagataaacatgtatctgtaagatcagcctttcccaaggtatacttttaaaatttaaagcgtgtactgtgttgctttcagactgagttgcatgtcactctttagtcttgatatctacctgtctgttcagccaggacaacaaatggcttccaagcctgaagaatacaaaagtgtgcttgtgtttctcatttttataccagtctagggacaaaggagactgaacatctttgcagcaggataggctggtaatttgatcaaatttattcaaaaagctctcagtctgtgtcatgtaaggacatgcttatgaaatgtgagagaggctcgccactaagtattctaaatacttttcaatggcttttctaacaacctcagtagtaatttgctgagcatcatccagaccattaatagaatcagcaaagcactggaatttcacactttaatgataatattccacatagtctatgggcaaatattttcaacatttccaatttttaaagcttcagaattgaagccaaacaaattaataaataattgttttaattactatttaaaaactcaggtttagattgtttaaaattagttgcttttgatactcagctgtcatgtttataattcaaacatgtagtaaacatatgtaggtaaggttgtttttttggagatgttgcagctcaaatttcagtccacatatgaatcatcagtgtattttccataaagtgattcgggcatatttgtgtgaaaacctcagttctgtcacttcttacctctataaacttggacgataatgtgccttctctgagactcagtttcttcctctgtaaaatgaggacatactacctacctcatgtggttggttgatgattgtctgtcaaagcacaaactctgaaattattaaaaacataattatttcataaacagatgagttaagttccagttaactcaacatcagtataacagagcaattggaagagaatatgaaaaaactggaatctaaatagtcagtgaggaaggctttgataaaatgaaattgccagaaagatataaaactggttagggtcctacagggaaataaaattataaccgtggaggtacatttctctaccagaaagcaaaaataaagcatcatgtcttaatggttttctacaaatcaacttctaattctacagagtccttaatctggtccctattaaattcttggtcagacaaagttacatttcccaagagagtcaggtgacacttgagtgagtttgatggataatgagctaatgtgatatctataggtcacaattttttaaaaccaaaattttcaagtctgggataatctttcctaaatgggatcaaatgaaataatatgtgtaaaagagtcaaatgcagtcctttaccatagtaactgcctatggacgttgtctttcccttacatgcctgcctacacttaaccagatgttggttttcaatgtctaatttgtcattagtttcaccacatttgctcactttttgtaacatttttgcaagatttgaaaactttcagtaaatgttttggcactattggt

SEQ ID NO: 109756 - DNA, 551 bp, Homo sapiens
  Payload ID: 1551
  Gene Symbol: ATP8B4
  Gene Name: ATPase, class I, type 8B, member 4
  ENST ID: ENST00000558458
  CDS Start-End: 1-253
ttttaaatcccggaccccagagaccataacaatagaagaattgggaacactagttacttatcaattacttgcctttttggatttcaacaacaccagaaaaaggatgtctgtcatagttcgaaacccagaaggacagataaagctttattccaaaggagcagatactattctgtttgaaaaacttcatccttccaatgaagtccttttgtctttgacgtcagaccacctcagtgaggccagcatggtcttttaaattttttttaatgaacacaacactggaatcataagtgtctgacttattgccgttactcaaacaccaaggccctggtttttcatacattctcctttaatactaaactataggaaacctaatttggtctttttacatttctctgcaaaataattttttttcaggaatttgcaggggaaggccttcggaccttggccatcgcatacagagacctggatgacaagtactttaaagagtggcataagatgcttgaagatgcgaatgctgccacagaagagagggatgaacgaatagctgggct

SEQ ID NO: 109757 - DNA, 759 bp, Homo sapiens
  Payload ID: 1551
  Gene Symbol: ATP8B4
  Gene Name: ATPase, class I, type 8B, member 4
  ENST ID: ENST00000558829
  CDS Start-End: 600-759
ggcacagcccagcttcaccagccccagccacagccacacgtaggccggctcgttacccataaggagcgccacgcagtctccctggcgcaggccgaggtggtcgtgcagcgcccgggccacttgattgctgcgccggtccacctgcgcgtaggtgagagtctcgtcgcggaagagcagaaaaggcttgtgtggcgtctggcgcgctttctccaggaacgcccgcaggatggtgcgcgccggccgccgcttcccgtagctgcgcaccctccggcccacggcggccaccttcaagaagtagcctatgtcctggaagaagtatgggcagcagaggttcaccaggagcggcaggaacagcagtcccgccaggactgtgtagatggcggaaagcatgacggctgcggggccctctgtcccagcgagggcagagggttcaccccgggcgtgcagcgcggcgactgggcgggctccgggcggactggcgggctgcgccggggcgcacgcggcgggacgccgggctcgcgtgagatgaaggggaagacagagctcctccgctgcaggtaggccacctgttgagacctggtgaaagatcaggtataataatgttctgcagtgaaaagaaattgcgtgaagtggaacggatagtgaaagccaatgaccgtgaatataatgaaaagttccagtatgcggataatcgtatccacacatcgaaatataatattctcaccttcttgccaattaatttatttgaacagttccaaa

SEQ ID NO: 109758 - DNA, 4124 bp, Homo sapiens
  Payload ID: 1551
  Gene Symbol: ATP8B4
  Gene Name: ATPase, class I, type 8B, member 4
  ENST ID: ENST00000557955
  CDS Start-End: 139-2292
ttctccttggcatggtcacggaatggatacctgtttgatcttcctgcactgctgagaaatcttccttttgggggagaggattaagtctgggttgaggtaggccacctgttgagacctggtgaaagatcaggtataataatgttctgcagtgaaaagaaattgcgtgaagtggaacggatagtgaaagccaatgaccgtgaatataatgaaaagttccagtatgcggataatcgtatccacacatcgaaatataatattctcaccttcttgccaattaatttatttgaacagttccaaagagtggcaaatgcctattttctttgccttctgattttacagctaattccagaaatttcctccttgacctggtttaccaccattgtgcctttggtcctggtgataactatgacagctgtcaaagatgccacagatgactattttcgccacaagagtgataatcaagtgaataatcggcagtctgaagtgctcatcaacagcaaactgcagaatgaaaaatggatgaatgtcaaagtgggagacatcattaaattagaaaataaccaatttgttgctgctgatttacttctcctatcaagtagtgagccacatggtctctgttatgttgaaactgctgagcttgatggggaaacgaacctaaaagtccgccatgcactatcagttacttcagaacttggagcagatatcagcagacttgcagggtttgatgggattgttgtctgtgaggtgcctaacaacaagttagataaattcatgggaatcctttcttggaaagacagcaagcattccctcaacaatgagaagataatcctgagaggctgcatcctgagaaataccagctggtgttttggaatggttatttttgcaggtcctgacactaaactaatgcagaatagtggtaagacaaagtttaaaaggacaagcattgatagattgatgaatactctagtactatggatttttgggtttctgatatgcttgggaattattcttgcaataggaaattcaatctgggagagtcaaactggggaccaattcagaactttcctcttttggaatgaaggagagaagagctctgtgttctccggattcttaacattctggtcatatattattattctcaatacagttgtacccatttccttatatgtgagtgtggaagtaattcgtctaggacacagttattttataaactgggaccggaagatgtattattctcgaaaagcaatacctgcagtggctcgaacgaccacgctcaatgaggaactggggcagattgagtacattttctccgacaaaacgggtaccctcactcaaaacatcatgacctttaaaagatgttccattaatgggagaatctatggtgaagtacatgatgacctggatcagaagacagaaataactcaggaaaaagagcctgtggatttctcagtcaaatctcaagcggatagagaatttcagttctttgaccaccatctgatggaatccattaaaatgggtgatcccaaagttcatgaattccttaggttacttgctctctgccacactgtaatgtcagaagagaatagcgcaggagagctgatttaccaagttcagtcacctgatgaaggggctctagtgactgccgctagaaattttgggttcatttttaaatcccggaccccagagaccataacaatagaagaattgggaacactagttacttatcaattacttgcctttttggatttcaacaacaccagaaaaaggatgtctgtcatagttcgaaacccagaaggacagataaagctttattccaaaggagcagatactattctgtttgaaaaacttcatccttccaatgaagtccttttgtctttgacgtcagaccacctcagtgaatttgcaggggaaggccttcggaccttggccatcgcatacagagacctggatgacaagtactttaaagagtggcataagatgcttgaagatgcgaatgctgccacagaagagagggatgaacgaatagctgggctatatgaagaaattgaaagagatttgatgctactaggtgccactgctgtagaagataagttacaggagggtgttattgaaacagttacaagtttatcactagccaatattaagatctgggtcctaacaggagacaaacaagaaactgccatcaacatcggttatgcctgcaacatgctgactgacgacatgaatgatgtgtttgtgatagcagggaataatgctgtggaagtgagagaagaactcaggctcatgccctagaaagtgatgtcaagaatgatctcctagaacttgcttgcatgtgtaagactgtaatttgctgcagggtcactccactccagaaagcccaagtggtagagctggtgaagaagtacagaaatgctgttactttggccattggtgatggagccaatgatgtcagcatgattaaaagtgctcacattggtgttggcatcagcggccaggaaggattgcaagcagtcttagccagcgactattcatttgcacagtttagatatctccaaaggcttctccttgttcatggaaggtggtcttatttccgaatgtgcaaattcttatgctatttcttctataagaattttgcatttacacttgtgcatttctggtttggtttcttctgtggtttctcagcccagactgtttatgaccagtggttcatcaccctttttaacattgtttacacatcactgcctgttttagccatggggatttttgaccaggatgtgagtgaccagaacagcgtggactgtccccagctctacaaaccaggacagctgaatctgctttttaacaagcgtaaatttttcatttgcgtgttgcatggaatctacacctcattagtccttttcttcatcccctatggggccttttacaacgtggctggagaagatgggcaacatattgctgactaccagtcctttgcagttaccatggccacatctttggtcattgtggtcagtgtgcagatagccttggataccagttactggactttcattaatcacgtcttcatctgggggagcattgccatttatttctccattttatttacaatgcacagtaatggcatctttggcatcttcccaaaccagtttccatttgttggtaatgcacgacattccctgacccagaagtgcatctggcttgtaattctcttaacaacagtggcttcagttatgccagtggtggcattcagatttttgaaggtggatttatacccaaccctgagtgatcagatccgccggtggcagaaggctcaaaagaaggcaaggcctccaagtagccgaaggcctcggacccgcaggtcaagctcaagaaggtctggatatgcttttgctcaccaagaaggctatggagagcttatcacatctggaaaaaatatgcgagctaaaaatccacccccaacatcagggctggaaaagacacattataatagcactagctggattgaaaatttatgtaagaaaaccacagacaccgtgagcagctttagccaggataaaacagtgaaactgtgagtcaatatgaatttaaaccacgtagttatcttttcacttcaggtggagctgaaattctgctggctccagagtttgagatttgaggcaagaggtggggcaggcagattgcctcacttaacttaaatctgcggcagacaactgccagtgcccatcaaacaggagtgtgcgctatggaaaaccaggccagagggtcactgtctggtttgtgatttggtggacaaaacactcgctgttacaagtacagattttttttttttttaaatcaacctagataccaattgacctgaactttagaatcttatttatggagaaaaacttgtaaagctgcatattcactgaatggatcctcaggcggataaaagggtgcattttaaaggtatatatccaagctgaaaagcatgcctattgacagataaacatgtatctgtaagatcagcctttcccaaggtatacttttaaaatttaaagcgtgtactgtgttgctttcagactgagttgcatgtcactctttagtcttgatatctacctgtctgttcagccaggacaacaaatggc

SEQ ID NO: 109759 - DNA, 7437 bp, Homo sapiens
  Payload ID: 1552
  Gene Symbol: ATP9A
  Gene Name: ATPase, class II, type 9A
  ENST ID: ENST00000311637
  CDS Start-End: 5-2740
gcggatggacagcaggccccgcgccgggtgctgcgagtggctgagatgctgcggtggaggggaggccaggccccgcactgtctggctggggcaccccgagaagagagaccagaggtatcctcggaatgtcatcaacaatcagaagtacaatttcttcacctttcttcctggggtgctgttcaaccagttcaaatactttttcaacctctatttcttacttcttgcctgctctcagtttgttcccgaaatgagacttggtgcactctatacctactgggttcccctgggcttcgtgctggccgtcactgtcatccgtgaggcggtggaggagatccgatgctacgtgcgggacaaggaagtcaactcccaggtctacagccggctcacagcacgaggtactgttgtgggtgttgttctttacactggcagagaactccggagtgtcatgaatacctcaaatccccgaagtaagatcggcctgttcgacttggaagtgaactgcctcaccaagatcctctttggtgccctggtggtggtctcgctggtcatggttgcccttcagcactttgcaggccgttggtacctgcagatcatccgcttcctcctcttgttttccaacatcatccccattagtttgcgtgtgaacctggacatgggcaagatcgtgtacagctgggtgattcgaagggactcgaaaatccccgggaccgtggttcgctccagcacgattcctgagcagctgggcaggatttcgtacttactcacagacaagacaggcactcttacccagaacgagatgattttcaaacggctccatctcggaacagtagcctacggcctcgactcaatggacgaagtacaaagccacattttcagcatttacacccagcaatcccaggacccaccggctcagaagggcccaacgctcaccactaaggtccggcggaccatgagcagccgcgtgcacgaagccgtgaaggccatcgcgctctgccacaacgtgactcccgtgtatgagtccaacggtgtgactgatcaggctgaggccgagaagcagtacgaagactcctgccgcgtataccaggcatccagccccgatgaggtggccctggtacagtggacggaaagtgtgggcttaaccctggtgggccgagaccagtcttccatgcagctgaggacccctggcgaccagatcctgaacttcaccatcctacagatcttccctttcacctatgaaagcaaacgtatgggcatcatcgtgcgggatgaatcaactggagaaattacgttttacatgaagggagcagatgtggtcatggctggcattgtgcagtacaatgactggttggaggaagagtgtggcaacatggcccgagaagggctgcgggtgctcgtggtggcaaagaagtctcttgcagaggagcagtatcaggactttgaagcccgctacgtccaggccaagctgagtgtgcacgaccgctccctcaaagtggccacggtgatcgagagcctggagatggagatggaactgctgtgcctgacgggcgtggaggaccagctgcaggcagatgtgcggcccacgctggagaccctgaggaatgctggcatcaaggtttggatgctgacaggggacaagctggagacagctacgtgcacagcgaagaatgcacatctggtgaccagaaaccaagacatccacgtttttcggctggtgaccaaccgcggggaggctcacctcgagctgaacgccttccgcaggaagcatgattgtgccctggtcatctcgggagactccctggaggtttgcctcaagtactatgagtacgagttcatggagctggcctgccagtgcccggccgtagtctgctgccgatgtgcccccacccagaaggcccagatcgtgcgcctgcttcaggagcgcacgggcaagctcacctgtgcagtaggggacggaggcaatgacgtcagcatgattcaggaatctgactgcggcgtgggagtggaaggaaaggaaggaaaacaggcttcgttggctgcagacttctccatcactcaatttaagcatcttggccggttgcttatggtgcatggccggaacagctacaagcggtcagccgccctcagccagttcgtgattcacaggagcctctgtatcagcaccatgcaggctgtcttttcctccgtgttttactttgcctccgtccctctctatcaaggattcctcatcattgggtactccacaatttacaccatgtttcctgtgttttctctggtcctggacaaagatgtcaaatcggaagttgccatgctgtatcctgagctctacaaggatcttctcaagggacggccgttgtcctacaagacattcttaatatgggttttgattagcatctatcaagggagcaccatcatgtacggggcgctgctgctgtttgagtcggagttcgtgcacatcgtggccatctccttcacctcgctgatcctcaccgagctgctcatggtggcgctgaccatccagacctggcactggctcatgacagtggcggagctgctcagcctggcctgctacatcgcctccctggtgttcttacacgagttcatcgatgtgtacttcatcgccaccttgtcattcttgtggaaagtctccgtcatcactctggtcagctgcctccccctctatgtcctcaagtacctgcgaagacggttctctccccccagctactcaaagctcacatcataggccgtgcgttcgctggagggggccctggtcttggcgcttccctgatggacagagctcaagttccatttatattaaccgccacctgtggattttgcagtaattgctaacacatgcagttttaatgggaagtggctctgcgcctaaacggagtcctaacgctgcatcaacgggagggagggtcctgaaagagacccatctgggcctgtctgaacccctcgttcttcatgtttaggtgaatatgaatatgttaaagctggtggctcagctgggagatttatatgggtcactgtgcgagcttccttatgacttgaattttgttgtcacatgataaaagtttctgtgtagctgaaggttgtagaaggcttgtgtgtgtgtgtgtgtgtgtgtgtgtgtgtgtgtgtgtttttaaagagtcctaatgtgtatgtactctttatgtctttcttgctcttacaaagaggtgtcagaaaaatagaaagctcttggtgtcggtttgggaggaaaagacagtgacatttggtaaaaagttatccacacaataatctccattcggaaatgctcagtatcgtctccagccagccctgcttatccaggttacactggattcctgggatcgtaaccagtaaatgagaggagagggagagagagtgtcctaagtccaatctgttatccttgatctgattcagcatccatagtgtgtgagttaacttcacctgccacctcgtaaaagaatttcagaggtgtgatcccgctttattgggacctggtaacaatcacaaagccagtggctgtttgagaaggacctcagacattttcagcagagttgttttagcaggaaacgtgccactgaatggcccctaaatgtgtcgacagtgtgataagagactcaactaattctttaggcaacatggcagatgtgactcagatcctccaagaccaaagcggaaaggtcagggggctgggactcttctcttccatagaagcctgtttcctgttaggaggcataatggaagatgaccccacaaaggcagaggcatctttcggaacaacactggtggcagctttcagaacaaggaacccctggtgggaggacgcccaagctacagcgttgggatctgggatctgttccactgccggcagatttcaaggggaacttgctgaaaggcagccagtggtgaagatttctcccctcccaggatggactacatgccggcatgtttcttataaagctgtggctgcttgtttcagaggaagggagtttgcagtcgcgggacgtggtagagcaaggcattcttgggttttcaagttgcttcttgcagaagccacatatgcatgccataagggttaagttggtggatctttaagagccaagtgtggttgagatcttggatttgcgtttacttcttgatgaatacatatccttcaaaccctctgcctggcgctacttctgtgtgcttcagagatgtacatcacagcctggtttctgatgcctactaactcctgctcttggagagctggagacacgaggatcagatagtcccttgcctttggagcactcttgataagcttttgtattttgtgttgtccttttaaaatgttctagaatgactttacgttgcaggtactggttaattggctgttgacaccacatctattttgtcttatgattctgcagttttgcagtacttttctctatctgattcagccatttctgccagagggaaaaggtcggcagaaaagatgtattgagtgaatagttaaggataggatctttgtccaaaaatttcagaaagattgagcaaatctgacgtattcattgagtgagtttctgtgttttcaaaggtggaggagaaatttgtgctggaagtttttaagcctccgttttcttggaaatcagtctgtaacactggcaagtcttaagatagtcccatttagactttgcagatgctgaacctggctctgtaacgctgggaagtcttaagatagtcctgtttagactttgcaaaccctgtacctggctttgctcggagattcgggatgctggctcctgcaggcagggcgtgtgggagcctcgtcagaaagttttagaggtttccagcagaagcagaatgaagatggtctccctggccttttccttaattctcaattttgattgaggtgcacaagttgacttttaaagccaacgcttaagatactgattgacatcttcaagggagaatgctcccaggaggggctgaagaagccatagttggaagtggaaggtactcgtcagtgttctccacaaacctttttactctgttgtctcagccgcactggggcggaggcggtcaagggtgagaagtaccgacactcaagtgcaaactgccacgtcgttggcccatcccatcagtgggcagctggctgacgccattcactggacggtccctgaacacctaggaatgcacacaccgtgcttctcagacactggagacgcaaaggcaggaggatgcagtccggtgagaggacacgatctttacctgcacaatcagactgtaagcccagcagagaaccccaggggcgcctgggtacttctcggaggtcatcttagttgtggtggggaagacaaagaaataagcaaacaagaaactagagttactatacaagaaactctcctgagtttgtaaaccttaagcataaggattcagttgacctttttcttggttcatcaatctggaaagaacttacataaagcgccattgacactgtcacctgggagctccatgggccgtaagtctttgacagccaatttaatttgaggtcagagggccttgaggtacacagtcagcactgtttgaacacttttcctgaaagcaaaactcacagctccctgcgccctctgacaacactagctatttctgccagagtaagaacttctattactattttattattgttcatatgtcttttgatgatggttgtgtgacagggggaagcaggatctatttggtttcttcccctccccccaccccttcctttttgtctctctttttttttctctaagaaaatcaccagactagtttttccatcttgagtaatttcttatgtgggacagttttgatcctcattttgaaagcatgcgtgtgcacatgtgtgttgcctgtggtgccaggtgagacaggtggcactaactccagctgcttggaaggcatcccaagggcgcatcttaaagttggagcagacctcccttttccagcccctggggccattagaccacgtgctggaactagcattgtaaaattcccatcccagttccactcccctgaagtgaaacccttttttttttgtgacagtaaatcttaaaaatcattgtctctttatgaacatttcctcagtttcttctctgctgaaaatgtaagccatgctactttttaatgtattttgaattttgtgctcattggaaattgatatgctaatgcctcccccaccccccgccagacttttctttttatactttgtcttgtttttactggggtaggctgggcatgcgtgcgtgcctttagggcagcattttaaacctttgccaaaattgcaaatgggacatgtacattcttctgctccatcctacttaaacacctatcagctatttttatctttaaccttttctgtatgtttgaagtgtgtggggggtgtgtgtgtgtgtgaaagagcgagagaatgatgtcatctaaagttttttgaagaattatttggttttcattgcattaaaattctatcactcccagctttgttttcatttaaaaaaatatacaaagagctttgtaaatacaacacattttatttctcccccttcttttaatgtacagcttttttgccacttatatatacttaaaatattcccatgaattatgtccagttcttcttggaaaaaaatttggttttgaatgaacctgcaaagcatcctgcagcgtgagcagctcctccacctggagctccgaagcatcttctcaggccaaagcggcattacccgtgaatctgtcttctccgccacagcatggtttgaggcgcagtctgttaatatagctgggccatgtcagtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatgctttaatttagcaggaacttccagatgatttaaattctcgatgctgtgatgacacacatatgatctttcgtgtttctgagcgactctactttcattgtttgccagcgtggctcgttgctgttgcccaataaagcttgtgtacgttctgccttgggggattattttaatttgtacagaaacatgaattctggtatcaaaatgaggactttttattataacgctcctattttttctttatttcatggtacatgaaatgtaaagaaaactctttccagttcagaaaattattttgattttggcaaaaaaaaccccaaatcaatgcatgttatttattattttgtactattgtccatcccagacgtgtcagaatttcaaaaggtgatagatataaatggaaaataagatgaaaa

SEQ ID NO: 109760 - DNA, 8106 bp, Homo sapiens
  Payload ID: 1552
  Gene Symbol: ATP9A
  Gene Name: ATPase, class II, type 9A
  Uniprot ID: O75110
  ENST ID: ENST00000338821
  CDS Start-End: 266-3409
gcgcggcgcggcgcggagcgagcgggcgcagcgcggagctcgggcccatggtgcgcccgtgtccgtcggtcgggccgcgcgggcgctccgcgcgtggcccggcgctcgcgagctcgccccctcgctgcgggcccggcccgcccgctgccgccgcctcctcccccggggcggcgcggcgccggcgggcggcggcgcggaggccggaccgggcggcggcccaggcggcgcggggggcgcggcggccaaggcgggcggcgccgccgacatgacggacaacatcccgctgcagccggtgcgccagaagaagcggatggacagcaggccccgcgccgggtgctgcgagtggctgagatgctgcggtggaggggaggccaggccccgcactgtctggctggggcaccccgagaagagagaccagaggtatcctcggaatgtcatcaacaatcagaagtacaatttcttcacctttcttcctggggtgctgttcaaccagttcaaatactttttcaacctctatttcttacttcttgcctgctctcagtttgttcccgaaatgagacttggtgcactctatacctactgggttcccctgggcttcgtgctggccgtcactgtcatccgtgaggcggtggaggagatccgatgctacgtgcgggacaaggaagtcaactcccaggtctacagccggctcacagcacgaggcacagtgaaggtgaagagttctaacatccaagttggagaccttatcatcgttgaaaagaaccagcgggtccctgccgacatgatcttcctgaggacatcagaaaaaaacgggtcatgcttcttgcggacggatcagctggatggggagacggactggaagctgcggcttcccgtggcctgcacgcagaggctccccacggccgccgaccttcttcagattcgatcgtatgtgtacgcagaagagccaaatattgacattcacaacttcgtgggaacttttacccgagaagacagcgaccccccgatcagcgagagcctgagcatagagaacacgctgtgggctggcactgtggtcgcatcaggtactgttgtgggtgttgttctttacactggcagagaactccggagtgtcatgaatacctcaaatccccgaagtaagatcggcctgttcgacttggaagtgaactgcctcaccaagatcctctttggtgccctggtggtggtctcgctggtcatggttgcccttcagcactttgcaggccgttggtacctgcagatcatccgcttcctcctcttgttttccaacatcatccccattagtttgcgtgtgaacctggacatgggcaagatcgtgtacagctgggtgattcgaagggactcgaaaatccccgggaccgtggttcgctccagcacgattcctgagcagctgggcaggatttcgtacttactcacagacaagacaggcactcttacccagaacgagatgattttcaaacggctccatctcggaacagtagcctacggcctcgactcaatggacgaagtacaaagccacattttcagcatttacacccagcaatcccaggacccaccggctcagaagggcccaacgctcaccactaaggtccggcggaccatgagcagccgcgtgcacgaagccgtgaaggccatcgcgctctgccacaacgtgactcccgtgtatgagtccaacggtgtgactgatcaggctgaggccgagaagcagtacgaagactcctgccgcgtataccaggcatccagccccgatgaggtggccctggtacagtggacggaaagtgtgggcttaaccctggtgggccgagaccagtcttccatgcagctgaggacccctggcgaccagatcctgaacttcaccatcctacagatcttccctttcacctatgaaagcaaacgtatgggcatcatcgtgcgggatgaatcaactggagaaattacgttttacatgaagggagcagatgtggtcatggctggcattgtgcagtacaatgactggttggaggaagagtgtggcaacatggcccgagaagggctgcgggtgctcgtggtggcaaagaagtctcttgcagaggagcagtatcaggactttgaagcccgctacgtccaggccaagctgagtgtgcacgaccgctccctcaaagtggccacggtgatcgagagcctggagatggagatggaactgctgtgcctgacgggcgtggaggaccagctgcaggcagatgtgcggcccacgctggagaccctgaggaatgctggcatcaaggtttggatgctgacaggggacaagctggagacagctacgtgcacagcgaagaatgcacatctggtgaccagaaaccaagacatccacgtttttcggctggtgaccaaccgcggggaggctcacctcgagctgaacgccttccgcaggaagcatgattgtgccctggtcatctcgggagactccctggaggtttgcctcaagtactatgagtacgagttcatggagctggcctgccagtgcccggccgtagtctgctgccgatgtgcccccacccagaaggcccagatcgtgcgcctgcttcaggagcgcacgggcaagctcacctgtgcagtaggggacggaggcaatgacgtcagcatgattcaggaatctgactgcggcgtgggagtggaaggaaaggaaggaaaacaggcttcgttggctgcagacttctccatcactcaatttaagcatcttggccggttgcttatggtgcatggccggaacagctacaagcggtcagccgccctcagccagttcgtgattcacaggagcctctgtatcagcaccatgcaggctgtcttttcctccgtgttttactttgcctccgtccctctctatcaaggattcctcatcattgggtactccacaatttacaccatgtttcctgtgttttctctggtcctggacaaagatgtcaaatcggaagttgccatgctgtatcctgagctctacaaggatcttctcaagggacggccgttgtcctacaagacattcttaatatgggttttgattagcatctatcaagggagcaccatcatgtacggggcgctgctgctgtttgagtcggagttcgtgcacatcgtggccatctccttcacctcgctgatcctcaccgagctgctcatggtggcgctgaccatccagacctggcactggctcatgacagtggcggagctgctcagcctggcctgctacatcgcctccctggtgttcttacacgagttcatcgatgtgtacttcatcgccaccttgtcattcttgtggaaagtctccgtcatcactctggtcagctgcctccccctctatgtcctcaagtacctgcgaagacggttctctccccccagctactcaaagctcacatcataggccgtgcgttcgctggagggggccctggtcttggcgcttccctgatggacagagctcaagttccatttatattaaccgccacctgtggattttgcagtaattgctaacacatgcagttttaatgggaagtggctctgcgcctaaacggagtcctaacgctgcatcaacgggagggagggtcctgaaagagacccatctgggcctgtctgaacccctcgttcttcatgtttaggtgaatatgaatatgttaaagctggtggctcagctgggagatttatatgggtcactgtgcgagcttccttatgacttgaattttgttgtcacatgataaaagtttctgtgtagctgaaggttgtagaaggcttgtgtgtgtgtgtgtgtgtgtgtgtgtgtgtgtgtgtgtttttaaagagtcctaatgtgtatgtactctttatgtctttcttgctcttacaaagaggtgtcagaaaaatagaaagctcttggtgtcggtttgggaggaaaagacagtgacatttggtaaaaagttatccacacaataatctccattcggaaatgctcagtatcgtctccagccagccctgcttatccaggttacactggattcctgggatcgtaaccagtaaatgagaggagagggagagagagtgtcctaagtccaatctgttatccttgatctgattcagcatccatagtgtgtgagttaacttcacctgccacctcgtaaaagaatttcagaggtgtgatcccgctttattgggacctggtaacaatcacaaagccagtggctgtttgagaaggacctcagacattttcagcagagttgttttagcaggaaacgtgccactgaatggcccctaaatgtgtcgacagtgtgataagagactcaactaattctttaggcaacatggcagatgtgactcagatcctccaagaccaaagcggaaaggtcagggggctgggactcttctcttccatagaagcctgtttcctgttaggaggcataatggaagatgaccccacaaaggcagaggcatctttcggaacaacactggtggcagctttcagaacaaggaacccctggtgggaggacgcccaagctacagcgttgggatctgggatctgttccactgccggcagatttcaaggggaacttgctgaaaggcagccagtggtgaagatttctcccctcccaggatggactacatgccggcatgtttcttataaagctgtggctgcttgtttcagaggaagggagtttgcagtcgcgggacgtggtagagcaaggcattcttgggttttcaagttgcttcttgcagaagccacatatgcatgccataagggttaagttggtggatctttaagagccaagtgtggttgagatcttggatttgcgtttacttcttgatgaatacatatccttcaaaccctctgcctggcgctacttctgtgtgcttcagagatgtacatcacagcctggtttctgatgcctactaactcctgctcttggagagctggagacacgaggatcagatagtcccttgcctttggagcactcttgataagcttttgtattttgtgttgtccttttaaaatgttctagaatgactttacgttgcaggtactggttaattggctgttgacaccacatctattttgtcttatgattctgcagttttgcagtacttttctctatctgattcagccatttctgccagagggaaaaggtcggcagaaaagatgtattgagtgaatagttaaggataggatctttgtccaaaaatttcagaaagattgagcaaatctgacgtattcattgagtgagtttctgtgttttcaaaggtggaggagaaatttgtgctggaagtttttaagcctccgttttcttggaaatcagtctgtaacactggcaagtcttaagatagtcccatttagactttgcagatgctgaacctggctctgtaacgctgggaagtcttaagatagtcctgtttagactttgcaaaccctgtacctggctttgctcggagattcgggatgctggctcctgcaggcagggcgtgtgggagcctcgtcagaaagttttagaggtttccagcagaagcagaatgaagatggtctccctggccttttccttaattctcaattttgattgaggtgcacaagttgacttttaaagccaacgcttaagatactgattgacatcttcaagggagaatgctcccaggaggggctgaagaagccatagttggaagtggaaggtactcgtcagtgttctccacaaacctttttactctgttgtctcagccgcactggggcggaggcggtcaagggtgagaagtaccgacactcaagtgcaaactgccacgtcgttggcccatcccatcagtgggcagctggctgacgccattcactggacggtccctgaacacctaggaatgcacacaccgtgcttctcagacactggagacgcaaaggcaggaggatgcagtccggtgagaggacacgatctttacctgcacaatcagactgtaagcccagcagagaaccccaggggcgcctgggtacttctcggaggtcatcttagttgtggtggggaagacaaagaaataagcaaacaagaaactagagttactatacaagaaactctcctgagtttgtaaaccttaagcataaggattcagttgacctttttcttggttcatcaatctggaaagaacttacataaagcgccattgacactgtcacctgggagctccatgggccgtaagtctttgacagccaatttaatttgaggtcagagggccttgaggtacacagtcagcactgtttgaacacttttcctgaaagcaaaactcacagctccctgcgccctctgacaacactagctatttctgccagagtaagaacttctattactattttattattgttcatatgtcttttgatgatggttgtgtgacagggggaagcaggatctatttggtttcttcccctccccccaccccttcctttttgtctctctttttttttctctaagaaaatcaccagactagtttttccatcttgagtaatttcttatgtgggacagttttgatcctcattttgaaagcatgcgtgtgcacatgtgtgttgcctgtggtgccaggtgagacaggtggcactaactccagctgcttggaaggcatcccaagggcgcatcttaaagttggagcagacctcccttttccagcccctggggccattagaccacgtgctggaactagcattgtaaaattcccatcccagttccactcccctgaagtgaaacccttttttttttgtgacagtaaatcttaaaaatcattgtctctttatgaacatttcctcagtttcttctctgctgaaaatgtaagccatgctactttttaatgtattttgaattttgtgctcattggaaattgatatgctaatgcctcccccaccccccgccagacttttctttttatactttgtcttgtttttactggggtaggctgggcatgcgtgcgtgcctttagggcagcattttaaacctttgccaaaattgcaaatgggacatgtacattcttctgctccatcctacttaaacacctatcagctatttttatctttaaccttttctgtatgtttgaagtgtgtggggggtgtgtgtgtgtgtgaaagagcgagagaatgatgtcatctaaagttttttgaagaattatttggttttcattgcattaaaattctatcactcccagctttgttttcatttaaaaaaatatacaaagagctttgtaaatacaacacattttatttctcccccttcttttaatgtacagcttttttgccacttatatatacttaaaatattcccatgaattatgtccagttcttcttggaaaaaaatttggttttgaatgaacctgcaaagcatcctgcagcgtgagcagctcctccacctggagctccgaagcatcttctcaggccaaagcggcattacccgtgaatctgtcttctccgccacagcatggtttgaggcgcagtctgttaatatagctgggccatgtcagtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatgctttaatttagcaggaacttccagatgatttaaattctcgatgctgtgatgacacacatatgatctttcgtgtttctgagcgactctactttcattgtttgccagcgtggctcgttgctgttgcccaataaagcttgtgtacgttctgccttgggggattattttaatttgtacagaaacatgaattctggtatcaaaatgaggactttttattataacgctcctattttttctttatttcatggtacatgaaatgtaaagaaaactctttccagttcagaaaattattttgattttggcaaaaaaaaccccaaatcaatgcatgttatttattattttgtactattgtccatcccagacgtgtcagaatttcaaaaggtgatagatataaatggaaaataagatgaaaa

SEQ ID NO: 109761 - DNA, 3533 bp, Homo sapiens
  Payload ID: 1553
  Gene Symbol: ATP9B
  Gene Name: ATPase, class II, type 9B
  Uniprot ID: O43861
  ENST ID: ENST00000307671
  CDS Start-End: 15-3425
ggggcggtcggaacatggcggaccagatcccgctttacccggtgcgtagcgcagcggcggccgcagccaaccgcaaacgcgcggcctactacagcgccgcggggcccaggccgggagccgaccggcacagcaggtaccagctggaggatgagtctgcgcatttggatgaaatgccactaatgatgtctgaagaaggctttgagaatgaggaaagtgattaccacaccttaccacgagccaggataatgcaaaggaaaagaggactggagtggtttgtctgtgatggctggaagttcctctgtaccagttgctgtggttggctgataaatatttgtcgaagaaagaaagagctgaaagctcgcacagtatggcttggatgtcctgaaaagtgtgaagaaaaacatcccaggaattctataaaaaatcaaaaatacaatgtgtttacctttatacctggggttttgtatgaacaattcaagtttttcttgaatctctattttctagtaatatcctgctcacagtttgtaccagcattgaaaataggctatctctacacctactgggctcctctgggatttgtcttggctgttactatgacacgggaagcaattgatgaatttcggcgttttcagcgtgacaaggaagtgaattcacaactatatagcaagcttacagtaagaggtaaagtgcaagttaagagttcagacatacaagttggagacctcatcatagtggaaaagaatcaaagaattccatcggacatggtgtttcttaggacttcagaaaaagcaggttcgtgttttattcgaactgatcaactagatggtgaaactgactggaagctgaaggtggcagtgagctgcacgcaacagctgccggctctgggggaccttttttctatcagtgcttatgtttatgctcagaaaccacaaatggacattcacagtttcgaaggcacatttaccagggaagacagtgacccgcccattcatgaaagtctcagcatagaaaatacattgtgggcaagcaccattgttgcatcaggtactgtaataggtgttgtcatttataccggaaaagagactcgaagtgtaatgaacacatccaatccaaaaaataaggttggtttgttggaccttgaactcaatcggctgacgaaagcgctatttttggctttagttgctctttccattgttatggtaaccttacaaggatttgtgggtccatggtaccgcaatctttttcggttccttctcctcttttcttacatcattcccataagtttgcgtgtgaacttggacatgggcaaagcggtgtatggatggatgatgatgaaagatgagaacatccctggcacggtcgttcggaccagcactatcccagaggaacttgggcgcctggtgtatttattgacagacaaaacaggaaccctcacccagaatgaaatgatatttaagcggctgcacctgggcaccgtgtcctatggcgccgacacgatggatgagatccagagccatgtcagggactcctactcacagatgcagtctcaagctggtggaaacaatactggttcaactccactaagaaaagcccaatcttcagctcccaaagttaggaaaagtgtcagtagtcgaatccatgaagccgtgaaagccatcgtgctgtgtcacaacgtgacccccgtgtatgagtctcgggccggcgttactgaggagactgagttcgcagaggctgaccaagacttcagtgatgagaatcgcacctaccaggcttccagcccggatgaggtcgctctggtgcagtggacagagagtgtgggcctcacgctggtcagcagggacctcacctccatgcagctgaagacccccagtggccaggtcctcagcttctgcattctgcagctgtttcccttcacctccgagagcaagcggatgggcgtcatcgtcagggatgaatccacggcagaaatcacattctacatgaagggcgctgacgtggccatgtctcctatcgtgcagtataatgactggctggaagaggagtgcggaaacatggctcgcgaaggactgcggaccctcgtggttgcaaagaaggcgttgacagaggagcagtaccaggactttgagagccgatacactcaagccaagctgagcatgcacgacaggtccctcaaggtggccgcggtagtcgagagcctggagagggagatggaactgctgtgcctcaccggcgtggaggaccagctgcaggcagacgtgcggcccacgctggagatgctgcgcaacgccgggatcaagatatggatgctaacaggcgataaactcgagacagctacctgcattgccaaaagttcacatctcgtgtctagaacacaagatattcatattttcagacaggtaaccagtcggggagaggcacatttggagctgaatgcatttcgaaggaagcatgattgtgcactagtcatatctggggactctctggaggtttgtctaaagtactacgagcatgaatttgtggagctggcctgccagtgccctgccgtggtttgctgccgctgctcacccacccagaaggcccgcattgtgacactgctgcagcagcacacagggagacgcacctgcgccatcggtgatggaggaaatgatgtcagcatgattcaggcagcagactgtgggattgggattgagggaaaggagggtaaacaggcctcgctggcggccgacttctccatcacgcagttccggcacataggcaggctgctcatggtgcacgggcggaacagctacaagaggtcggcggcactcggccagttcgtcatgcacaggggccttatcatctccaccatgcaggctgtgttttcctcagtcttctacttcgcatccgtccctttgtatcagggcttcctcatggtggggtatgccaccatatacaccatgttcccagtgttctccttagtgctggaccaggacgtgaagccagagatggcgatgctctacccggagctgtacaaggacctcaccaagggaagatccttgtccttcaaaaccttcctcatctgggttttaataagtatttaccaaggcggcatcctcatgtatggggccctggtgctcttcgagtctgagttcgtccacgtggtggccatctccttcaccgcactgatcctgaccgagctgctgatggtggcgctgaccgtccgcacgtggcactggctgatggtggtggccgagttcctcagcttaggctgctacgtgtcctcactcgcttttctcaatgaatattttgatgttgcctttatcaccaccgtgaccttcctgtggaaagtgtcggcgatcaccgtggtcagctgcctcccgctgtatgtcctcaagtacctgaggcgcaagctctctcctcccagctactgcaagctggcctcctaaggggctgtgcacccccagcgggctggccccagcaccttctgcccttcccagcaccttgtgcccttgccagtgaacgcagggtttgccattgctaccaagcaagcacca

SEQ ID NO: 109762 - DNA, 4361 bp, Homo sapiens
  Payload ID: 1553
  Gene Symbol: ATP9B
  Gene Name: ATPase, class II, type 9B
  Uniprot ID: O43861
  ENST ID: ENST00000426216
  CDS Start-End: 18-3461
aaaggggcggtcggaacatggcggaccagatcccgctttacccggtgcgtagcgcagcggcggccgcagccaaccgcaaacgcgcggcctactacagcgccgcggggcccaggccgggagccgaccggcacagcaggtaccagctggaggatgagtctgcgcatttggatgaaatgccactaatgatgtctgaagaaggctttgagaatgaggaaagtgattaccacaccttaccacgagccaggataatgcaaaggaaaagaggactggagtggtttgtctgtgatggctggaagttcctctgtaccagttgctgtggttggctgataaatatttgtcgaagaaagaaagagctgaaagctcgcacagtatggcttggatgtcctgaaaagtgtgaagaaaaacatcccaggaattctataaaaaatcaaaaatacaatgtgtttacctttatacctggggttttgtatgaacaattcaagtttttcttgaatctctattttctagtaatatcctgctcacagtttgtaccagcattgaaaataggctatctctacacctactgggctcctctgggatttgtcttggctgttactatgacacgggaagcaattgatgaatttcggcgttttcagcgtgacaaggaagtgaattcacaactatatagcaagcttacagtaagaggtaaagtgcaagttaagagttcagacatacaagttggagacctcatcatagtggaaaagaatcaaagaattccatcggacatggtgtttcttaggacttcagaaaaagcaggttcgtgttttattcgaactgatcaactagatggtgaaactgactggaagctgaaggtggcagtgagctgcacgcaacagctgccggctctgggggaccttttttctatcagtgcttatgtttatgctcagaaaccacaaatggacattcacagtttcgaaggcacatttaccagggaagacagtgacccgcccattcatgaaagtctcagcatagaaaatacattgtgggcaagcaccattgttgcatcaggtactgtaataggtgttgtcatttataccggaaaagagactcgaagtgtaatgaacacatccaatccaaaaaataaggttggtttgttggaccttgaactcaatcggctgacgaaagcgctatttttggctttagttgctctttccattgttatggtaaccttacaaggatttgtgggtccatggtaccgcaatctttttcggttccttctcctcttttcttacatcattcccataagtttgcgtgtgaacttggacatgggcaaagcggtgtatggatggatgatgatgaaagatgagaacatccctggcacggtcgttcggaccagcactatcccagaggaacttgggcgcctggtgtatttattgacagacaaaacaggaaccctcacccagaatgaaatgatatttaagcggctgcacctgggcaccgtgtcctatggcgccgacacgatggatgagatccagagccatgtcagggactcctactcacagatgcagtctcaagctggtggaaacaatactggttcaactccactaagaaaagcccaatcttcagctcccaaagttaggaaaagtgtcagtagtcgaatccatgaagccgtgaaagccatcgtgctgtgtcacaacgtgacccccgtgtatgagtctcgggccggcgttactgaggagactgagttcgcagaggctgaccaagacttcagtgatgagaatcgcacctaccaggcttccagcccggatgaggtcgctctggtgcagtggacagagagtgtgggcctcacgctggtcagcagggacctcacctccatgcagctgaagacccccagtggccaggtcctcagcttctgcattctgcagctgtttcccttcacctccgagagcaagcggatgggcgtcatcgtcagggatgaatccacggcagaaatcacattctacatgaagggcgctgacgtggccatgtctcctatcgtgcagtataatgactggctggaagaggagtgcggaaacatggctcgcgaaggactgcggaccctcgtggttgcaaagaaggcgttgacagaggagcagtaccaggactttgagagccgatacactcaagccaagctgagcatgcacgacaggtccctcaaggtggccgcggtagtcgagagcctggagagggagatggaactgctgtgcctcaccggcgtggaggaccagctgcaggcagacgtgcggcccacgctggagatgctgcgcaacgccgggatcaagatatggatgctaacaggcgataaactcgagacagctacctgcattgccaaaagttcacatctcgtgtctagaacacaagatattcatattttcagacaggtaaccagtcggggagaggcacatttggagctgaatgcatttcgaaggaagcatgattgtgcactagtcatatctggggactctctggaggtttgtctaaagtactacgagcatgaatttgtggagctggcctgccagtgccctgccgtggtttgctgccgctgctcacccacccagaaggcccgcattgtgacactgctgcagcagcacacagggagacgcacctgcgccatcggtgatggaggaaatgatgtcagcatgattcaggcagcagactgtgggattgggattgagggaaaggagggtaaacaggcctcgctggcggccgacttctccatcacgcagttccggcacataggcaggctgctcatggtgcacgggcggaacagctacaagaggtcggcggcactcggccagttcgtcatgcacaggggccttatcatctccaccatgcaggctgtgttttcctcagtcttctacttcgcatccgtccctttgtatcagggcttcctcatggtggggtatgccaccatatacaccatgttcccagtgttctccttagtgctggaccaggacgtgaagccagagatggcgatgctctacccggagctgtacaaggacctcaccaagggaagatccttgtccttcaaaaccttcctcatctgggttttaataagtatttaccaaggcggcatcctcatgtatggggccctggtgctcttcgagtctgagttcgtccacgtggtggccatctccttcaccgcactgatcctgaccgagctgctgatggtggcgctgaccgtccgcacgtggcactggctgatggtggtggccgagttcctcagcttaggctgctacgtgtcctcactcgcttttctcaatgaatattttggtataggcagagtgtcttttggagctttcttagatgttgcctttatcaccaccgtgaccttcctgtggaaagtgtcggcgatcaccgtggtcagctgcctcccgctgtatgtcctcaagtacctgaggcgcaagctctctcctcccagctactgcaagctggcctcctaaggggctgtgcacccccagcgggctggccccagcaccttctgcccttcccagcaccttgtgcccttgccagtgaacgcagggtttgccattgctaccaagcaagcaccacaagaaagggagggtacgccaggcgagcccagggcacagatgctgagacagcctctccttctcagtgcagggacgtcacccctgccaggcaagcccagggcacagatgccaggatggcttctccctctcagtgcgaggcttcacccctgccaggcaagcccagggcatagatgctgagacagcctctccctctcagtgcagggacgtcacccctgccaggcaagcccagggcacagaggccgggacggcctctccctctcagtgtgaggcttcacccatgctaggcaagcccagggcacagatgccgggatggcccctccctctcagtgcgggaacgtcacccctgccaggcaagcccagggcacagatgctgcgatggcctcttcctcttaagtgtggggcctcacccctgcttttctttctttttttgtattgtcaaaattgtatttccatattgaagcagcttgagtttctactgaaaatgagcccgaattatttcactattactgtaaagggttcatcttactctggcattctgagaattagactgaaagtttaatttctgcagttccctcatattcagattctttctttgatgttataacacaaagtcattcctactcaaatgtaataaaattgaggctccacggaggcccgtgtccacatcagctgcagctcccactcagacagacggcctgccccacagcctgccctttgctgaagataccctcgctttatacttgcatttcgcttttcagtaaaaacagtcaagttactgagttctcacataaa

SEQ ID NO: 109763 - DNA, 1507 bp, Homo sapiens
  Payload ID: 1553
  Gene Symbol: ATP9B
  Gene Name: ATPase, class II, type 9B
  ENST ID: ENST00000458297
  CDS Start-End: 1-1416
atgccactaatgatgtctgaagaaggctttgagaatgaggaaagtgattaccacaccttaccacgagccaggataatgcaaaggaaaagaggactggagtggtttgtctgtgatggctggaagttcctctgtaccagttgctgtggttggctgataaatatttgtcgaagaaagaaagagctgaaagctcgcacagtatggcttggatgtcctgaaaagtgtgaagaaaaacatcccaggaattctataaaaaatcaaaaatacaatgtgtttacctttatacctggggttttgtatgaacaattcaagtttttcttgaatctctattttctagtaatatcctgctcacagtttgtaccagcattgaaaataggctatctctacacctactgggctcctctgggatttgtcttggctgttactatgacacgggaagcaattgatgaatttcggcgttttcagcgtgacaaggaagtgaattcacaactatatagcaagcttacagtaagaggtaaagtgcaagttaagagttcagacatacaagttggagacctcatcatagtggaaaagaatcaaagaattccatcggacatggtgtttcttaggacttcagaaaaagcaggttcgtgttttattcgaactgatcaactagatggtgaaactgactggaagctgaaggtggcagtgagctgcacgcaacagctgccggctctgggggaccttttttctatcagtgcttatgtttatgctcagaaaccacaaatggacattcacagtttcgaaggcacatttaccagggaagacagtgacccgcccattcatgaaagtctcagcatagaaaatacattgtgggcaagcaccattgttgcatcaggtactgtaataggtgttgtcatttataccggaaaagagactcgaagtgtaatgaacacatccaatccaaaaaataaggttggtttgttggaccttgaactcaatcggctgacgaaagcgctatttttggctttagttgctctttccattgttatggtaaccttacaaggatttgtgggtccatggtaccgcaatctttttcggttccttctcctcttttcttacatcattcccataagtttgcgtgtgaacttggacatgggcaaagcggtgtatggatggatgatgatgaaagatgagaacatccctggcacggtcgttcggaccagcactatcccagaggaacttgggcgcctggtgtatttattgacagacaaaacaggggcctcacccctgcttttctttctttttttgtattgtcaaaattgtatttccatattgaagcagcttgagtttctactgaaaatgagcccgaattatttcactattactgtaaagggttcatcttactctggcattctgagaattagactgaaagtttaatttctgcagttccctcatattcagattctttctttgatgttataacacaaagtcattcctactcaaatgtaataaaattgaggctccacgg

SEQ ID NO: 109764 - DNA, 549 bp, Homo sapiens
  Payload ID: 1553
  Gene Symbol: ATP9B
  Gene Name: ATPase, class II, type 9B
  ENST ID: ENST00000589326
  CDS Start-End: 1-438
tgtcacaacgtgacccccgtgtatgagtctcgggccggcgttactgaggagactgagttcgcagaggctgaccaagacttcagtgatgagaatcgcacctaccaggcttccagcccggatgaggtcgctctggtgcagtggacagagagtgtgggcctcacgctggtcagcagggacctcacctccatgcagctgaagacccccagtggccaggtcctcagcttctgcattctgcagctgtttcccttcacctccgagagcaagcggatgggcgtcatcgtcagggatgaatccacggcagaaatcacattctacatgaagggcgctgacgtggccatgtctcctatcgtgcagtataatgactggctggaagaggagaggtcactattccaattcctaaacaggagacgggaagagacacagctgttggatgcataaagaagggtgctagacccacgcctctcctccagcccttcctgccatccctgcagcctccagtccaacgtcaaatacaatcaactggatgaattaaaaagaaattgcaaataa

SEQ ID NO: 109765 - DNA, 427 bp, Homo sapiens
  Payload ID: 1553
  Gene Symbol: ATP9B
  Gene Name: ATPase, class II, type 9B
  ENST ID: ENST00000588600
  CDS Start-End: 127-427
gcttggcggaggcggggaaggcccgcaggcggcgcctcagccggggttggcgctgaggggagagggcggggaaaaggtggcgaattgaggggaaagtgggaggggcgggaaaggggcggtcggaacatggcggaccagatcccgctttacccggtgcgtagcgcagcggcggccgcagccaaccgcaaacgcgcggcctactacagcgccgcggggcccaggccgggagccgaccggcacagcaggaacgagcatccggcacccttgtgcatgtaccctacaatgactgccaggcttggatggatgtccccactcctgacttggtctgccctgacaccacctgggcaatggggagagtgtcttcctacggctggggcgtgtgggagtccaggcttcacgcactctttgctgttcaatgtaggtacca

SEQ ID NO: 109766 - DNA, 1511 bp, Homo sapiens
  Payload ID: 1553
  Gene Symbol: ATP9B
  Gene Name: ATPase, class II, type 9B
  ENST ID: ENST00000588921
  CDS Start-End: 1-421
tatcatctccaccatgcaggctgtgttttcctcagtcttctacttcgcatccgtccctttgtatcagggcttcctcatggtggggtatgccaccatatacaccatgttcccagtgttctccttagtgctggaccaggacgtgaagccagagatggcgatgctctacccggagctgtacaaggacctcaccaagagccaacaagacggcaggtcaaacagaagacaacatgaacgtctaacctcaggcaccagtggacacgtgtgggacccaggcagcttcttcaggattcgggtgtcaggaaaaggcgcccgaaatgctgggaagatccttgtccttcaaaaccttcctcatctgggttttaataagtatttaccaaggcggcatcctcatgtatggggccctggtgctcttcgagtctgagttcgtccacgtggtggccatctccttcaccgcactgatcctgaccgagctgctgatggtggcgctgaccgtccgcacgtggcactggctgatggtggtggccgagttcctcagcttaggctgctacgtgtcctcactcgcttttctcaatgaatattttggtataggcagagtgtcttttggagctttcttagatgttgcctttatcaccaccgtgaccttcctgtggaaagtgtcggcgatcaccgtggtcagctgcctcccgctgtatgtcctcaagtacctgaggcgcaagctctctcctcccagctactgcaagctggcctcctaaggggctgtgcacccccagcgggctggccccagcaccttctgcccttcccagcaccttgtgcccttgccagtgaacgcagggtttgccattgctaccaagcaagcaccacaagaaagggagggtacgccaggcgagcccagggcacagatgctgagacagcctctccttctcagtgcagggacgtcacccctgccaggcaagcccagggcacagatgccaggatggcttctccctctcagtgcgaggcttcacccctgccaggcaagcccagggcatagatgctgagacagcctctccctctcagtgcagggacgtcacccctgccaggcaagcccagggcacagaggccgggacggcctctccctctcagtgtgaggcttcacccatgctaggcaagcccagggcacagatgccgggatggcccctccctctcagtgcgggaacgtcacccctgccaggcaagcccagggcacagatgctgcgatggcctcttcctcttaagtgtggggcctcacccctgcttttctttctttttttgtattgtcaaaattgtatttccatattgaagcagcttgagtttctactgaaaatgagcccgaattatttcactattactgtaaagggttcatcttactctggcattctgagaattagactgaaagtttaatttctgcagttccctcatattcagattctttctttgatgttataacacaaagtcattcctactcaaatgtaataaaattgaggctccacgga

SEQ ID NO: 109767 - DNA, 344 bp, Homo sapiens
  Payload ID: 1553
  Gene Symbol: ATP9B
  Gene Name: ATPase, class II, type 9B
  ENST ID: ENST00000587878
  CDS Start-End: 1-56
aaaatacattgtgggcaagcaccattgttgcatcaggttggtttgttggaccttgaactcaatcggctgacgaaagcgctatttttggctttagttgctctttccattgttatggtaaccttacaaggatttgtgggtccatggtaccgcaatctttttcggttccttctcctcttttcttacatcattcccataagtttgcgtgtgaacttggacatgggcaaagcggtgtatggatggatgatgatgaaagatgagaacatccctggcacggtcgttcggaccagcactatcccagaggaacttgggcgcctggtgtatttattgacagacaaaacaggtac

SEQ ID NO: 109768 - DNA, 467 bp, Homo sapiens
  Payload ID: 1553
  Gene Symbol: ATP9B
  Gene Name: ATPase, class II, type 9B
  ENST ID: ENST00000588895
  CDS Start-End: 1-242
agtgcggaaacatggctcgcgaaggactgcggaccctcgtggttgcaaagaaggcgttgacagaggagcagtaccaggactttgaggtccctcaaggtggccgcggtagtcgagagcctggagagggagatggaactgctgtgcctcaccggcgtggaggaccagctgcaggcagacgtgcggcccacgctggagatgctgcgcaacgccgggatcaagatatggatgctaacaggcgataaactcgagacagctacctgcattgccaaaagttcacatctcgtgtctagaacacaagatattcatattttcagacaggtaaccagtcggggagaggcacatttggagctgaatgcatttcgaaggaagcatgattgtgcactagtcatatctggggactctctggaggtttgtctaaagtactacgagcatgaatttgtggagctggcctgccagtgccctgccgt

SEQ ID NO: 109769 - DNA, 1650 bp, Homo sapiens
  Payload ID: 1553
  Gene Symbol: ATP9B
  Gene Name: ATPase, class II, type 9B
  ENST ID: ENST00000586722
  CDS Start-End: 4-570
aacatggcggaccagatcccgctttacccggtgcgtagcgcagcggcggccgcagccaaccgcaaacgcgcggcctactacagcgccgcggggcccaggccgggagccgaccggcacagcaggtaccagctggaggatgagtctgcgcatttggatgaaatgccactaatgatgtctgaagaaggctttgagaatgaggaaagtgattaccacaccttaccacgagccaggataatgcaaaggaaaagaggactggagtggtttgtctgtgatggctggaagttcctctgtaccagttgctgtggttggctgataaatatttgtcgaagaaagaaagagctgaaagctcgcacagtatggcttggatgtcctgaaaagtgtgaagaaaaacatcccaggaattctataaaaaatcaaaaatacaatgtgtttacctttatacctggggttttgtatgaacaattcaagtttttcttgaatctctattttctagtaatatcctgctcacagtttgtaccagcattgaaaataggctatctctacacctactgggctcctctgatgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgaatgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttacagttcatatggaaccaaaaaagagtctgcatcgccaaatcaatcctaagccaaaagaacaaagctggaggcatcacactacctgacttcaaactatactacaaggctacagtaaccaaaacagcatggtactggtaccaaaacagagatatagatcaatggaacagaagagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcaataccattcaggacataggcatgggcaaggacttcatgtccaaaacaccaaaagcaatggcaacaaaagccaaaattgacaaatgggatctaattaaactcaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaa

SEQ ID NO: 109770 - DNA, 2845 bp, Homo sapiens
  Payload ID: 1553
  Gene Symbol: ATP9B
  Gene Name: ATPase, class II, type 9B
  ENST ID: ENST00000586366
  CDS Start-End: 20-889
ggaaaggggcggtcggaacatggcggaccagatcccgctttacccggtgcgtagcgcagcggcggccgcagccaaccgcaaacgcgcggcctactacagcgccgcggggcccaggccgggagccgaccggcacagcaggtaccagctggaggatgagtctgcgcatttggatgaaatgccactaatgatgtctgaagaaggctttgagaatgaggaaagtgattaccacaccttaccacgagccaggataatgcaaaggaaaagaggactggagtggtttgtctgtgatggctggaagttcctctgtaccagttgctgtggttggctgataaatatttgtcgaagaaagaaagagctgaaagctcgcacagtatggcttggatgtcctgaaaagtgtgaagaaaaacatcccaggaattctataaaaaatcaaaaatacaatgtgtttacctttatacctggggttttgtatgaacaattcaagtttttcttgaatctctattttctagtaatatcctgctcacagtttgtaccagcattgaaaataggctatctctacacctactgggctcctctgggatttgtcttggctgttactatgacacgggaagcaattgatgaatttcggcgttttcagcgtgacaaggaagtgaattcacaactatatagcaagcttacagtaagaggtaaagtgcaagttaagagttcagacatacaagttggagacctcatcatagtggaaaagaatcaaagaattccatcggacatggtgtttcttaggacttcagaaaaagcaggaccttttttctatcagtgcttatgtttatgctcagaaaccacaaatggacattcacagtttcgaaggcacatttaccagggaagacagtgacccgcccattcatgaaagtctcagcatagaaaatacattgtgggcaagcaccattgttgcatcaggttggtttgttggaccttgaactcaatcggctgacgaaagcgctatttttggctttagttgctctttccattgttatggtaaccttacaaggatttgtgggtccatggtaccgcaatctttttcggttccttctcctcttttcttacatcattcccataaggtaagtttaaaaatgaaaataaaacaaatgtctggtttcattgagtatgattttattgaatttatctttctcagtatgaaagaaattacccaaacaaagctagagaagtaggagccagaagttctgaggaatcttgaggaattcttctgtggaaatgttgttgggggagacgtcatcagtgccggtagaatgatctagaggtgccatactttcctgatagtgaatgtgttgatggtgtcttcttcaacaatcagaagatatttcctgatgaaacataaaccagaatttcacaaaattagttttgttttttgctgatagacttttaaatgtccagtgccctttgatctgtgtggaatcactggcattttaaagttctgtttaatatatctaatatctgtcaagttagataaaatattaaggctgtgttttagtagggactatcatttcagaatgttaacctatattataactacagattggaatataaatagttcatattagatgcctatttaatgtaaagactaatattttaccatataaacataaatccattttaaactattttctaaaatattttaagaaagatattcttaatatatatgatttaaaattttcataggaatgagcaactgaaacctaatgatggataaagtatgaatctagaatatctaccttttgtaacagagaatggactaaaacggtatagaatgcttaggctcaaggatgtagccactttgaagagaaagatatctctatttctaaaccagctttctccaaaatttgctctaaaaggtgatgtctcttccatttacttacgtcataaagtcagagctataatctgttcttgggatgtgtacacactgcactgccctcacaggcagtcaccaggaatgaatccagttgctctcacccagtctgttcgagaggtaggaaatcagcctcctttctgcccgtcacagtacagattcctgtggatgctgccttccatggtgttgctggttcacgggtggccaggcctgtgcagagagcacgcagcaaatagcaacttctcattgcggctgtgtaacttgctgctgacatagattttctgcactccataaagctgactgcagagatggctgttccagcctggcttgtggattaaacctaataaggcccagcttccccgctctcctctcccaccacactgcagctatccccatgtgccagctgcttcccaccctagctgtgtcctctgcttcagtgctcctctacctcatcattccatggctgggcttgtcttgtcactcggctcttaccctaaatacctttcctcagagaggctgcgtttgtctgctcagtacagaccaagaaacagccagccacttgctatcatagcagcctattgaattctgtgtagatctctatgacattcatcttgtttgttgcctgtttctctcttctcactaagccctgtgagaatagaggccttgtatgtcccgtttgttgttgtgtcctagttaggacctagaacggagcacgcttgggatgtggtagggcctctgtaagtatttgttgaatggacccattacaaaggccccatcctgctcagaggacccgagcgcagattgtcacagttcttgtgccggcatgtattgagtgccacaggtggactctggagacacaatctttgtcctcaaaataccccccgcccactggctaagtggcaataaacaaactataaccagaaa

SEQ ID NO: 109771 - DNA, 509 bp, Homo sapiens
  Payload ID: 1553
  Gene Symbol: ATP9B
  Gene Name: ATPase, class II, type 9B
  ENST ID: ENST00000587919
  CDS Start-End: 1-112
gctggaccaggacgtgaagccagagatggcgatgctctacccggagctgtacaaggacctcaccaagttcgccaaggtagcacagactgcagcactctgcgttgttgtctgatgatcggggcagctggagactggatgtgccaacgcagtttatccacaccggtcagtgtcagtggacaccaagtccccagtccgtcggctcaagctcctgcgatgtaggacaacatagccctgctctcaacaagtctgtattctagtcaggatgagaaagcagtgaatcagtggcatagagcaacagcataaagggccgcggcctgcagtggaagatccttgtccttcaaaaccttcctcatctgggttttaataagtatttaccaaggcggcatcctcatgtatggggccctggtgctcttcgagtctgagttcgtccacgtggtggccatctccttcaccgcactgatcctgaccgagctgctgatggtggcgctgaccgtccgcacgtggcactg

SEQ ID NO: 109772 - DNA, 1784 bp, Homo sapiens
  Payload ID: 1553
  Gene Symbol: ATP9B
  Gene Name: ATPase, class II, type 9B
  ENST ID: ENST00000590477
  CDS Start-End: 1-603
ctagtcatatctggggactctctggaggtttgtctaaagtactacgagcatgaatttgtggagctggcctgccagtgccctgccgtggtttgctgccgctgctcacccacccagaaggcccgcattgtgacactgctgcagcagcacacagggagacgcacctgcgccatcggtgatggaggaaatgatgtcagcatgattcaggcagcagactgtgggattgggattgagggaaaggagggtaaacaggcctcgctggcggccgacttctccatcacgcagttccggcacataggcaggctgctcatggtgcacgggcggaacagctacaagaggtcggcggcactcggccagttcgtcatgcacaggggccttatcatctccaccatgcaggtatgccaccatatacaccatgttcccagtgttctccttagtgctggaccaggacgtgaagccagagatggcgatgctctacccggagctgtacaaggacctcaccaagggaagatccttgtccttcaaaaccttcctcatctgggttttaataagtatttaccaaggcggcatcctcatgtatggggccctggtgctcttcgagtctgagttcgtccacgtggtggccatctccttcaccgcactgatcctgaccgagctgctgatggtggcgctgaccgtccgcacgtggcactggctgatggtggtggccgagttcctcagcttaggctgctacgtgtcctcactcgcttttctcaatgaatattttgatgttgcctttatcaccaccgtgaccttcctgtggaaagtgtcggcgatcaccgtggtcagctgcctcccgctgtatgtcctcaagtacctgaggcgcaagctctctcctcccagctactgcaagctggcctcctaaggggctgtgcacccccagcgggctggccccagcaccttctgcccttcccagcaccttgtgcccttgccagtgaacgcagggtttgccattgctaccaagcaagcaccacaagaaagggagggtacgccaggcgagcccagggcacagatgctgagacagcctctccttctcagtgcagggacgtcacccctgccaggcaagcccagggcacagatgccaggatggcttctccctctcagtgcgaggcttcacccctgccaggcaagcccagggcatagatgctgagacagcctctccctctcagtgcagggacgtcacccctgccaggcaagcccagggcacagaggccgggacggcctctccctctcagtgtgaggcttcacccatgctaggcaagcccagggcacagatgccgggatggcccctccctctcagtgcgggaacgtcacccctgccaggcaagcccagggcacagatgctgcgatggcctcttcctcttaagtgtggggcctcacccctgcttttctttctttttttgtattgtcaaaattgtatttccatattgaagcagcttgagtttctactgaaaatgagcccgaattatttcactattactgtaaagggttcatcttactctggcattctgagaattagactgaaagtttaatttctgcagttccctcatattcagattctttctttgatgttataacacaaagtcattcctactcaaatgtaataaaattgaggctccacggaggcccgtgtccacatcagctgcagctcccactcagacagacggcctgccccacagcctgccctttgctgaagataccctcgctttatacttgcatttcgcttttcagtaaaaacagtcaagtta

SEQ ID NO: 109773 - DNA, 583 bp, Homo sapiens
  Payload ID: 1553
  Gene Symbol: ATP9B
  Gene Name: ATPase, class II, type 9B
  ENST ID: ENST00000586672
  CDS Start-End: 6-583
ggaacatggcggaccagatcccgctttacccggtgcgtagcgcagcggcggccgcagccaaccgcaaacgcgcggcctactacagcgccgcggggcccaggccgggagccgaccggcacagcagttgctgtggttggctgataaatatttgtcgaagaaagaaagagctgaaagctcgcacagtatggcttggatgtcctgaaaagtgtgaagaaaaacatcccaggaattctataaaaaatcaaaaatacaatgtgtttacctttatacctggggttttgtatgaacaattcaagtttttcttgaatctctattttctagtaatatcctgctcacagtttgtaccagcattgaaaataggctatctctacacctactgggctcctctgggatttgtcttggctgttactatgacacgggaagcaattgatgaatttcggcgttttcagcgtgacaaggaagtgaattcacaactatatagcaagcttacagtaagaggtaaagtgcaagttaagagttcagacatacaagttggagacctcatcatagtggaaaagaatcaaagaattccatcggacatggt

SEQ ID NO: 109774 - DNA, 447 bp, Homo sapiens
  Payload ID: 1553
  Gene Symbol: ATP9B
  Gene Name: ATPase, class II, type 9B
  ENST ID: ENST00000589732
  CDS Start-End: 1-423
ttcagtgatgagaatcgcacctaccaggcttccagcccggatgaggtcgctctggtgcagtggacagagagtgtgggcctcacgctggtcagcagggacctcacctccatgcagctgaagacccccagtggccaggtcctcagcttctgcattctgcagctgtttcccttcacctccgagagcaagcggatgggcgtcatcgtcagggatgaatccacggcagaaatcacattctacatgaagggcgctgacgtggccatgtctcctatcgtgcagtataatgactggctggaagaggaggagacgggaagagacacagctgttggatgcataaagaagggtgctagacccacgcctctcctccagcccttcctgccatccctgcagcctccagtccaacgtcaaatacaatcaactggatgaattaaaaagaaattgcaaataata

SEQ ID NO: 109775 - DNA, 128 bp, Homo sapiens
  Payload ID: 1553
  Gene Symbol: ATP9B
  Gene Name: ATPase, class II, type 9B
  ENST ID: ENST00000619535
  CDS Start-End: 10-128
ggtcggaacatggcggaccagatcccgctttacccggtgcgtagcgcagcggcggccgcagccaaccgcaaacgcgcggcctactacagcgccgcggggcccaggccgggagccgaccggcacagcag

SEQ ID NO: 109776 - DNA, 138 bp, Homo sapiens
  Payload ID: 1553
  Gene Symbol: ATP9B
  Gene Name: ATPase, class II, type 9B
  ENST ID: ENST00000633900
  CDS Start-End: 20-138
ggaaaggggcggtcggaacatggcggaccagatcccgctttacccggtgcgtagcgcagcggcggccgcagccaaccgcaaacgcgcggcctactacagcgccgcggggcccaggccgggagccgaccggcacagcag

SEQ ID NO: 109777 - DNA, 124 bp, Homo sapiens
  Payload ID: 1553
  Gene Symbol: ATP9B
  Gene Name: ATPase, class II, type 9B
  ENST ID: ENST00000633276
  CDS Start-End: 6-124
ggaacatggcggaccagatcccgctttacccggtgcgtagcgcagcggcggccgcagccaaccgcaaacgcgcggcctactacagcgccgcggggcccaggccgggagccgaccggcacagcag

SEQ ID NO: 109778 - DNA, 122 bp, Homo sapiens
  Payload ID: 1553
  Gene Symbol: ATP9B
  Gene Name: ATPase, class II, type 9B
  ENST ID: ENST00000633385
  CDS Start-End: 4-122
aacatggcggaccagatcccgctttacccggtgcgtagcgcagcggcggccgcagccaaccgcaaacgcgcggcctactacagcgccgcggggcccaggccgggagccgaccggcacagcag

SEQ ID NO: 109779 - DNA, 133 bp, Homo sapiens
  Payload ID: 1553
  Gene Symbol: ATP9B
  Gene Name: ATPase, class II, type 9B
  ENST ID: ENST00000632485
  CDS Start-End: 15-133
ggggcggtcggaacatggcggaccagatcccgctttacccggtgcgtagcgcagcggcggccgcagccaaccgcaaacgcgcggcctactacagcgccgcggggcccaggccgggagccgaccggcacagcag

SEQ ID NO: 109780 - DNA, 421 bp, Homo sapiens
  Payload ID: 1553
  Gene Symbol: ATP9B
  Gene Name: ATPase, class II, type 9B
  ENST ID: ENST00000633932
  CDS Start-End: 127-421
gcttggcggaggcggggaaggcccgcaggcggcgcctcagccggggttggcgctgaggggagagggcggggaaaaggtggcgaattgaggggaaagtgggaggggcgggaaaggggcggtcggaacatggcggaccagatcccgctttacccggtgcgtagcgcagcggcggccgcagccaaccgcaaacgcgcggcctactacagcgccgcggggcccaggccgggagccgaccggcacagcaggaacgagcatccggcacccttgtgcatgtaccctacaatgactgccaggcttggatggatgtccccactcctgacttggtctgccctgacaccacctgggcaatggggagagtgtcttcctacggctggggcgtgtgggagtccaggcttcacgcactctttgctgttcaatgtag

SEQ ID NO: 109781 - DNA, 136 bp, Homo sapiens
  Payload ID: 1553
  Gene Symbol: ATP9B
  Gene Name: ATPase, class II, type 9B
  ENST ID: ENST00000633480
  CDS Start-End: 18-136
aaaggggcggtcggaacatggcggaccagatcccgctttacccggtgcgtagcgcagcggcggccgcagccaaccgcaaacgcgcggcctactacagcgccgcggggcccaggccgggagccgaccggcacagcag

SEQ ID NO: 109782 - DNA, 6680 bp, Homo sapiens
  Payload ID: 1554
  Gene Symbol: ATP10A
  Gene Name: ATPase, class V, type 10A
  Uniprot ID: O60312
  ENST ID: ENST00000356865
  CDS Start-End: 113-4612
ccgcaggcggggagctcgcaccgccgcgcccgggccgcgagtgatgataacctaagaggccggcgcgggcgggcgtgagcggcggaggagccgggcgcggcgacacgcggccatggagcgggagccggcggggaccgaggagcccgggcctccgggacggcggaggcgccgagagggcaggacgcgcacggtgcgctccaacctgctgccgcccccgggcgccgaggaccctgcggctggcgcggccaagggcgagcggcgacggcggcgcgggtgtgcccagcacctggccgacaaccggctcaagactaccaagtacacgctgctgtccttcctgcccaagaacctgttcgagcagttccaccgcccggccaacgtgtactttgtcttcatcgcgctgctcaacttcgtgccggcggtgaacgccttccagcccggcctggcactggcgccggtgctcttcatcctggccatcacggccttcagggacctgtgggaggactacagccgccaccgctccgaccacaagatcaaccacctgggctgcctggtcttcagcagggaagaaaagaaatacgtgaaccgattctggaaagaaatccacgtgggagactttgtgcgtcttcgctgcaacgaaatcttccctgcggacattctgctgctctcctccagtgaccccgacgggctatgccacatcgagaccgccaacctggatggagagaccaacctgaagcggcggcaggtggtccgcggcttctcggagcttgtctccgaattcaatcctttgacgttcaccagcgtgatcgaatgcgagaagccaaacaacgacctgagtaggtttcgcggctgcatcatacatgacaacgggaaaaaggccgggctgtataaagaaaacctgctgctgaggggctgcacccttaggaacacggacgcagtcgtcggcattgtcatctacgcaggacatgaaaccaaggctctgctgaacaacagtgggccccgctacaagcgcagcaagctggagaggcagatgaactgcgacgtgctctggtgtgtcctgctccttgtttgcatgtctctgttttcagcagtcggacatggactgtggatatggcggtatcaagagaagaagtcattattttatgtccccaagtctgatggaagctccttatccccagtcacagctgcagtttactcatttttaacaatgataatagttctgcaggttttgatcccaatttccttatacgtttccattgaaattgttaaagcatgccaagtgtacttcattaaccaggacatgcagttgtatgacgaagaaacagactcgcagctgcagtgccgagctctgaacatcacggaagacttaggacagatacagtacattttctcagataaaactggcactttgacagagaataagatggttttccgaagatgcactgtgtctggtgtagaatattctcatgatgcaaatgcgcagcgtctggccaggtaccaagaggcagactcggaggaggaggaggtggtgcccagagggggctcggtgtcccagcgcggcagcatcggcagccaccagagtgtccgggtggtgcacagaacccagagcaccaagtcccaccggcgcacgggcagccgggccgaggccaagagggccagcatgctgtccaagcacacggccttcagcagccccatggagaaggatatcacgcccgacccaaagctgctggagaaggtgagtgagtgtgacaagagcctagccgtggcgaggcatcaggagcacctgctggcccacctctcgcctgagctgtctgacgtctttgatttcttcatcgcactcaccatctgcaacacagtcgtcgtcacgtccccggatcagccacgaacaaaggtgagggtgaggtttgagctgaagtccccggtgaagacgatagaagacttcctgcggaggttcacacccagctgcctgacctcaggctgcagcagcatcgggagcctggccgccaacaagtccagccacaagttgggctccagcttcccgtccaccccgtccagcgacggcatgcttctcaggctggaggagaggctgggccagcccacctcggccatcgccagcaacggctacagcagccaggcggacaactgggcctcggagcttgctcaggagcaggagtcagagcgcgagctgcggtacgaggcggagagcccggatgaggccgcactggtgtatgcggccagagcctacaactgcgtgcttgtggagcggctgcacgaccaagtgtcagtggagctgccccacctgggcaggctcaccttcgagctcctgcacacactgggtttcgattccgtccgcaagaggatgtcagtggtgatccggcacccgcttaccgatgagatcaacgtctacaccaagggggccgactcagtggtcatggatctcctgcagccctgctcttcagttgacgccagagggaggcatcaaaaaaagattcggagcaaaactcagaattacctcaacgtgtatgcggcggaaggcctgcgcaccttgtgcatcgccaagagagttctgagtaaagaagagtatgcctgctggttgcaaagccacctagaagccgaatcctccctggaaaacagcgaggagctcctcttccagtctgccattcgcctggagaccaacctgcacttgttaggtgccactgggattgaagaccgcctgcaggacggagtccctgaaactatttctaaattgcgtcaagcgggcctgcagatttgggttctcactggtgacaaacaagaaacagctgtcaacattgcatatgcctgcaaactgctggaccacgacgaggaggtcatcaccctgaatgccacctcccaggaggcgtgtgcagccctgctagaccagtgcctatgctacgtgcagtccagaggcctccagagagcccctgagaagaccaagggcaaagtgagcatgaggttctcctctctctgcccaccctccacgtccactgcctctggccgcagacccagcctcgtgatcgatgggagaagcctggcctacgctctcgagaaaaacctggaggacaaattcctcttccttgccaagcagtgccgctccgtcctctgctgtcggtcgacgcctctgcagaagagcatggtggtgaagctggtgcggagcaagctcaaggccatgaccctggccataggtgatggagccaatgatgtcagcatgatccaggtggcagatgtgggtgtgggaatctccggccaggagggtatgcaggcagtgatggccagcgactttgcagtgccgaaattccgatacctggagaggctcttgattcttcacgggcattggtgctactcccgacttgccaacatggtgctgtacttcttctacaaaaacacaatgttcgtgggcctcctgttttggttccagtttttctgtggcttctctgcatctaccatgattgaccagtggtatctaatcttctttaatctgctcttctcgtcacttcccccgctcgtgactggggtgctggacagggatgtgccagccaatgtgctgctgaccaacccgcagctctacaagagtggccagaacatggaggaataccggccacgaacgttctggtttaacatggccgacgccgccttccagagcctggtttgcttttccattccttacctggcctactatgactcgaacgtggacctgtttacctgggggacccctattgtgacaatcgcgctgctcactttcctgctccacctgggcattgaaaccaaaacctggacctggctcaactggataacgtgtggcttcagtgtccttttgtttttcaccgtggctttgatttacaatgcgtcttgtgccacgtgctatcctccgtccaacccttactggactatgcaagccttactgggtgacccagtgttttacttgacttgcctgatgacgcctgtcgctgcactgctgcccagattgtttttcagatccctccaggggagggttttccccacacaacttcagctggcacgtcagttgaccaggaagtcccccaggagatgcagtgctcccaaagagacctttgctcagggacgcctcccgaaggactcgggaaccgagcactcatcagggaggacagtcaagacctctgtgcccctgtcccagccttcttggcacacacagcagccggtctgctccctggaggccagcggggagcccagcacagtggacatgagcatgccagtgagggagcacaccctgctggaggggctgagcgcaccggcccccatgtcctctgcgccaggggaggctgtcctgaggagtccaggagggtgtcctgaggagtccaaggtgagagctgccagcaccggcagggtgacccccctgtcttccctcttcagcctgcctaccttcagcttactcaactggatttcctcctggtcgctggtcagcaggctggggagtgtcttacagttctcccggacggagcagcttgcagatggacaagcgggacgtggacttcctgtccagccccactcaggccgatcaggacttcaagggccagaccacagactacttataggagcatcttcaaggcggtcacagtgaaaaccttgaaatggccttttttaatatatataaataaatgttaatattatttatgtttattatttgcacagaagagttctagggagatgtatttctaaatgtttcccaggctaatacaggaaacaagaggtaccaaaaaagaaagtttattttttaaaattctaagtagagtatattgaaaagaaaaagaagagccttaacatatataaaagtttaaagaagagtaacacttgaaaagtgtgtttagatttattttttcatctcatttttaagaacaagcagtacgatttgttttcttcaacatgtgtgactgcgcactgagtacaaatgtgtgactgctcatggttaatgcaggcaggtgtgaacatgggggaacaatgagcagagatggcagagggcagagcacatggcccccagaggcttccagtctcactgacacaggagggctgggctccacttcatccagatgaaggaaaggaagacctcaagaaaaattcacagttgagtgcatcccagcattctgttccgggcaggcatttcaggaagaccgccttgtaggtattacatccctggtgtcgtattttgcctgttaaatcgtaacaagcaataaacaactttcactttgcaaagacagtgtgtccagttaccactggtgtatgaaatgattaatacctgacctcacagagtatgatctcagggcacttccgtaaggcaagtccttttagaggctatgaagaaaacagctgcatggcacataccaaagctgctgcacagctggccaccatggcaccctgcaccaggccatcagcaccacgtgccaaggagctcagcggtcttcaggcatttttgtaatgagccattagttctgtccctctaaaactagaaaaggaagggcaggaaatgataacaacccaaggcaatgatatggcatgtcatcttccgagcccttctttctactttgtcaaacagttcttagttgctggctctgctcggcaccgggactgtgaagggtgtactccctgctgtgtgggagggacctagggcctctttggatgctgtcttcgaggacagcaatgcagagagggcataggatctgaggacaaggaaattcctcagcatggcgtatcaggaaagcatggctcattctgcaatgagccatgagtgtgggccatcgcaagtcacagaaaatgcacctcattccagtcaagcagaaaaacaggcacaggctcagtgtaggtcccaagagagggtgcctggactcagcaactcagacctgggcttttctcccagctttcagggacagctttgtcctgagtctgcctctgttcacggggatgcttggctggagtcacccccaggacttatccatgcatcactattcagaagacacagagggcccctctctccacattccaaacagagtcctggtttcctcagcctcaccctgcatagcttgcacaacatcctcagaaccattcactggcaaatggaggggaacgtgctgactgggactcccagctggagctgggaggagaggtccacttcccttagaacacctgagctgctgcatgagtggacgtcagaagaatctctatgccctgttaaatggggagacaaaggggtggtgggggcttcagccagtgatttcggaccgaaggtgacagccgtcccaaccctgcccagcctgatgccacctcctctgttcttggaacaacgcataggaaaagaatctcctttggaaggtgacactgctccctgaattaaggtaatggttgcgagcaccaagtacaaggactagacgcatatttacctgcgtatctgagagttccagattcccagcttccagatgatccttgcacagacaacctaccttctttccagaggatgtctttctcctctggagagtagatgcttgctcttgggaaacggaatgaccttggcgctggcttcaggaatatgcatcccacagccagtttagagaaatacatgttgtaaatggcattgacagctgctctttaggatggggagtattatggaaatccacaataacaatctatggcaagcaact

SEQ ID NO: 109783 - DNA, 1186 bp, Homo sapiens
  Payload ID: 1554
  Gene Symbol: ATP10A
  Gene Name: ATPase, class V, type 10A
  Uniprot ID: O60312
  ENST ID: ENST00000389967
  CDS Start-End: 263-730
aggataaggagacctctcaccttggggctgggcctgaaccagggaggggctgaagaaaatcagcaagctggttcccctcagggcctcaagggacctctgcctgaggaatcagcatttggctttgtaagcaccaggagtactcctggaagctccagggcggggagctcgcaccgccgcgcccgggccgcgagtgatgataacctaagaggccggcgcgggcgggcgtgagcggcggaggagccgggcgcggcgacacgcggccatggagcgggagccggcggggaccgaggagcccgggcctccgggacggcggaggcgccgagagggcaggacgcgcacggtgcgctccaacctgctgccgcccccgggcgccgaggaccctgcggctggcgcggccaagggcgagcggcgacggcggcgcgggtgtgcccagcacctggccgacaaccggctcaagactaccaagtacacgctgctgtccttcctgcccaagaacctgttcgagcagttccaccgcccggccaacgtgtactttgtcttcatcgcgctgctcaacttcgtgccggcggtgaacgccttccagcccggcctggcactggcgccggtgctcttcatcctggccatcacggccttcagggacctgtgggaggactacagccgccaccgctccgaccacaagatcaaccacctgggctgcctggtcttcagcagccgctcccacctgaagtgaaaggcaggaaaagccagcctggccccctggcctgaagtccctgcctcagtcttcggccaggcacagtggtctctgaacagccggcacaggacagtaaagctcagtctgctaacagctcggctcaggacagcagcaaagtgaaactgccgccaagtgctgatatgtctggcacggcccaggagagccccttggtagatccatcttggagctgtgtccagcagcctggaccacctcaaggccctgtccctgagaaaggatgcaggatgaacattacaaaatgctgatgaaaaatatcaaggaacatctgaataaatggagagacttcccatgttcatggatcggaaaatgaacataataacatacacaagcttattctacgtggaaaaacacaggtccaaaaatgtccacaagatttctcaaaaagaataataaagtggaagcactcacttctcccaa

SEQ ID NO: 109784 - DNA, 6766 bp, Homo sapiens
  Payload ID: 1554
  Gene Symbol: ATP10A
  Gene Name: ATPase, class V, type 10A
  ENST ID: ENST00000555815
  CDS Start-End: 200-1984
catggatcctttggattttgattccagttgatccctggagtaaggtcctaaccggggtctcccgaggtcgtttcgccgtccaggatggagcaggcggggagctcgcaccgccgcgcccgggccgcgagtgatgataacctaagaggccggcgcgggcgggcgtgagcggcggaggagccgggcgcggcgacacgcggccatggagcgggagccggcggggaccgaggagcccgggcctccgggacggcggaggcgccgagagggcaggacgcgcacggtgcgctccaacctgctgccgcccccgggcgccgaggaccctgcggctggcgcggccaagggcgagcggcgacggcggcgcgggtgtgcccagcacctggccgacaaccggctcaagactaccaagtacacgctgctgtccttcctgcccaagaacctgttcgagcagttccaccgcccggccaacgtgtactttgtcttcatcgcgctgctcaacttcgtgccggcggtgaacgccttccagcccggcctggcactggcgccggtgctcttcatcctggccatcacggccttcagggacctgtgggaggactacagccgccaccgctccgaccacaagatcaaccacctgggctgcctggtcttcagcagggaagaaaagaaatacgtgaaccgattctggaaagaaatccacgtgggagactttgtgcgtcttcgctgcaacgaaatcttccctgcggacattctgctgctctcctccagtgaccccgacgggctatgccacatcgagaccgccaacctggatggagagaccaacctgaagcggcggcaggtggtccgcggcttctcggagcttgtctccgaattcaatcctttgacgttcaccagcgtgatcgaatgcgagaagccaaacaacgacctgagtaggtttcgcggctgcatcatacatgacaacgggaaaaaggccgggctgtataaagaaaacctgctgctgaggggctgcacccttaggaacacggacgcagtcgtcggcattgtcatctacgcaggacatgaaaccaaggctctgctgaacaacagtgggccccgctacaagcgcagcaagctggagaggcagatgaactgcgacgtgctctggtgtgtcctgctccttgtttgcatgtctctgttttcagcagtcggacatggactgtggatatggcggtatcaagagaagaagtcattattttatgtccccaagtctgatggaagctccttatccccagtcacagctgcagtttactcatttttaacaatgataatagttctgcaggttttgatcccaatttccttatacgtttccattgaaattgttaaagcatgccaagtgtacttcattaaccaggacatgcagttgtatgacgaagaaacagactcgcagctgcagtgccgagctctgaacatcacggaagacttaggacagatacagtacattttctcagataaaactggcactttgacagagaataagatggttttccgaagatgcactgtgtctggtgtagaatattctcatgatgcaaatgcgcagcgtctggccaggtaccaagaggcagactcggaggaggaggaggtggtgcccagagggggctcggtgtcccagcgcggcagcatcggcagccaccagagtgtccgggtggtgcacagaacccagagcaccaagtcccaccggcgcacgggcagccgggccgaggccaagagggccagcatgctgtccaagcacacggccttcagcagccccatggagaaggatatcacgcccgacccaaagctgctggagaaggtgagtgagtgtgacaagagcctagccgtggcgaggcatcaggagcacctgctggcccacctctcgcctgagctgtctgacgtctttgatttcttcatcgcactcaccatctgcaacacagtcgtcgtcacgtccccggatcagccacgaacaaaggcaaggtgaggtttgagctgaagtccccggtgaagacgatagaagacttcctgcggaggttcacacccagctgcctgacctcaggctgcagcagcatcgggagcctggccgccaacaagtccagccacaagttgggctccagcttcccgtccaccccgtccagcgacggcatgcttctcaggctggaggagaggctgggccagcccacctcggccatcgccagcaacggctacagcagccaggcggacaactgggcctcggagcttgctcaggagcaggagtcagagcgcgagctgcggtacgaggcggagagcccggatgaggccgcactggtgtatgcggccagagcctacaactgcgtgcttgtggagcggctgcacgaccaagtgtcagtggagctgccccacctgggcaggctcaccttcgagctcctgcacacactgggtttcgattccgtccgcaagaggatgtcagtggtgatccggcacccgcttaccgatgagatcaacgtctacaccaagggggccgactcagtggtcatggatctcctgcagccctgctcttcagttgacgccagagggaggcatcaaaaaaagattcggagcaaaactcagaattacctcaacgtgtatgcggcggaaggcctgcgcaccttgtgcatcgccaagagagttctgagtaaagaagagtatgcctgctggttgcaaagccacctagaagccgaatcctccctggaaaacagcgaggagctcctcttccagtctgccattcgcctggagaccaacctgcacttgttaggtgccactgggattgaagaccgcctgcaggacggagtccctgaaactatttctaaattgcgtcaagcgggcctgcagatttgggttctcactggtgacaaacaagaaacagctgtcaacattgcatatgcctgcaaactgctggaccacgacgaggaggtcatcaccctgaatgccacctcccaggaggcgtgtgcagccctgctagaccagtgcctatgctacgtgcagtccagaggcctccagagagcccctgagaagaccaagggcaaagtgagcatgaggttctcctctctctgcccaccctccacgtccactgcctctggccgcagacccagcctcgtgatcgatgggagaagcctggcctacgctctcgagaaaaacctggaggacaaattcctcttccttgccaagcagtgccgctccgtcctctgctgtcggtcgacgcctctgcagaagagcatggtggtgaagctggtgcggagcaagctcaaggccatgaccctggccataggtgatggagccaatgatgtcagcatgatccaggtggcagatgtgggtgtgggaatctccggccaggagggtatgcaggcagtgatggccagcgactttgcagtgccgaaattccgatacctggagaggctcttgattcttcacgggcattggtgctactcccgacttgccaacatggtgctgtacttcttctacaaaaacacaatgttcgtgggcctcctgttttggttccagtttttctgtggcttctctgcatctaccatgattgaccagtggtatctaatcttctttaatctgctcttctcgtcacttcccccgctcgtgactggggtgctggacagggatgtgccagccaatgtgctgctgaccaacccgcagctctacaagagtggccagaacatggaggaataccggccacgaacgttctggtttaacatggccgacgccgccttccagagcctggtttgcttttccattccttacctggcctactatgactcgaacgtggacctgtttacctgggggacccctattgtgacaatcgcgctgctcactttcctgctccacctgggcattgaaaccaaaacctggacctggctcaactggataacgtgtggcttcagtgtccttttgtttttcaccgtggctttgatttacaatgcgtcttgtgccacgtgctatcctccgtccaacccttactggactatgcaagccttactgggtgacccagtgttttacttgacttgcctgatgacgcctgtcgctgcactgctgcccagattgtttttcagatccctccaggggagggttttccccacacaacttcagctggcacgtcagttgaccaggaagtcccccaggagatgcagtgctcccaaagagacctttgctcagggacgcctcccgaaggactcgggaaccgagcactcatcagggaggacagtcaagacctctgtgcccctgtcccagccttcttggcacacacagcagccggtctgctccctggaggccagcggggagcccagcacagtggacatgagcatgccagtgagggagcacaccctgctggaggggctgagcgcaccggcccccatgtcctctgcgccaggggaggctgtcctgaggagtccaggagggtgtcctgaggagtccaaggtgagagctgccagcaccggcagggtgacccccctgtcttccctcttcagcctgcctaccttcagcttactcaactggatttcctcctggtcgctggtcagcaggctggggagtgtcttacagttctcccggacggagcagcttgcagatggacaagcgggacgtggacttcctgtccagccccactcaggccgatcaggacttcaagggccagaccacagactacttataggagcatcttcaaggcggtcacagtgaaaaccttgaaatggccttttttaatatatataaataaatgttaatattatttatgtttattatttgcacagaagagttctagggagatgtatttctaaatgtttcccaggctaatacaggaaacaagaggtaccaaaaaagaaagtttattttttaaaattctaagtagagtatattgaaaagaaaaagaagagccttaacatatataaaagtttaaagaagagtaacacttgaaaagtgtgtttagatttattttttcatctcatttttaagaacaagcagtacgatttgttttcttcaacatgtgtgactgcgcactgagtacaaatgtgtgactgctcatggttaatgcaggcaggtgtgaacatgggggaacaatgagcagagatggcagagggcagagcacatggcccccagaggcttccagtctcactgacacaggagggctgggctccacttcatccagatgaaggaaaggaagacctcaagaaaaattcacagttgagtgcatcccagcattctgttccgggcaggcatttcaggaagaccgccttgtaggtattacatccctggtgtcgtattttgcctgttaaatcgtaacaagcaataaacaactttcactttgcaaagacagtgtgtccagttaccactggtgtatgaaatgattaatacctgacctcacagagtatgatctcagggcacttccgtaaggcaagtccttttagaggctatgaagaaaacagctgcatggcacataccaaagctgctgcacagctggccaccatggcaccctgcaccaggccatcagcaccacgtgccaaggagctcagcggtcttcaggcatttttgtaatgagccattagttctgtccctctaaaactagaaaaggaagggcaggaaatgataacaacccaaggcaatgatatggcatgtcatcttccgagcccttctttctactttgtcaaacagttcttagttgctggctctgctcggcaccgggactgtgaagggtgtactccctgctgtgtgggagggacctagggcctctttggatgctgtcttcgaggacagcaatgcagagagggcataggatctgaggacaaggaaattcctcagcatggcgtatcaggaaagcatggctcattctgcaatgagccatgagtgtgggccatcgcaagtcacagaaaatgcacctcattccagtcaagcagaaaaacaggcacaggctcagtgtaggtcccaagagagggtgcctggactcagcaactcagacctgggcttttctcccagctttcagggacagctttgtcctgagtctgcctctgttcacggggatgcttggctggagtcacccccaggacttatccatgcatcactattcagaagacacagagggcccctctctccacattccaaacagagtcctggtttcctcagcctcaccctgcatagcttgcacaacatcctcagaaccattcactggcaaatggaggggaacgtgctgactgggactcccagctggagctgggaggagaggtccacttcccttagaacacctgagctgctgcatgagtggacgtcagaagaatctctatgccctgttaaatggggagacaaaggggtggtgggggcttcagccagtgatttcggaccgaaggtgacagccgtcccaaccctgcccagcctgatgccacctcctctgttcttggaacaacgcataggaaaagaatctcctttggaaggtgacactgctccctgaattaaggtaatggttgcgagcaccaagtacaaggactagacgcatatttacctgcgtatctgagagttccagattcccagcttccagatgatccttgcacagacaacctaccttctttccagaggatgtctttctcctctggagagtagatgcttgctcttgggaaacggaatgaccttggcgctggcttcaggaatatgcatcccacagccagtttagagaaatacatgttgtaaatggcattgacagctgctctttaggatggggagtattatggaaatccacaataacaatctatggcaagcaact

SEQ ID NO: 109785 - DNA, 418 bp, Homo sapiens
  Payload ID: 1554
  Gene Symbol: ATP10A
  Gene Name: ATPase, class V, type 10A
  ENST ID: ENST00000555756
  CDS Start-End: 1-418
gccataggtgatggagccaatgatgtcagcatgatccaggtggcagatgtgggtgtgggaatctccggccaggagggtatgcaggagatgctgagggagacgacagcgatggagaccctggccggccacgctcgcactgtgttcagaatggggattttccttccctgttgtgtaccttgcattttgagaagagaagacaaatctgacgccaggtcggcatcaccagtaacaggaatccctctccctttgaaggcagtgatggccagcgactttgcagtgccgaaattccgatacctggagaggctcttgattcttcacgggcattggtgctactcccgacttgccaacatggtgctgtacttcttctacaaaaacacaatgttcgtgggcctcctgttttggttccagtttttctgtg

SEQ ID NO: 109786 - DNA, 988 bp, Homo sapiens
  Payload ID: 1554
  Gene Symbol: ATP10A
  Gene Name: ATPase, class V, type 10A
  Uniprot ID: O60312
  ENST ID: ENST00000619904
  CDS Start-End: 265-732
gaaggataaggagacctctcaccttggggctgggcctgaaccagggaggggctgaagaaaatcagcaagctggttcccctcagggcctcaagggacctctgcctgaggaatcagcatttggctttgtaagcaccaggagtactcctggaagctccagggcggggagctcgcaccgccgcgcccgggccgcgagtgatgataacctaagaggccggcgcgggcgggcgtgagcggcggaggagccgggcgcggcgacacgcggccatggagcgggagccggcggggaccgaggagcccgggcctccgggacggcggaggcgccgagagggcaggacgcgcacggtgcgctccaacctgctgccgcccccgggcgccgaggaccctgcggctggcgcggccaagggcgagcggcgacggcggcgcgggtgtgcccagcacctggccgacaaccggctcaagactaccaagtacacgctgctgtccttcctgcccaagaacctgttcgagcagttccaccgcccggccaacgtgtactttgtcttcatcgcgctgctcaacttcgtgccggcggtgaacgccttccagcccggcctggcactggcgccggtgctcttcatcctggccatcacggccttcagggacctgtgggaggactacagccgccaccgctccgaccacaagatcaaccacctgggctgcctggtcttcagcagccgctcccacctgaagtgaaaggcaggaaaagccagcctggccccctggcctgaagtccctgcctcagtcttcggccaggcacagtggtctctgaacagccggcacaggacagtaaagctcagtctgctaacagctcggctcaggacagcagcaaagtgaaactgccgccaagtgctgatatgtctggcacggcccaggagagccccttggtagatccatcttggagctgtgtccagcagcctggaccacctcaaggccctgtccctgagaaagg

SEQ ID NO: 109787 - DNA, 7566 bp, Homo sapiens
  Payload ID: 1555
  Gene Symbol: ATP10B
  Gene Name: ATPase, class V, type 10B
  Uniprot ID: O94823
  ENST ID: ENST00000327245
  CDS Start-End: 848-5233
tctttcactcttgggcctagcgaggcagcttatttttcctttttctttcattggtcacagttatttcttttcagtgtgtcatcttctctaagtttctgagggagtgttagcttgaggccttgccttgacataatcagatataatcagaaaaatgaaaaattccataggaaagagaactattttagccaaggtgtgcgagagaaataccgccactttcaagcactgttttcttctactggagtctgctcaatagggacgtcagctttgctggggcttcctttgacaagagaatcagaaccgactggtgacatttgtttcaatgaaagcaacagtgtgaagagtaagtagtttttcctattattcatctcactcagtggagataatgaactcctctccactgccaagatgagaaactaccatttcttacacatggacacaaagatgagaacaataaacactgagacttcaaaaaggagggaaggagaaagaggaacaagacttgaaatctacctatcagaacttgcaatttattctgatcaacaatttgcccagctaaagtactacatctgccccctcttcctgtggctgtaggggcacagcaaaggtcactggtctaacctccttaaagggactccgctaacagaaaccaccaaatggagtggagaaaaagaaaagggatcccctatccccaactccagccatctagattaagaaaagccagctgactggacagtagcacagcccagtcacctcatggacaaatttcctaggaaagaacctctcccatctattctacttatcactctcctttgaggttccggccacagatcttcgcctgctgctggaaatggccctctcagtggactcatcgtggcatcggtggcagtggagagtcagagatggcttcccccattgtccatcggaaaccacaccgctgctctctccagagaaagggagacagagctacaacttgacacagcagcgggtcgtgttccccaacaacagcatattccatcaagattgggaagaggtctccaggagataccctggcaacagaacctgcacaaccaaatacaccctcttcaccttcctgccccggaatctctttgagcaatttcatagatgggctaacctctatttcctgttcctggtgattttgaactggatgccctccatggaagtcttccacagagaaatcaccatgttaccattggccattgtcctgttcgtcatcatgatcaaggatggcatggaggacttcaagagacaccgctttgataaagcaataaactgctccaacattcgaatttatgaaagaaaagagcagacctatgtgcagaagtgctggaaggatgtgcgcgtgggagacttcatccaaatgaaatgcaatgagattgtcccagcagacatactcctccttttttcctctgaccccaatgggatatgccatctggaaactgccagcttggatggagagacaaacctcaagcaaagatgtgtcgtgaagggcttctcacagcaggaggtacagttcgaaccagagcttttccacaataccatcgtgtgtgagaaacccaacaaccacctcaacaaatttaagggttatatggagcatcctgaccagaccaggactggctttggctgtgagagtcttctgcttcgaggctgcaccatcagaaacaccgagatggctgttggcattgtcatctatgcaggccatgagacgaaagccatgctgaacaacagtggcccccggtacaaacgcagcaagattgagcggcgcatgaatatagacatcttcttctgcattgggatcctcatcctcatgtgccttattggagctgtaggtcacagcatctggaatgggacctttgaagaacaccctcccttcgatgtgccagatgccaatggcagcttccttcccagtgcccttgggggcttctacatgttcctcacaatgatcatcctgctccaggtgctgatccccatctctttgtatgtctccattgagctggtgaagctcgggcaagtgttcttcttgagcaatgaccttgacctgtatgatgaagagaccgatttatccattcaatgtcgagccctcaacatcgcagaggacttgggccagatccagtacatcttctccgataagacggggaccctgacagagaacaagatggtgttccgacgttgcaccatcatgggcagcgagtattctcaccaagaaaatgctaagcgactggagaccccaaaggagctggactcagatggtgaagagtggacccaataccaatgcctgtccttctcggctagatgggcccaggatccagcaactatgagaagccaaaaaggtgctcagcctctgaggaggagccagagtgcccgggtgcccatccagggccactaccggcaaaggtctatggggcaccgtgaaagctcacagcctcctgtggccttcagcagctccatagaaaaagatgtaactccagataaaaacctactgaccaaggttcgagatgctgccctgtggttggagaccttgtcagacagcagacctgccaaggcttccctctccaccacctcctccattgctgatttcttccttgccttaaccatctgcaactctgtcatggtgtccacaaccaccgagcccaggcagagggtcaccatcaaaccctcaagcaaggctctggggacgtccctggagaagattcagcagctcttccagaagttgaagctattgagcctcagccagtcattctcatccactgcaccctctgacacagacctcggggagagcttaggggccaacgtggccaccacagactcggatgagagagatgatgcatctgtgtgcagtggaggtgactccactgatgacggtggctacaggagcagcatgtgggaccagggcgacatcctggagtctgggtcaggcacttccttggaggaggcattggaggccccagccacagacctggccaggcctgagttctgttacgaggctgagagccctgatgaggccgccctggtgcacgctgcccatgcctacagcttcacactagtgtcccggacacctgagcaggtgactgtgcgcctgccccagggcacctgcctcaccttcagcctcctctgcaccctgggctttgactctgtcaggaagagaatgtctgtggttgtgaggcacccactgactggcgagattgttgtctacaccaagggtgctgactcggtcatcatggacctgctggaagacccagcctgcgtacctgacattaatatggaaaagaagctgagaaaaatccgagcccggacccaaaagcatctagacttgtatgcaagagatggcctgcgcacactatgcattgccaagaaggttgtaagcgaagaggacttccggagatgggccagtttccggcgtgaggctgaggcatccctcgacaaccgagatgagcttctcatggaaactgcacagcatctggagaatcaactcaccttacttggagccactgggatcgaagaccggctgcaggaaggagttccagatacgattgccactctgcgggaggctgggatccagctctgggtcctgactggagataagcaggagacagcggtcaacattgcccattcctgcagactgttaaatcagaccgacactgtttataccatcaatacagagaatcaggagacctgtgaatccatcctcaattgtgcattggaagagctaaagcaatttcgtgaactacagaagccagaccgcaagctctttggattccgcttaccttccaagacaccatccatcacctcagaagctgtggttccagaagctggattggtcatcgatgggaagacattgaatgccatcttccagggaaagctagagaagaagtttctggaattgacccagtattgtcggtccgtcctgtgctgccgctccacgccactccagaagagtatgatagtcaagctggtgcgagacaagttgcgcgtcatgaccctttccataggtgatggagcaaatgatgtaagcatgattcaagctgctgatattggaattggaatatctggacaggaaggcatgcaggctgtcatgtccagcgactttgccatcacccgctttaagcatctcaagaagttgctgctcgtgcatggccactggtgttactcgcgcctggccaggatggtggtgtactacctctacaagaacgtgtgctacgtcaacctgctcttctggtatcagttcttctgtggtttctccagctccaccatgattgattactggcagatgatattcttcaatctcttctttacctccttgcctcctcttgtctttggagtccttgacaaagacatctctgcagaaacactcctggcattgcctgagctatacaagagtggccagaactctgagtgctataacctgtcgactttctggatttctatggtggatgcattctaccagagcctcatctgtttctttatcccttacctggcctataagggctctgatatagatgtctttacctttgggacaccaatcaacaccatctccctcaccacaatccttttgcaccaggcaatggaaatgaagacatggaccattttccacggagtcgtgctcctcggcagcttcctgatgtactttctggtatccctcctgtacaatgccacctgcgtcatctgcaacagccccaccaatccctattgggtgatggaaggccagctctcaaaccccactttctacctcgtctgctttctcacaccagttgttgctcttctcccaagatactttttcctgtctctgcaaggaacttgtgggaagtctctaatctcaaaagctcagaaaattgacaaactccccccagacaaaagaaacctggaaatccagagttggagaagcagacagaggcctgcccctgtccccgaagtggctcgaccaactcaccacccagtgtcatctatcacaggacaggacttcagtgccagcaccccaaagagctctaaccctcccaagaggaagcatgtggaagagtcagtactccacgaacagagatgtggcacggagtgcatgagggatgactcatgctcaggggactcctcagctcaactctcatccggggagcacctgctgggacctaacaggataatggcctactcaagaggacagactgatatgtgccggtgctcaaagaggagcagccatcgccgatcccagagttcactgaccatatgaggagctgcagaaatctgtacaaactcaacagaggccacctagtcactggtccacataacccttgaccccttcttcttcatagaggaaacaatgtgccagtcttattcttttcttcaacaaccttgacttccatggaggaagtgctggccccaaggggtctgacacaaagacgggaaacccagtcggcctctagttttctgctgctctcaggcagcacatcttgcaaacagtttggagaaggaggctgtttttgttgaatcgagttctcaaatcggtttagaccaaagccattcttctgaccctctagataagcgtagcctacaacccagtgccgtaagtttccaagattcaagaagtgtatcaacccaggcaatatctcaggatatggaagtttctgggtttatttacccctcagtgcccagagttaaagtttcagaagagacttgtgcacataagggcttcatctcaagtgtattgcagtaatggctgaatcggggttaacatcccttccaggcacagcgagttggttctgctttttgcctgtaagccaaagaaaagccacatctaaaaagctactactaaaagccagaaagaaaagtggatttgaactcagtgtcacagactcttctgagtgttttagggtcacagctagtgtaagaggcatgaagaatagacatgcaaaagggaacgggtgcaccagagacccctgttttggctgacagaccatatgtcccaccagctggggaatctgacaagaggacataggtggcactctttttttaaagctatttattgtatctatttttaaataaaattgcccatcctcattcagctcttagaacaaaagcaaaaaaccctgtaaatcaggagatataagcacatctgcacccagaataggcccatatgatagggcaaccctgagcttaaacaatgacatcttcaagggtagaactaatctgaaaccccattcagcctattccagaatggggataggctgaaacccccttccagcctctggaagacactggcctgcatcagttagagtcagagcaagtgtcacttcacagggaaaagaaggattatatagacttcctatccctagagtttataaatgtcaactatataaaaaaagctcaaaacagtgttaaaggaatgaacagtagaattttaataggctgtccaaagaagccaggtctgctgtgggcaagtatagcctaaccctagtcttgtaaaataagccagaaagggttactgagccaccttaagctagtacctatatagtaggcaaaaagtacagaaatagatgcaataagtgtggtgagtctttgagcctacgagtcatgccaccagccataagttgacctatcacttgagaacctcctcagcaaagatgccagaaaacattcaatcaagttggcaaatgacacagggagctggccctctgaccatcttcctggcaaacctggactggaagggccatttgcagcactgtcctggagctaatacactgtttcactgcctctgccatataatgatgccagcactagccagctggtgggtatttggaggaatcctgcatgaggattgcccaataaggggcaggtacacatacctggcaaagtgatgatgatgtgaattgtttccagtgaggggattgagtcaaaacttggatctcaggtacctcaatttttcccccaatttctggctactactaaaagccagaaagaacagaacagtggcctcaggagatctgagtttgaatccttgctctctaggatgcaggtggcttgaagcagaatgccacacctgcaagttgattagaactgcctttcttcccaggcttgacataggtattaagtcaaaattacatgaaacccagtggtaaaaaagcctctgaaagctgtaacaccctcagtaataacaaaagggatttttatttcacagctaaagggaaaataggtggagaagttaaaaaataatgtctgatcctgttcctaagttccaaactatagccaacactctgatgctgctctttttcttgtaggaccaaccgtcccagtttgcctgggactttctcatttttacagagtcccaaatcctaggaaactggagcaactggtacaactggtcacctactcttgcccctctgtaaatcaagccaactgtgaccatccaatgtgccatcttacagggaaaagttataaccactattcccctataacataatgctaatgattgtacttagtacatttttatacttttatgatattttactgattggaaatgtcatcctttattaaaaataaacatggttttccatagttgcctgccaa

SEQ ID NO: 109788 - DNA, 2164 bp, Homo sapiens
  Payload ID: 1555
  Gene Symbol: ATP10B
  Gene Name: ATPase, class V, type 10B
  ENST ID: ENST00000520108
  CDS Start-End: 1-1671
gggcaagtgttcttcttgagcaatgaccttgacctgtatgatgaagagaccgatttatccattcaatgtcgagccctcaacatcgcagaggacttgggccagatccagtacatcttctccgataagacggggaccctgacagagaacaagatggtgttccgacgttgcaccatcatgggcagcgagtattctcaccaagaaaatgctaagcgactggagaccccaaaggagctggactcagatggtgaagagtggacccaataccaatgcctgtccttctcggctagatgggcccaggatccagcaactatgagaagccaaaaaggtgctcagcctctgaggaggagccagagtgcccgggtgcccatccagggccactaccggcaaaggtctatggggcaccgtgaaagctcacagcctcctgtggccttcagcagctccatagaaaaagatgtaactccagataaaaacctactgaccaaggttcgagatgctgccctgtggttggagaccttgtcagacagcagacctgccaaggcttccctctccaccacctcctccattgctgatttcttccttgccttaaccatctgcaactctgtcatggtgtccacaaccaccgagcccaggcagagggtcaccatcaaaccctcaagcaaggctctggggacgtccctggagaagattcagcagctcttccagaagttgaagctattgagcctcagccagtcattctcatccactgcaccctctgacacagacctcggggagagcttaggggccaacgtggccaccacagactcggatgagagagatgatgcatctgtgtgcagtggaggtgactccactgatgacggtggctacaggagcagcatgtgggaccagggcgacatcctggagtctgggtcaggcacttccttggaggaggcattggaggccccagccacagacctggccaggcctgagttctgttacgaggctgagagccctgatgaggccgccctggtgcacgctgcccatgcctacagcttcacactagtgtcccggacacctgagcaggtgactgtgcgcctgccccagggcacctgcctcaccttcagcctcctctgcaccctgggctttgactctgtcaggaagagaatgtctgtggttgtgaggcacccactgactggcgagattgttgtctacaccaagggtgctgactcggtcatcatggacctgctggaagacccagcctgcgtacctgacattaatatggaaaagaagctgagaaaaatccgagcccggacccaaaagcatctagacttgtatgcaagagatggcctgcgcacactatgcattgccaagaaggttgtaagcgaagaggacttccggagatgggccagtttccggcgtgaggctgaggcatccctcgacaaccgagatgagcttctcatggaaactgcacagcatctggagaatcaactcaccttacttggagccactgggatcgaagaccggctgcaggaaggagttccagatacgattgccactctgcgggaggctgggatccagctctgggtcctgactggagataagcaggagacagcggtcaacattgcccattcctgcagactgttaaatcagaccgacactgtttataccatcaatacagagaatcaggtgaggtgattctctgtattgatatctgcagatatcaacgtgtagagcaacccctcaaccaagaggacacaggcttctaggtgggatttgggtacaccagggaagcacccaacccccaacagatcactgaatcttggagtctagaggaccctggaagtcatccagcccaatatcctttatctcatccccacacatggctagctggtctcttttacattacttctggcactgcttgttagaaagttttacctctcccaaattctactattggtctagtctccccatttccccacagataaggaaactgaagactactggggctaagtctcttgctcaggtttaccctgcttatttctgataggtagaactaagtctagaactgagctagtgctatttacattctaccacactgtttgcttatggaaactcaactgtcggtttcttactatttaagactaacttatccattgaaaaagtcccaattaaattgaaattattcaga

SEQ ID NO: 109789 - DNA, 6655 bp, Homo sapiens
  Payload ID: 1556
  Gene Symbol: ATP10D
  Gene Name: ATPase, class V, type 10D
  Uniprot ID: Q9P241
  ENST ID: ENST00000273859
  CDS Start-End: 270-4550
gacgggaggaggagcggagggagaagtaggttgcgagctcagcacaggctccggcgctggctcccgcagctgagtttgggagatgtctaagtgattttttttttttcccggaaggcaaatggctggcgtggaagcacaacccgctttcactcttcgaatttgtgcttagctcttttcttgtaccttgcgactcgtgaccaacatgctgtgatgtgtgccgagggaggaattggtcagctacacaacctggatcttaccacagtttggatatgactgaggctctccaatgggccagatatcactggcgacggctgatcagaggtgcaaccagggatgatgattcagggccatacaactattcctcgttgctcgcctgtgggcgcaagtcctctcagacccctaaactgtcaggaaggcaccggattgttgttccccacatccagcccttcaaggatgagtatgagaagttctccggagcctatgtgaacaatcgaatacgaacaacaaagtacacacttctgaattttgtgccaagaaatttatttgaacaatttcacagagctgccaatttatatttcctgttcctagttgtcctgaactgggtacctttggtagaagccttccaaaaggaaatcaccatgttgcctctggtggtggtccttacaattatcgcaattaaagatggcctggaagattatcggaaatacaaaattgacaaacagatcaataatttaataactaaagtttatagtaggaaagagaaaaaatacattgaccgatgctggaaagacgttactgttggggactttattcgcctctcctgcaacgaggtcatccctgcagacatggtactactcttttccactgatccagatggaatctgtcacattgagacttctggtcttgatggagagagcaatttaaaacagaggcaggtggttcggggatatgcagaacaggactctgaagttgatcctgagaagttttccagtaggatagaatgtgaaagcccaaacaatgacctcagcagattccgaggcttcctagaacattccaacaaagaacgcgtgggtctcagtaaagaaaatttgttgcttagaggatgcaccattagaaacacagaggctgttgtgggcattgtggtttatgcaggccatgaaaccaaagcaatgctgaacaacagtgggccacggtataagcgcagcaaattagaaagaagagcaaacacagatgtcctctggtgtgtcatgcttctggtcataatgtgcttaactggcgcagtaggtcatggaatctggctgagcaggtatgaaaagatgcattttttcaatgttcccgagcctgatggacatatcatatcaccactgttggcaggattttatatgttttggaccatgatcattttgttacaggtcttgattcctatttctctctatgtttccatcgaaattgtgaagcttggacaaatatatttcattcaaagtgatgtggatttctacaatgaaaaaatggattctattgttcagtgccgagccctgaacatcgccgaggatctgggacagattcagtacctcttttccgataagacaggaaccctcactgagaataagatggtttttcgaagatgtagtgtggcaggatttgattactgccatgaagaaaatgccaggaggttggagtcctatcaggaagctgtctctgaagatgaagattttatagacacagtcagtggttccctcagcaatatggcaaaaccgagagcccccagctgcaggacagttcataatgggcctttgggaaataagccctcaaatcatcttgctgggagctcttttactctaggaagtggagaaggagccagtgaagtgcctcattccagacaggctgctttcagtagccccattgaaacagacgtggtaccagacaccaggcttttagacaaatttagtcagattacacctcggctctttatgccactagatgagaccatccaaaatccaccaatggaaactttgtacattatcgactttttcattgcattggcaatttgcaacacagtagtggtttctgctcctaaccaaccccgacaaaagatcagacacccttcactgggggggttgcccattaagtctttggaagagattaaaagtcttttccagagatggtctgtccgaagatcaagttctccatcgcttaacagtgggaaagagccatcttctggagttccaaacgcctttgtgagcagactccctctctttagtcgaatgaaaccagcttcacctgtggaggaagaggtctcccaggtgtgtgagagcccccagtgctccagtagctcagcttgctgcacagaaacagagaaacaacacggtgatgcaggcctcctgaatggcaaggcagagtccctccctggacagccattggcctgcaacctgtgttatgaggccgagagcccagacgaagcggccttagtgtatgccgccagggcttaccaatgcactttacggtctcggacaccagagcaggtcatggtggactttgctgctttgggaccattaacatttcaactcctacacatcctgccctttgactcagtaagaaaaagaatgtctgttgtggtccgacaccctctttccaatcaagttgtggtgtatacgaaaggcgctgattctgtgatcatggagttactgtcggtggcttccccagatggagcaagtctggagaaacaacagatgatagtaagggagaaaacccagaagcacttggatgactatgccaaacaaggccttcgtactttatgtatagcaaagaaggtcatgagtgacactgaatatgcagagtggctgaggaatcattttttagctgaaaccagcattgacaacagggaagaattactacttgaatctgccatgaggttggagaacaaacttacattacttggtgctactggcattgaagaccgtctgcaggagggagtccctgaatctatagaagctcttcacaaagcgggcatcaagatctggatgctgacaggggacaagcaggagacagctgtcaacatagcttatgcatgcaaactactggagccagatgacaagctttttatcctcaatacccaaagtaaagatgcctgtgggatgctgatgagcacaattttgaaagaacttcagaagaaaactcaagccctgccagagcaagtgtcattaagtgaagatttacttcagcctcctgtcccccgggactcagggttacgagctggactcattatcactgggaagaccctggagtttgccctgcaagaaagtctgcaaaagcagttcctggaactgacatcttggtgtcaagctgtggtctgctgccgagccacaccgctgcagaaaagtgaagtggtgaaattggtccgcagccatctccaggtgatgacccttgctattggtgatggtgccaatgatgttagcatgatacaagtggcagacattgggataggggtctcaggtcaagaaggcatgcaggctgtgatggccagtgactttgccgtttctcagttcaaacatctcagcaagctccttcttgtccatggacactggtgttatacacggctttccaacatgattctctattttttctataagaatgtggcctatgtgaacctccttttctggtaccagttcttttgtggattttcaggaacatccatgactgattactgggttttgatcttcttcaacctcctcttcacatctgcccctcctgtcatttatggtgttttggagaaagatgtgtctgcagagaccctcatgcaactgcctgaactttacagaagtggtcagaaatcagaggcatacttaccccataccttctggatcaccttattggatgctttttatcaaagcctggtctgcttctttgtgccttattttacctaccagggctcagatactgacatctttgcatttggaaaccccctgaacacagccgctctgttcatcgttctcctccatctggtcattgaaagcaagagtttgacttggattcacttgctggtcatcattggtagcatcttgtcttattttttatttgccatagtttttggagccatgtgtgtaacttgcaacccaccatccaacccttactggattatgcaggagcacatgctggatccagtattctacttagtttgtatcctcacgacgtccattgctcttctgcccaggtttgtatacagagttcttcagggatccctgtttccatctccaattctgagagctaagcactttgacagactaactccagaggagaggactaaagctctcaagaagtggagaggggctggaaagatgaatcaagtgacatcaaagtatgctaaccaatcagctggcaagtcaggaagaagacccatgcctggcccttctgctgtatttgcaatgaagtcagcaagttcctgtgctattgagcaaggaaacttatctctgtgtgaaactgctttagatcaaggctactctgaaactaaggcctttgagatggctggaccctccaaaggtaaagaaagctagataccctccttggagttgcaagtattctttcaaggttggaagagggattttgaagaggtatctctccaagcaagaatgacttgtttttccataagggacatgagcattttactaggcttggaagagctgacatgatgagcattattgtatgtttgtatatacatttgtgatagagggctagagtttgacctagagagagtttaaggaagtgaaatatttaattcagaaccaaatgcttttgtaaaactttttggattttgtaaaagcattttcattctcttagaaattcaagtattttcaaggggagtcatttgagatatatttattttactaggagatcttatattctagggaaatgctttaaatggtcaggctccagtcggaatttttttaagaaaaaagtagtttttaatacattggttaggactcagaggaaatacggaaaaaacattgtagatggttaatttacagataaaatcccaagagccttttaaacaacaaggtacctaaaatagggtataattatactgcttaaaatacagttagtgcctattaatagctttttatttcctatgggaagatgcttttggtcttctggctgaagatgtaggcatacctctcactcatttcaatgttttcctgaggtggagccttcattggaaaggggaaagagggattctagggtttcatcagggaccaggaatgcattcctctgtcaggttccaatcaagagaagaccttttatgagatctgcctctgtatagatgttgtcagttaggaaactgaagccataggtcaggcagacatcagctcagcctgtggcccattgggtgatttcctgtattttaaaactgacagtagcctgatcaaagtgatacaatcaatttcaaaacaatcttccagagaccacttgaaggttcatagtttttacaataccctgagacttttcaggtgttggagcctctaaaatatgagatataaacagaaactaatacaagttgttctctggaggtttctatgaggttcttagaaaaatttggttttaaaatcatttgaggacaggaatgtctatagcaagtttactcctattgcgaatcatgtatgctggctttagttgtaacaaacgattttattctaagtaaggccaggtgctactataaaatcatatattcctgttgaagttcttttgaagtcctatctctatttattatatttgaaagttgtcagccaccagtcatccagaatttccttcctgaatctccatgctcatatgcaatgtctacatcaaggtcttcttaatgactattattctcagggtttagttttctaccttctgcctactattttggtctgacatttttgtagccttctgttattattggaaatagtctcttacataagctgatttcgagaactttcaaaatctcacatagctaatggaagttgctttctgctttcttatgactgtttttataaataaactgtttcataaataatgtatactggaaaattgtcatcactcttgtaaacatttgccaaatccaactgtaattagtaccagaacttagaaggaaagtcacaaagcatgccttttaccagaatattgctttgccttttcttatatggaaaatcactgatgtcatatcatttattatcctcacagcagctggcattcattccctgaaatcgtcgtctcctgataaacaataatttagagatatgttcacttgtaaataaaaaggttagaatctaaggacaaagaatgatccaaaaatactaaggaaaaagaacaattttcaattttcagaaatgaattatctgtacatatgaatagaggaaaatactgagtgctaatgttacagggccacaatctcatatccacaattccaaaatctccaaacctctgaaaactgaaatatttttcataaattaggcgtaaattctatgccctgaacaaatgtaaagctatttatgtactttgcttaatgtaatcattcatatactttgctacaaaaatattaatatatttcattactgaatgctaaactgtatttctttttaaaatttggaaaatttttaattctgaaacacaatctagaccttag

SEQ ID NO: 109790 - DNA, 2550 bp, Homo sapiens
  Payload ID: 1556
  Gene Symbol: ATP10D
  Gene Name: ATPase, class V, type 10D
  ENST ID: ENST00000504445
  CDS Start-End: 259-1866
gagcggagggagaagtaggttgcgagctcagcacaggctccggcgctggctcccgcagctgagtttgggagatgtctaagtgattttttttttttcccggaaggcaaatggctggcgtggaagcacaacccgctttcactcttcgaatttgtgcttagctcttttcttgtaccttgcgactcgtgaccaacatgctgtgatgtgtgccgagggaggaattggtcagctacacaacctggatcttaccacagtttggatatgactgaggctctccaatgggccagatatcactggcgacggctgatcagaggtgcaaccagggatgatgattcagggccatacaactattcctcgttgctcgcctgtgggcgcaagtcctctcagacccctaaactgtcaggaaggcaccggattgttgttccccacatccagcccttcaaggatgagtatgagaagttctccggagcctatgtgaacaatcgaatacgaacaacaaagtacacacttctgaattttgtgccaagaaatttatttgaacaatttcacagagctgccaatttatatttcctgttcctagttgtcctgaactgggtacctttggtagaagccttccaaaaggaaatcaccatgttgcctctggtggtggtccttacaattatcgcaattaaagatggcctggaagattatcggaaatacaaaattgacaaacagatcaataatttaataactaaagtttatagtaggaaagagaaaaaatacattgaccgatgctggaaagacgttactgttggggactttattcgcctctcctgcaacgaggtcatccctgcagacatggtactactcttttccactgatccagatggaatctgtcacattgagacttctggtcttgatggagagagcaatttaaaacagaggcaggtggttcggggatatgcagaacaggactctgaagttgatcctgagaagttttccagtaggatagaatgtgaaagcccaaacaatgacctcagcagattccgaggcttcctagaacattccaacaaagaacgcgtgggtctcagtaaagaaaatttgttgcttagaggatgcaccattagaaacacagaggctgttgtgggcattgtggtttatgcaggccatgaaaccaaagcaatgctgaacaacagtgggccacggtataagcgcagcaaattagaaagaagagcaaacacagatgtcctctggtgtgtcatgcttctggtcataatgtgcttaactggcgcagtaggtcatggaatctggctgagcaggtatgaaaagatgcattttttcaatgttcccgagcctgatggacatatcatatcaccactgttggcaggattttatatgttttggaccatgatcattttgttacagcttggacaaatatatttcattcaaagtgatgtggatttctacaatgaaaaaatggattctattgttcagtgccgagccctgaacatcgccgaggatctgggacagattcagtacctcttttccgataagacaggaaccctcactgagaataagatggtttttcgaagatgtagtgtggcaggatttgattactgccatgaagaaaatgccaggaggttggagtcctatcaggaagctgtctctgaagatgaagattttatagacacagtcagtggttccctcagcaatatggcaaaaccgagagcccccagctgcaggacagttcataatgggcctttgggaaataagccctcaaatcatcttgctgggagctcttttactctaggaagtggagaaggagccagtgaagtgcctcattccagacaggctgctttcagtagccccattgtaagtatgaatgcatgactagagtcttgcacatccacaatgtatgatgagagaacagccttgtaattatgatagagtcaaactctgttgtcttttctaccttagaagagactacatgattgcagctcagcaagatcaccacacataattagaagtataaacaaacaatatcacactagtctacttttaaaaaataactcaatgttgagaggtagtataccatttctgaaaaaaaaaaaggagaatatttctggccagggctgattatgtgtgagcctgaagaaggctgccttggtttaagaatcatggctcactcttagaaccagcaaagcttaccagagttatctcgtagtcagataagcaagtgtaatttatagggacattcataggccatgtggtacattgaaggcctttttattgctctgtaatctcccaaatcccaccaaacttgtggtttttccctattcctggctccagaaggtcattttctaatatatcaatttcagagctcaacagaatgtgttcatgagttccagtgggaagtgtcaggaactgtctagtcacatccattaacaaatccattttactccagaaaaactagaggaccatgtagatgatggggaaaagagggaaaggtgctgtgtgaaaaaaattagaaatttttgctgtatttaaaattacctgtataaaagttcaatttcc

SEQ ID NO: 109791 - DNA, 4146 bp, Homo sapiens
  Payload ID: 1556
  Gene Symbol: ATP10D
  Gene Name: ATPase, class V, type 10D
  ENST ID: ENST00000503288
  CDS Start-End: 1-673
caatgttcccgagcctgatggacatatcatatcaccactgttggcaggattttatatgttttggaccatgatcattttgttacaggtcttgattcctatttctctctatgtttccatcgaaattgtgaagcttggacaaatatatttcattcaaagtgatgtggatttctacaatgaaaaaatggattctattgttcagtgccgagccctgaacatcgccgaggatctgggacagattcagtacctcttttccgataagacaggaaccctcactgagaataagatggtttttcgaagatgtagtgtggcaggatttgattactgccatgaagaaaatgccaggaggttggagtcctatcaggaagctgtctctgaagatgaagattttatagacacagtcagtggttccctcagcaatatggcaaaaccgagagcccccagctgcaggacagttcataatgggcctttgggaaataagccctcaaatcatcttgctgggagctcttttactctaggaagtggagaaggagccagtgaagtgcctcattccagacaggctgctttcagtagccccattgaaacagacgtggtaccagacaccagagcaggtcatggtggactttgctgctttgggaccattaacatttcaactcctacacatcctgccctttgactcagtaagaaaaagaatgtctgttgtggtccgacaccctctttccaatcaagttgtggtgtatacgaaaggcgctgattctgtgatcatggagttactgtcggtggcttccccagatggagcaagtctggagaaacaacagatgatagtaagggagaaaacccagaagcacttggatgactatgccaaacaaggccttcgtactttatgtatagcaaagaaggtcatgagtgacactgaatatgcagagtggctgaggaatcattttttagctgaaaccagcattgacaacagggaagaattactacttgaatctgccatgaggttggagaacaaacttacattacttggtgctactggcattgaagaccgtctgcaggagggagtccctgaatctatagaagctcttcacaaagcgggcatcaagatctggatgctgacaggggacaagcaggagacagctgtcaacatagcttatgcatgcaaactactggagccagatgacaagctttttatcctcaatacccaaagtaaagatgcctgtgggatgctgatgagcacaattttgaaagaacttcagaagaaaactcaagccctgccagagcaagtgtcattaagtgaagatttacttcagcctcctgtcccccgggactcagggttacgagctggactcattatcactgggaagaccctggagtttgccctgcaagaaagtctgcaaaagcagttcctggaactgacatcttggtgtcaagctgtggtctgctgccgagccacaccgctgcagaaaagtgaagtggtgaaattggtccgcagccatctccaggtgatgacccttgctattggtgatggtgccaatgatgttagcatgatacaagtggcagacattgggataggggtctcaggtcaagaaggcatgcaggctgtgatggccagtgactttgccgtttctcagttcaaacatctcagcaagctccttcttgtccatggacactggtgttatacacggctttccaacatgattctctattttttctataagaatgtggcctatgtgaacctccttttctggtaccagttcttttgtggattttcaggaacatccatgactgattactgggttttgatcttcttcaacctcctcttcacatctgcccctcctgtcatttatggtgttttggagaaagatgtgtctgcagagaccctcatgcaactgcctgaactttacagaagtggtcagaaatcagaggcatacttaccccataccttctggatcaccttattggatgctttttatcaaagcctggtctgcttctttgtgccttattttacctaccagggctcagatactgacatctttgcatttggaaaccccctgaacacagccgctctgttcatcgttctcctccatctggtcattgaaagcaagagtttgacttggattcacttgctggtcatcattggtagcatcttgtcttattttttatttgccatagtttttggagccatgtgtgtaacttgcaacccaccatccaacccttactggattatgcaggagcacatgctggatccagtattctacttagtttgtatcctcacgacgtccattgctcttctgcccaggtttgtatacagagttcttcagggatccctgtttccatctccaattctgagagctaagcactttgacagactaactccagaggagaggactaaagctctcaagaagtggagaggggctggaaagatgaatcaagtgacatcaaagtatgctaaccaatcagctggcaagtcaggaagaagacccatgcctggcccttctgctgtatttgcaatgaagtcagcaagttcctgtgctattgagcaaggaaacttatctctgtgtgaaactgctttagatcaaggctactctgaaactaaggcctttgagatggctggaccctccaaaggtaaagaaagctagataccctccttggagttgcaagtattctttcaaggttggaagagggattttgaagaggtatctctccaagcaagaatgacttgtttttccataagggacatgagcattttactaggcttggaagagctgacatgatgagcattattgtatgtttgtatatacatttgtgatagagggctagagtttgacctagagagagtttaaggaagtgaaatatttaattcagaaccaaatgcttttgtaaaactttttggattttgtaaaagcattttcattctcttagaaattcaagtattttcaaggggagtcatttgagatatatttattttactaggagatcttatattctagggaaatgctttaaatggtcaggctccagtcggaatttttttaagaaaaaagtagtttttaatacattggttaggactcagaggaaatacggaaaaaacattgtagatggttaatttacagataaaatcccaagagccttttaaacaacaaggtacctaaaatagggtataattatactgcttaaaatacagttagtgcctattaatagctttttatttcctatgggaagatgcttttggtcttctggctgaagatgtaggcatacctctcactcatttcaatgttttcctgaggtggagccttcattggaaaggggaaagagggattctagggtttcatcagggaccaggaatgcattcctctgtcaggttccaatcaagagaagaccttttatgagatctgcctctgtatagatgttgtcagttaggaaactgaagccataggtcaggcagacatcagctcagcctgtggcccattgggtgatttcctgtattttaaaactgacagtagcctgatcaaagtgatacaatcaatttcaaaacaatcttccagagaccacttgaaggttcatagtttttacaataccctgagacttttcaggtgttggagcctctaaaatatgagatataaacagaaactaatacaagttgttctctggaggtttctatgaggttcttagaaaaatttggttttaaaatcatttgaggacaggaatgtctatagcaagtttactcctattgcgaatcatgtatgctggctttagttgtaacaaacgattttattctaagtaaggccaggtgctactataaaatcatatattcctgttgaagttcttttgaagtcctatctctatttattatatttgaaagttgtcagccaccagtcatccagaatttccttcctgaatctccatgctcatatgcaatgtctacatcaaggtcttcttaatgactattattctcagggtttagttttctaccttctgcctactattttggtctgacatttttgtagccttctgttattattggaaatagtctcttacataagctgatttcgagaactttcaaaatctcacatagctaatggaagttgctttctgctttcttatgactgtttttataaataaactgtttcataaataatgtatactggaaaa

SEQ ID NO: 109792 - DNA, 8768 bp, Homo sapiens
  Payload ID: 1557
  Gene Symbol: ATP11A
  Gene Name: ATPase, class VI, type 11A
  ENST ID: ENST00000375630
  CDS Start-End: 89-3664
gcggccgcactagtaccccggagcccatgggcgcgccgagccgggcgcgggggcgctgaacggcggagcgggagcggccggaggagccatggactgcagcctcgtgcggacgctcgtgcacagatactgtgcaggagaagagaattgggtggacagcaggaccatctacgtgggacacagggagccacctccgggcgcagaggcctacatcccacagagatacccagacaacaggatcgtctcgtccaagtacacattttggaactttatacccaagaatttatttgaacaattcagaagagtagccaacttttatttccttatcatatttctggtgcagttgattattgatacacccacaagtccagtgacaagcggacttccactcttctttgtcattactgtgacggctatcaaacagggttatgaagactggcttcgacataaagcagacaatgccatgaaccagtgtcctgttcatttcattcagcacggcaagctcgttcggaaacaaagtcgaaagctgcgagttggggacattgtcatggttaaggaggacgagacctttccctgcgacttgatcttcctttccagcaaccggggagatgggacgtgccacgtcaccaccgccagcttggatggagaatccagccataaaacgcattacgcggtccaggacaccaaaggcttccacacagaggaggatatcggcggacttcacgccaccatcgagtgtgagcagccccagcccgacctctacaagttcgtgggtcgcatcaacgtttacagtgacctgaatgaccccgtggtgaggcccttaggatcggaaaacctgctgcttagaggagctacactgaagaacactgagaaaatctttggtgtggctatttacacgggaatggaaaccaagatggcattaaattatcaatcaaaatctcagaagcgatctgccgtggaaaaatcgatgaatgcgttcctcattgtgtatctctgcattctgatcagcaaagccctgataaacactgtgctgaaatacatgtggcagagtgagccctttcgggatgagccgtggtataatcagaaaacggagtcggaaaggcagaggaatctgttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggtggagtacatcttcacagacaagaccggcaccctcacggaaaacaacatggagttcaaggagtgctgcatcgaaggccatgtctacgtgccccacgtcatctgcaacgggcaggtcctcccagagtcgtcaggaatcgacatgattgactcgtcccccagcgtcaacgggagggagcgcgaggagctgtttttccgggccctctgtctctgccacaccgtccaggtgaaagacgatgacagcgtagacggccccaggaaatcgccggacggggggaaatcctgtgtgtacatctcatcctcgcccgacgaggtggcgctggtcgaaggtgtccagagacttggctttacctacctaaggctgaaggacaattacatggagatattaaacagggagaaccacatcgaaaggtttgaattgctggaaattttgagttttgactcagtcagaaggagaatgagtgtaattgtaaaatctgctacaggagaaatttatctgttttgcaaaggagcagattcttcgatattcccccgagtgatagaaggcaaagttgaccagatccgagccagagtggagcgtaacgcagtggaggggctccgaactttgtgtgttgcttataaaaggctgatccaagaagaatatgaaggcatttgtaagctgctgcaggctgccaaagtggcccttcaagatcgagagaaaaagttagcagaagcctatgagcaaatagagaaagatcttactctgcttggtgctacagctgttgaggaccggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctgtccggactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcagattgttaaattaatcaaattttcaaaagagcacccaatcacgttagcaattggcgatggtgcaaatgatgtcagcatgattctggaagcgcacgtgggcataggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataagaacgtctgcttcatcttccctcagtttttataccagttcttctgtgggttttcacaacagactttgtacgacaccgcgtatctgaccctctacaacatcagcttcacctccctccccatcctcctgtacagcctcatggagcagcatgttggcattgacgtgctcaagagagacccgaccctgtacagggacgtcgccaagaatgccctgctgcgctggcgcgtgttcatctactggacgctcctgggactgtttgacgcactggtgttcttctttggtgcttatttcgtgtttgaaaatacaactgtgacaagcaacgggcagatatttggaaactggacgtttggaacgctggtattcaccgtgatggtgttcacagttacactaaagcttgcattggacacacactactggacttggatcaaccattttgtcatctgggggtcgctgctgttctacgttgtcttttcgcttctctggggaggagtgatctggccgttcctcaactaccagaggatgtactacgtgttcatccagatgctgtccagcgggcccgcctggctggccatcgtgctgctggtgaccatcagcctccttcccgacgtcctcaagaaagtcctgtgccggcagctgtggccaacagcaacagagagagtccagaatgggtgcgcacagcctcgggaccgcgactcagaattcacccctcttgcctctctgcagagcccaggctaccagagcacctgtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtggttgttgagccacaccagtggcctctgggcattcggctcaacgcaggagggacattctgctggcccaccctgcgcgctgtcatgcagaggccattcccccaggcctgtgtcttcacccacctgccatcattggcctttgctgtcactgggagagaagagccgtccagggacccatggtggcccacatgtggatgccacatgctgctgtttcctgcttgcccggccaccacccatgccctccatagggtgaggtggagccatggtggtgcgtcctttactcaacaaccctccaatccggatgctgtgggaagggccgggtcactcggataccatcatccctgcggatgcaccgccgtaccctgctcatctgggagtggtttccctgcggttacgtccaagcccgcctgccctgtgtgttggggctggctgagtttcggtctccccatcaccggccgcctcgtggagaaggcagtgccacgtgggaggacaaggccacgccggcagcttccagccctgccgcagaagtgccaggatgtccatcagccactcgccagggcacggagccgtcagtccactgttacgggagaatgttgatttcgcgggtgcgagggccgggagacagatacttggctgtgatgagcagacatcctctgtccccgtggaggggtcaacaccaaggtggtgttcgtgcaccagaacctgtctcgggctgacgggggtggcacacaggacacgggtggatcccaacaggcagcaccgcacctctgcccgcctcccgcactgcagctccgcccgccgggctctgcgtccccacgtcccctcgtcccatccccacgtcccctcatcccgtcacctcgtccccacatccccttgccccgtcacctcgtcctcatgtccccttgtcctgtcacctcgtccccacgtcccctcgtctcctcatccccacgtcctctcgtccccttgtcccgtccccacataccctcgtccccatgtccccacgcagggctctccttcgtcttaggatctgtccagcgctgctctgggtgggttagcaaccccagggctgctgtgataggaagtccctgttgttctccgtactggcatttctatttctagaaataatatttgacatagccttaatggtccttaaagaagacatttcagtgtgagattcagacttcagacgctgaaactgctgcctttcaggaaagcaccaccaacgctggaggaggagccggccctcacgcccgccccgcgccacgctgtggaacggggctccggcaagtgaaacccagagggtgtttccgaggtgctcgacagtaggtatttttggaagctcagatttcaccatttgattgtataatcttttacctataaaatatttatttgaagtagagggtaaatcagcggtaagaacagtgaacacagtggttgggataaaataaggtgacaaacatcacaccaaagatgagggtagcgagcaactggcttgagcagacagaacggggaagactccactctgtcccgaggggccagccgcaggcgtccccagggccaccctgccctgaggtccttgtgtggccgccctggcttggcagccctgcccacgctgcccccgcaaacaatggtgtgtgcgtttttacagccctttttaggaacccaatatgggcataaatgtaacacctgtagcgggggcagattctctgtatgttcagttaacaaattatttgtaatgtatttttttagaaatcttaaaattgcctttgcactgaagtattttcatagctgtttatatctcttttattcatttatttaacatactgtctaattttaaaaataggtttttaaagctttcatttttaagtttatgaaattttggccactttacatttagattctggtgagagttttgactgaatgttccaatctctgatgaatgcgaattttcagatttgattttattctctacacacacctcttcttttcttggtatttctggtggcagtgattagttgaacagcacatttaaggcacgataatttgctacactttttctttacaatttgttgcaatttcatctgctttctatgtttcattgttaattgccatccttcagccttaaaaatagaagattctcacgtgaaggtttagtaagttgggtcccagctctgcctgtgtggagatagtcaccatgtacctctgacaacaagttttagtgtgaaagtcactaaacttttacacactcccaaacgtctttttaaaaattgcttgggaaattattaaatgaatgtgcctgatgatttgaaatagacaaggggcacgagataaaaaagaaaaggatgagaagatcctcagtgaatgacgttgcagggtcttcatgcaattttccacctcgcagtagttagtatttacttgccttaaactaactttgaagcaagtaatgtcaactttgagcactttgttgagttttgaaaaatcttatttgttgctgcacaggttaataaattatcaatttgtaattcagcatgttggtcagagacacggtcactgattcacacccagtccctgccacagaccgtctcagacacgcacagtgggcctgctgcatgattcacacccagtccctgccacagaccgtctcagacacgcacagtgggcctgctgcatgattcacacccagtccctgccacagaccgtctcagacacgcacagtgggcctgctgcatgcgtgttacctggcttttggctccacgctcactcatagccatgtccacatgggggcttgcacacaggatcactcacatatgtacatgtacccaccacaaacgtgcaagctcctgcacacatgcatgcacacaaacgtgtacacaagtgtgagctcctacacgcatacacacacacacgtgtacatgcaccaaagcatgtgtgacctacagacatgcagaacatgcacgtgtacacataccacagacacgcgtgtgcatgctcctacacaatacatatgcacatatcatgaacagcgtaagttcctacacacggacgtgtgatacacacatgcatgtacaggtaagcacacatgtacaagctcctacaggcttgctctcacacacgtgtatgcacagcagagagacgtatgagcttctactgcacacatgcacacacacacgcacacgtacattcactacaaacgtgcagcctcctgcacacgtgcacattcatgtgtacaccacaaatgagttcccagacgtgtaaacacacgtgcacacatcgtacacatgtgagctcccacacgtacacacagatgcacatggacacaccccaaacacgcacaggctcctacacacatgcacacacgtgtacaccacaaacgagctcccagacatgtaaacacacgtctcccacacgtgagctcccacacgtacacatgcacatgtacgcaccacaaacacatgcgcaggctcctgcaggcgtgaatacacacatgcacacacatatacacacatgtgccacaaacaagtgcacactgtcctggtgtcctgcactgcatcctgcctccttgctgaggggcccctgtgagaggcctctggatgggcatgggaagatgggctccctggcccccagcccatgcctccctgggatgaagagtccccctcctggcagaatgtctgggctttgcagagcaggccccgggggtgaagtcgcagcttcacttacaccagctgctctgtgagcaaggcttggtgccctggacaaggcccttcccctttagggaggtccagcctcgcaagctgaaacctcccctcggctcagccctataccaggcggccacagcaggactggccacacccacgccgcacctcatccgtgcacgcgtcggagcacggccagccttccgccacgagccagctgggaagggccgcggccgcctaaagccccagtcaacccagcctgtgtctgagcagacagggcgaacaagcaggccacaccgtctcgagggaggaggccagatgcggccagcgtctccaacagggtgaccatccgctcggcttgctgagcgtttaaacaaatgtttagacaggctgtggggactcccctgagttgagccttggccaggggtccggtgctgtcgcgggaaacctccagccttgttcttcaaaccactcagctcatgtgttttgcactgactagtactgaataatacaaccactcttatttaatgttagtattatttatttgacaactcagtgtctaacagcttgatatgcaggtccttgcatcctacatttctttaggaagttacccatttgtaactttaaaaacaggaaaaatatcagttggcaaatgcaatcttttttttttttaagctaaaggtgggtgaactggaatgaaaatctttctgatgttgtgtctataagcagccttgatgggatatgttagaagtgtcatgaaagtgtgattctacttttgcagaaaaatctaaagatcaatttatatagctttattttttactttatcaaagtatacagaattttaatatgcatatattgtgtctgacttaaaattataatgtctgcgtcaccatttaaaatgtctgttcattatgtaatgtaataaaagaaggtcttcaaaaatgtatttaacatgaatggtatccatagttgtcatcatcataaatactggagtttatttttaaattattaaacatagtaggtgcattaacataaatcagtctccacacagtaacatttaactgataattcattaatcagctttgaaaaattaaattgttaattaaaccaatctaacatttcagtaaagtttattttgtatgcttctgtttttaacttttatttctgtagataaactgactggataatattatattggacttttctctagattatctaagcaggagacctgaatctgcttgcaataaagaataaaagtctgcttcagtttctttataaagaaactcacacaa

SEQ ID NO: 109793 - DNA, 8795 bp, Homo sapiens
  Payload ID: 1557
  Gene Symbol: ATP11A
  Gene Name: ATPase, class VI, type 11A
  Uniprot ID: P98196
  ENST ID: ENST00000375645
  CDS Start-End: 89-3493
gcggccgcactagtaccccggagcccatgggcgcgccgagccgggcgcgggggcgctgaacggcggagcgggagcggccggaggagccatggactgcagcctcgtgcggacgctcgtgcacagatactgtgcaggagaagagaattgggtggacagcaggaccatctacgtgggacacagggagccacctccgggcgcagaggcctacatcccacagagatacccagacaacaggatcgtctcgtccaagtacacattttggaactttatacccaagaatttatttgaacaattcagaagagtagccaacttttatttccttatcatatttctggtgcagttgattattgatacacccacaagtccagtgacaagcggacttccactcttctttgtcattactgtgacggctatcaaacagggttatgaagactggcttcgacataaagcagacaatgccatgaaccagtgtcctgttcatttcattcagcacggcaagctcgttcggaaacaaagtcgaaagctgcgagttggggacattgtcatggttaaggaggacgagacctttccctgcgacttgatcttcctttccagcaaccggggagatgggacgtgccacgtcaccaccgccagcttggatggagaatccagccataaaacgcattacgcggtccaggacaccaaaggcttccacacagaggaggatatcggcggacttcacgccaccatcgagtgtgagcagccccagcccgacctctacaagttcgtgggtcgcatcaacgtttacagtgacctgaatgaccccgtggtgaggcccttaggatcggaaaacctgctgcttagaggagctacactgaagaacactgagaaaatctttggtgtggctatttacacgggaatggaaaccaagatggcattaaattatcaatcaaaatctcagaagcgatctgccgtggaaaaatcgatgaatgcgttcctcattgtgtatctctgcattctgatcagcaaagccctgataaacactgtgctgaaatacatgtggcagagtgagccctttcgggatgagccgtggtataatcagaaaacggagtcggaaaggcagaggaatctgttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggtggagtacatcttcacagacaagaccggcaccctcacggaaaacaacatggagttcaaggagtgctgcatcgaaggccatgtctacgtgccccacgtcatctgcaacgggcaggtcctcccagagtcgtcaggaatcgacatgattgactcgtcccccagcgtcaacgggagggagcgcgaggagctgtttttccgggccctctgtctctgccacaccgtccaggtgaaagacgatgacagcgtagacggccccaggaaatcgccggacggggggaaatcctgtgtgtacatctcatcctcgcccgacgaggtggcgctggtcgaaggtgtccagagacttggctttacctacctaaggctgaaggacaattacatggagatattaaacagggagaaccacatcgaaaggtttgaattgctggaaattttgagttttgactcagtcagaaggagaatgagtgtaattgtaaaatctgctacaggagaaatttatctgttttgcaaaggagcagattcttcgatattcccccgagtgatagaaggcaaagttgaccagatccgagccagagtggagcgtaacgcagtggaggggctccgaactttgtgtgttgcttataaaaggctgatccaagaagaatatgaaggcatttgtaagctgctgcaggctgccaaagtggcccttcaagatcgagagaaaaagttagcagaagcctatgagcaaatagagaaagatcttactctgcttggtgctacagctgttgaggaccggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctgtccggactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcagattgttaaattaatcaaattttcaaaagagcacccaatcacgttagcaattggcgatggtgcaaatgatgtcagcatgattctggaagcgcacgtgggcataggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataagaacgtctgcttcatcttccctcagtttttataccagttcttctgtgggttttcacaacagactttgtacgacaccgcgtatctgaccctctacaacatcagcttcacctccctccccatcctcctgtacagcctcatggagcagcatgttggcattgacgtgctcaagagagacccgaccctgtacagggacgtcgccaagaatgccctgctgcgctggcgcgtgttcatctactggacgctcctgggactgtttgacgcactggtgttcttctttggtgcttatttcgtgtttgaaaatacaactgtgacaagcaacgggcagatatttggaaactggacgtttggaacgctggtattcaccgtgatggtgttcacagttacactaaagcttgcattggacacacactactggacttggatcaaccattttgtcatctgggggtcgctgctgttctacgttgtcttttcgcttctctggggaggagtgatctggccgttcctcaactaccagaggatgtactacgtgttcatccagatgctgtccagcgggcccgcctggctggccatcgtgctgctggtgaccatcagcctccttcccgacgtcctcaagaaagtcctgtgccggcagctgtggccaacagcaacagagagagtccagactaagagccagtgcctttctgtcgagcagtcaaccatctttatgctttctcagacttccagcagcctgagtttctgatggaacaagagcccaggctaccagagcacctgtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtggttgttgagccacaccagtggcctctgggcattcggctcaacgcaggagggacattctgctggcccaccctgcgcgctgtcatgcagaggccattcccccaggcctgtgtcttcacccacctgccatcattggcctttgctgtcactgggagagaagagccgtccagggacccatggtggcccacatgtggatgccacatgctgctgtttcctgcttgcccggccaccacccatgccctccatagggtgaggtggagccatggtggtgcgtcctttactcaacaaccctccaatccggatgctgtgggaagggccgggtcactcggataccatcatccctgcggatgcaccgccgtaccctgctcatctgggagtggtttccctgcggttacgtccaagcccgcctgccctgtgtgttggggctggctgagtttcggtctccccatcaccggccgcctcgtggagaaggcagtgccacgtgggaggacaaggccacgccggcagcttccagccctgccgcagaagtgccaggatgtccatcagccactcgccagggcacggagccgtcagtccactgttacgggagaatgttgatttcgcgggtgcgagggccgggagacagatacttggctgtgatgagcagacatcctctgtccccgtggaggggtcaacaccaaggtggtgttcgtgcaccagaacctgtctcgggctgacgggggtggcacacaggacacgggtggatcccaacaggcagcaccgcacctctgcccgcctcccgcactgcagctccgcccgccgggctctgcgtccccacgtcccctcgtcccatccccacgtcccctcatcccgtcacctcgtccccacatccccttgccccgtcacctcgtcctcatgtccccttgtcctgtcacctcgtccccacgtcccctcgtctcctcatccccacgtcctctcgtccccttgtcccgtccccacataccctcgtccccatgtccccacgcagggctctccttcgtcttaggatctgtccagcgctgctctgggtgggttagcaaccccagggctgctgtgataggaagtccctgttgttctccgtactggcatttctatttctagaaataatatttgacatagccttaatggtccttaaagaagacatttcagtgtgagattcagacttcagacgctgaaactgctgcctttcaggaaagcaccaccaacgctggaggaggagccggccctcacgcccgccccgcgccacgctgtggaacggggctccggcaagtgaaacccagagggtgtttccgaggtgctcgacagtaggtatttttggaagctcagatttcaccatttgattgtataatcttttacctataaaatatttatttgaagtagagggtaaatcagcggtaagaacagtgaacacagtggttgggataaaataaggtgacaaacatcacaccaaagatgagggtagcgagcaactggcttgagcagacagaacggggaagactccactctgtcccgaggggccagccgcaggcgtccccagggccaccctgccctgaggtccttgtgtggccgccctggcttggcagccctgcccacgctgcccccgcaaacaatggtgtgtgcgtttttacagccctttttaggaacccaatatgggcataaatgtaacacctgtagcgggggcagattctctgtatgttcagttaacaaattatttgtaatgtatttttttagaaatcttaaaattgcctttgcactgaagtattttcatagctgtttatatctcttttattcatttatttaacatactgtctaattttaaaaataggtttttaaagctttcatttttaagtttatgaaattttggccactttacatttagattctggtgagagttttgactgaatgttccaatctctgatgaatgcgaattttcagatttgattttattctctacacacacctcttcttttcttggtatttctggtggcagtgattagttgaacagcacatttaaggcacgataatttgctacactttttctttacaatttgttgcaatttcatctgctttctatgtttcattgttaattgccatccttcagccttaaaaatagaagattctcacgtgaaggtttagtaagttgggtcccagctctgcctgtgtggagatagtcaccatgtacctctgacaacaagttttagtgtgaaagtcactaaacttttacacactcccaaacgtctttttaaaaattgcttgggaaattattaaatgaatgtgcctgatgatttgaaatagacaaggggcacgagataaaaaagaaaaggatgagaagatcctcagtgaatgacgttgcagggtcttcatgcaattttccacctcgcagtagttagtatttacttgccttaaactaactttgaagcaagtaatgtcaactttgagcactttgttgagttttgaaaaatcttatttgttgctgcacaggttaataaattatcaatttgtaattcagcatgttggtcagagacacggtcactgattcacacccagtccctgccacagaccgtctcagacacgcacagtgggcctgctgcatgattcacacccagtccctgccacagaccgtctcagacacgcacagtgggcctgctgcatgattcacacccagtccctgccacagaccgtctcagacacgcacagtgggcctgctgcatgcgtgttacctggcttttggctccacgctcactcatagccatgtccacatgggggcttgcacacaggatcactcacatatgtacatgtacccaccacaaacgtgcaagctcctgcacacatgcatgcacacaaacgtgtacacaagtgtgagctcctacacgcatacacacacacacgtgtacatgcaccaaagcatgtgtgacctacagacatgcagaacatgcacgtgtacacataccacagacacgcgtgtgcatgctcctacacaatacatatgcacatatcatgaacagcgtaagttcctacacacggacgtgtgatacacacatgcatgtacaggtaagcacacatgtacaagctcctacaggcttgctctcacacacgtgtatgcacagcagagagacgtatgagcttctactgcacacatgcacacacacacgcacacgtacattcactacaaacgtgcagcctcctgcacacgtgcacattcatgtgtacaccacaaatgagttcccagacgtgtaaacacacgtgcacacatcgtacacatgtgagctcccacacgtacacacagatgcacatggacacaccccaaacacgcacaggctcctacacacatgcacacacgtgtacaccacaaacgagctcccagacatgtaaacacacgtctcccacacgtgagctcccacacgtacacatgcacatgtacgcaccacaaacacatgcgcaggctcctgcaggcgtgaatacacacatgcacacacatatacacacatgtgccacaaacaagtgcacactgtcctggtgtcctgcactgcatcctgcctccttgctgaggggcccctgtgagaggcctctggatgggcatgggaagatgggctccctggcccccagcccatgcctccctgggatgaagagtccccctcctggcagaatgtctgggctttgcagagcaggccccgggggtgaagtcgcagcttcacttacaccagctgctctgtgagcaaggcttggtgccctggacaaggcccttcccctttagggaggtccagcctcgcaagctgaaacctcccctcggctcagccctataccaggcggccacagcaggactggccacacccacgccgcacctcatccgtgcacgcgtcggagcacggccagccttccgccacgagccagctgggaagggccgcggccgcctaaagccccagtcaacccagcctgtgtctgagcagacagggcgaacaagcaggccacaccgtctcgagggaggaggccagatgcggccagcgtctccaacagggtgaccatccgctcggcttgctgagcgtttaaacaaatgtttagacaggctgtggggactcccctgagttgagccttggccaggggtccggtgctgtcgcgggaaacctccagccttgttcttcaaaccactcagctcatgtgttttgcactgactagtactgaataatacaaccactcttatttaatgttagtattatttatttgacaactcagtgtctaacagcttgatatgcaggtccttgcatcctacatttctttaggaagttacccatttgtaactttaaaaacaggaaaaatatcagttggcaaatgcaatcttttttttttttaagctaaaggtgggtgaactggaatgaaaatctttctgatgttgtgtctataagcagccttgatgggatatgttagaagtgtcatgaaagtgtgattctacttttgcagaaaaatctaaagatcaatttatatagctttattttttactttatcaaagtatacagaattttaatatgcatatattgtgtctgacttaaaattataatgtctgcgtcaccatttaaaatgtctgttcattatgtaatgtaataaaagaaggtcttcaaaaatgtatttaacatgaatggtatccatagttgtcatcatcataaatactggagtttatttttaaattattaaacatagtaggtgcattaacataaatcagtctccacacagtaacatttaactgataattcattaatcagctttgaaaaattaaattgttaattaaaccaatctaacatttcagtaaagtttattttgtatgcttctgtttttaacttttatttctgtagataaactgactggataatattatattggacttttctctagattatctaagcaggagacctgaatctgcttgcaataaagaataaaagtctgcttcagtttctttataaagaaactcacacaa

SEQ ID NO: 109794 - DNA, 3163 bp, Homo sapiens
  Payload ID: 1557
  Gene Symbol: ATP11A
  Gene Name: ATPase, class VI, type 11A
  ENST ID: ENST00000418678
  CDS Start-End: 1-2807
tctacgtgggacacagggagccacctccgggcgcagaggcctacatcccacagagatacccagacaacaggatcgtctcgtccaagtacacattttggaactttatacccaagaatttatttgaacaattcagaagagtagccaacttttatttccttatcatatttctggtgcagttgattattgatacacccacaagtccagtgacaagcggacttccactcttctttgtcattactgtgacggctatcaaacagggttatgaagactggcttcgacataaagcagacaatgccatgaaccagtgtcctgttcatttcattcagcacggcaagctcgttcggaaacaaagtcgaaagctgcgagttggggacattgtcatggttaaggaggacgagacctttccctgcgacttgatcttcctttccagcaaccggggagatgggacgtgccacgtcaccaccgccagcttggatggagaatccagccataaaacgcattacgcggtccaggacaccaaaggcttccacacagaggaggatatcggcggacttcacgccaccatcgagtgtgagcagccccagcccgacctctacaagttcgtgggtcgcatcaacgtttacagtgacctgaatgaccccgtggtgaggcccttaggatcggaaaacctgctgcttagaggagctacactgaagaacactgagaaaatctttggtgtggctatttacacgggaatggaaaccaagatggcattaaattatcaatcaaaatctcagaagcgatctgccgtggaaaaatcgatgaatgcgttcctcattgtgtatctctgcattctgatcagcaaagccctgataaacactgtgctgaaatacatgtggcagagtgagccctttcgggatgagccgtggtataatcagaaaacggagtcggaaaggcagaggaatctgttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggtggagtacatcttcacagacaagaccggcaccctcacggaaaacaacatggagttcaaggagtgctgcatcgaaggccatgtctacgtgccccacgtcatctgcaacgggcaggtcctcccagagtcgtcaggaatcgacatgattgactcgtcccccagcgtcaacgggagggagcgcgaggagctgtttttccgggccctctgtctctgccacaccgtccaggtgaaagacgatgacagcgtagacggccccaggaaatcgccggacggggggaaatcctgtgtgtacatctcatcctcgcccgacgaggtggcgctggtcgaaggtgtccagagacttggctttacctacctaaggctgaaggacaattacatggagatattaaacagggagaaccacatcgaaaggtttgaattgctggaaattttgagttttgactcagtcagaaggagaatgagtgtaattgtaaaatctgctacaggagaaatttatctgttttgcaaaggagcagattcttcgatattcccccgagtgatagaaggcaaagttgaccagatccgagccagagtggagcgtaacgcagtggaggggctccgaactttgtgtgttgcttataaaaggctgatccaagaagaatatgaaggcatttgtaagctgctgcaggctgccaaagtggcccttcaagatcgagagaaaaagttagcagaagcctatgagcaaatagagaaagatcttactctgcttggtgctacagctgttgaggaccggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctgtccggactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcagattgttaaattaatcaaattttcaaaagagcacccaatcacgttagcaattggcgatggtgcaaatgatgtcagcatgattctggaagcgcacgtgggcataggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataagaacgtctgcttcatcttccctcagtttttataccagttcttctgtgggttttcacaacagactttgtacgacaccgcgtatctgaccctctacaacatcagcttcacctccctccccatcctcctgtacagcctcatggagcagcatgttggcattgacgtgctcaagagagacccgaccctgtacaggtaccatcctccaaacagcctctcctgagagcagagagagtaactaggcagcactctggcagttccttccaatagccacctggcagacctcagttgagggccagaagcattcggcatctgctgatattcttgcttgatcaggagcttgtttaaactggaagcaacatagctcaaatggagattcttcaagtcttgctggatggtttatgctgcatttggaacatctgtgtggagccagtttgcactttcctgtgctttctgacagtcctgagggagctggggtacaagcgtcttcctcgttgtgaccctagggaatctgtggcctaagttatcctttaaaaccatgtgtgttccattcagtgagaaaaaacaaaaattaacagc

SEQ ID NO: 109795 - DNA, 550 bp, Homo sapiens
  Payload ID: 1557
  Gene Symbol: ATP11A
  Gene Name: ATPase, class VI, type 11A
  ENST ID: ENST00000415301
  CDS Start-End: 1-226
gttcatccagatgctgtccagcgggcccgcctggctggccatcgtgctgctggtgaccatcagcctccttcccgacgtcctcaagaaagtcctgtgccggcagctgtggccaacagcaacagagagagtccagaggggtgtgaagcacaaggctccagtccaggccgcacagagcagcgatgggcccctcctgaaggacctcctacggcggccaaggcgcagttagctccacgctagagcccaggctaccagagcacctgtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtgg

SEQ ID NO: 109796 - DNA, 2446 bp, Homo sapiens
  Payload ID: 1557
  Gene Symbol: ATP11A
  Gene Name: ATPase, class VI, type 11A
  ENST ID: ENST00000419631
  CDS Start-End: 1-552
ttcaccgtgatggtgttcacagttacactaaagcttgcattggacacacactactggacttggatcaaccattttgtcatctgggggtcgctgctgttctacgttgtcttttcgcttctctggggaggagtgatctggccgttcctcaactaccagaggatgtactacgtgttcatccagatgctgtccagcgggcccgcctggctggccatcgtgctgctggtgaccatcagcctccttcccgacgtcctcaagaaagtcctgtgccggcagctgtggccaacagcaacagagagagtccagaatgggtgcgcacagcctcgggaccgcgactcagaattcacccctcttgcctctctgcagagcccaggctaccagagcacctgtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtggttgttgagccacaccagtggcctctgggcattcggctcaacgcaggagggacattctgctggcccaccctgcgcgctgtcatgcagaggccattcccccaggcctgtgtcttcacccacctgccatcattggcctttgctgtcactgggagagaagagccgtccagggacccatggtggcccacatgtggatgccacatgctgctgtttcctgcttgcccggccaccacccatgccctccatagggtgaggtggagccatggtggtgcgtcctttactcaacaaccctccaatccggatgctgtgggaagggccgggtcactcggataccatcatccctgcggatgcaccgccgtaccctgctcatctgggagtggtttccctgcggttacgtccaagcccgcctgccctgtgtgttggggctggctgagtttcggtctccccatcaccggccgcctcgtggagaaggcagtgccacgtgggaggacaaggccacgccggcagcttccagccctgccgcagaagtgccaggatgtccatcagccactcgccagggcacggagccgtcagtccactgttacgggagaatgttgatttcgcgggtgcgagggccgggagacagatacttggctgtgatgagcagacatcctctgtccccgtggaggggtcaacaccaaggtggtgttcgtgcaccagaacctgtctcgggctgacgggggtggcacacaggacacgggtggatcccaacaggcagcaccgcacctctgcccgcctcccgcactgcagctccgcccgccgggctctgcgtccccacgtcccctcgtcccatccccacgtcccctcatcccgtcacctcgtccccacatccccttgccccgtcacctcgtcctcatgtccccttgtcctgtcacctcgtccccacgtcccctcgtctcctcatccccacgtcctctcgtccccttgtcccgtccccacataccctcgtccccatgtccccacgcagggctctccttcgtcttaggatctgtccagcgctgctctgggtgggttagcaaccccagggctgctgtgataggaagtccctgttgttctccgtactggcatttctatttctagaaataatatttgacatagccttaatggtccttaaagaagacatttcagtgtgagattcagacttcagacgctgaaactgctgcctttcaggaaagcaccaccaacgctggaggaggagccggccctcacgcccgccccgcgccacgctgtggaacggggctccggcaagtgaaacccagagggtgtttccgaggtgctcgacagtaggtatttttggaagctcagatttcaccatttgattgtataatcttttacctataaaatatttatttgaagtagagggtaaatcagcggtaagaacagtgaacacagtggttgggataaaataaggtgacaaacatcacaccaaagatgagggtagcgagcaactggcttgagcagacagaacggggaagactccactctgtcccgaggggccagccgcaggcgtccccagggccaccctgccctgaggtccttgtgtggccgccctggcttggcagccctgcccacgctgcccccgcaaacaatggtgtgtgcgtttttacagccctttttaggaacccaatatgggcataaatgtaacacctgtagcgggggcagattctctgtatgttcagttaacaaattatttgtaatgtatttttttagaaatcttaaaattgcctttgcactg

SEQ ID NO: 109797 - DNA, 8858 bp, Homo sapiens
  Payload ID: 1557
  Gene Symbol: ATP11A
  Gene Name: ATPase, class VI, type 11A
  Uniprot ID: P98196
  ENST ID: ENST00000487903
  CDS Start-End: 89-3493
gcggccgcactagtaccccggagcccatgggcgcgccgagccgggcgcgggggcgctgaacggcggagcgggagcggccggaggagccatggactgcagcctcgtgcggacgctcgtgcacagatactgtgcaggagaagagaattgggtggacagcaggaccatctacgtgggacacagggagccacctccgggcgcagaggcctacatcccacagagatacccagacaacaggatcgtctcgtccaagtacacattttggaactttatacccaagaatttatttgaacaattcagaagagtagccaacttttatttccttatcatatttctggtgcagttgattattgatacacccacaagtccagtgacaagcggacttccactcttctttgtcattactgtgacggctatcaaacagggttatgaagactggcttcgacataaagcagacaatgccatgaaccagtgtcctgttcatttcattcagcacggcaagctcgttcggaaacaaagtcgaaagctgcgagttggggacattgtcatggttaaggaggacgagacctttccctgcgacttgatcttcctttccagcaaccggggagatgggacgtgccacgtcaccaccgccagcttggatggagaatccagccataaaacgcattacgcggtccaggacaccaaaggcttccacacagaggaggatatcggcggacttcacgccaccatcgagtgtgagcagccccagcccgacctctacaagttcgtgggtcgcatcaacgtttacagtgacctgaatgaccccgtggtgaggcccttaggatcggaaaacctgctgcttagaggagctacactgaagaacactgagaaaatctttggtgtggctatttacacgggaatggaaaccaagatggcattaaattatcaatcaaaatctcagaagcgatctgccgtggaaaaatcgatgaatgcgttcctcattgtgtatctctgcattctgatcagcaaagccctgataaacactgtgctgaaatacatgtggcagagtgagccctttcgggatgagccgtggtataatcagaaaacggagtcggaaaggcagaggaatctgttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggtggagtacatcttcacagacaagaccggcaccctcacggaaaacaacatggagttcaaggagtgctgcatcgaaggccatgtctacgtgccccacgtcatctgcaacgggcaggtcctcccagagtcgtcaggaatcgacatgattgactcgtcccccagcgtcaacgggagggagcgcgaggagctgtttttccgggccctctgtctctgccacaccgtccaggtgaaagacgatgacagcgtagacggccccaggaaatcgccggacggggggaaatcctgtgtgtacatctcatcctcgcccgacgaggtggcgctggtcgaaggtgtccagagacttggctttacctacctaaggctgaaggacaattacatggagatattaaacagggagaaccacatcgaaaggtttgaattgctggaaattttgagttttgactcagtcagaaggagaatgagtgtaattgtaaaatctgctacaggagaaatttatctgttttgcaaaggagcagattcttcgatattcccccgagtgatagaaggcaaagttgaccagatccgagccagagtggagcgtaacgcagtggaggggctccgaactttgtgtgttgcttataaaaggctgatccaagaagaatatgaaggcatttgtaagctgctgcaggctgccaaagtggcccttcaagatcgagagaaaaagttagcagaagcctatgagcaaatagagaaagatcttactctgcttggtgctacagctgttgaggaccggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctgtccggactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcagattgttaaattaatcaaattttcaaaagagcacccaatcacgttagcaattggcgatggtgcaaatgatgtcagcatgattctggaagcgcacgtgggcataggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataagaacgtctgcttcatcttccctcagtttttataccagttcttctgtgggttttcacaacagactttgtacgacaccgcgtatctgaccctctacaacatcagcttcacctccctccccatcctcctgtacagcctcatggagcagcatgttggcattgacgtgctcaagagagacccgaccctgtacagggacgtcgccaagaatgccctgctgcgctggcgcgtgttcatctactggacgctcctgggactgtttgacgcactggtgttcttctttggtgcttatttcgtgtttgaaaatacaactgtgacaagcaacgggcagatatttggaaactggacgtttggaacgctggtattcaccgtgatggtgttcacagttacactaaagcttgcattggacacacactactggacttggatcaaccattttgtcatctgggggtcgctgctgttctacgttgtcttttcgcttctctggggaggagtgatctggccgttcctcaactaccagaggatgtactacgtgttcatccagatgctgtccagcgggcccgcctggctggccatcgtgctgctggtgaccatcagcctccttcccgacgtcctcaagaaagtcctgtgccggcagctgtggccaacagcaacagagagagtccagactaagagccagtgcctttctgtcgagcagtcaaccatctttatgctttctcagacttccagcagcctgagtttctgatggaacaagcagaatgggtgcgcacagcctcgggaccgcgactcagaattcacccctcttgcctctctgcagagcccaggctaccagagcacctgtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtggttgttgagccacaccagtggcctctgggcattcggctcaacgcaggagggacattctgctggcccaccctgcgcgctgtcatgcagaggccattcccccaggcctgtgtcttcacccacctgccatcattggcctttgctgtcactgggagagaagagccgtccagggacccatggtggcccacatgtggatgccacatgctgctgtttcctgcttgcccggccaccacccatgccctccatagggtgaggtggagccatggtggtgcgtcctttactcaacaaccctccaatccggatgctgtgggaagggccgggtcactcggataccatcatccctgcggatgcaccgccgtaccctgctcatctgggagtggtttccctgcggttacgtccaagcccgcctgccctgtgtgttggggctggctgagtttcggtctccccatcaccggccgcctcgtggagaaggcagtgccacgtgggaggacaaggccacgccggcagcttccagccctgccgcagaagtgccaggatgtccatcagccactcgccagggcacggagccgtcagtccactgttacgggagaatgttgatttcgcgggtgcgagggccgggagacagatacttggctgtgatgagcagacatcctctgtccccgtggaggggtcaacaccaaggtggtgttcgtgcaccagaacctgtctcgggctgacgggggtggcacacaggacacgggtggatcccaacaggcagcaccgcacctctgcccgcctcccgcactgcagctccgcccgccgggctctgcgtccccacgtcccctcgtcccatccccacgtcccctcatcccgtcacctcgtccccacatccccttgccccgtcacctcgtcctcatgtccccttgtcctgtcacctcgtccccacgtcccctcgtctcctcatccccacgtcctctcgtccccttgtcccgtccccacataccctcgtccccatgtccccacgcagggctctccttcgtcttaggatctgtccagcgctgctctgggtgggttagcaaccccagggctgctgtgataggaagtccctgttgttctccgtactggcatttctatttctagaaataatatttgacatagccttaatggtccttaaagaagacatttcagtgtgagattcagacttcagacgctgaaactgctgcctttcaggaaagcaccaccaacgctggaggaggagccggccctcacgcccgccccgcgccacgctgtggaacggggctccggcaagtgaaacccagagggtgtttccgaggtgctcgacagtaggtatttttggaagctcagatttcaccatttgattgtataatcttttacctataaaatatttatttgaagtagagggtaaatcagcggtaagaacagtgaacacagtggttgggataaaataaggtgacaaacatcacaccaaagatgagggtagcgagcaactggcttgagcagacagaacggggaagactccactctgtcccgaggggccagccgcaggcgtccccagggccaccctgccctgaggtccttgtgtggccgccctggcttggcagccctgcccacgctgcccccgcaaacaatggtgtgtgcgtttttacagccctttttaggaacccaatatgggcataaatgtaacacctgtagcgggggcagattctctgtatgttcagttaacaaattatttgtaatgtatttttttagaaatcttaaaattgcctttgcactgaagtattttcatagctgtttatatctcttttattcatttatttaacatactgtctaattttaaaaataggtttttaaagctttcatttttaagtttatgaaattttggccactttacatttagattctggtgagagttttgactgaatgttccaatctctgatgaatgcgaattttcagatttgattttattctctacacacacctcttcttttcttggtatttctggtggcagtgattagttgaacagcacatttaaggcacgataatttgctacactttttctttacaatttgttgcaatttcatctgctttctatgtttcattgttaattgccatccttcagccttaaaaatagaagattctcacgtgaaggtttagtaagttgggtcccagctctgcctgtgtggagatagtcaccatgtacctctgacaacaagttttagtgtgaaagtcactaaacttttacacactcccaaacgtctttttaaaaattgcttgggaaattattaaatgaatgtgcctgatgatttgaaatagacaaggggcacgagataaaaaagaaaaggatgagaagatcctcagtgaatgacgttgcagggtcttcatgcaattttccacctcgcagtagttagtatttacttgccttaaactaactttgaagcaagtaatgtcaactttgagcactttgttgagttttgaaaaatcttatttgttgctgcacaggttaataaattatcaatttgtaattcagcatgttggtcagagacacggtcactgattcacacccagtccctgccacagaccgtctcagacacgcacagtgggcctgctgcatgattcacacccagtccctgccacagaccgtctcagacacgcacagtgggcctgctgcatgattcacacccagtccctgccacagaccgtctcagacacgcacagtgggcctgctgcatgcgtgttacctggcttttggctccacgctcactcatagccatgtccacatgggggcttgcacacaggatcactcacatatgtacatgtacccaccacaaacgtgcaagctcctgcacacatgcatgcacacaaacgtgtacacaagtgtgagctcctacacgcatacacacacacacgtgtacatgcaccaaagcatgtgtgacctacagacatgcagaacatgcacgtgtacacataccacagacacgcgtgtgcatgctcctacacaatacatatgcacatatcatgaacagcgtaagttcctacacacggacgtgtgatacacacatgcatgtacaggtaagcacacatgtacaagctcctacaggcttgctctcacacacgtgtatgcacagcagagagacgtatgagcttctactgcacacatgcacacacacacgcacacgtacattcactacaaacgtgcagcctcctgcacacgtgcacattcatgtgtacaccacaaatgagttcccagacgtgtaaacacacgtgcacacatcgtacacatgtgagctcccacacgtacacacagatgcacatggacacaccccaaacacgcacaggctcctacacacatgcacacacgtgtacaccacaaacgagctcccagacatgtaaacacacgtctcccacacgtgagctcccacacgtacacatgcacatgtacgcaccacaaacacatgcgcaggctcctgcaggcgtgaatacacacatgcacacacatatacacacatgtgccacaaacaagtgcacactgtcctggtgtcctgcactgcatcctgcctccttgctgaggggcccctgtgagaggcctctggatgggcatgggaagatgggctccctggcccccagcccatgcctccctgggatgaagagtccccctcctggcagaatgtctgggctttgcagagcaggccccgggggtgaagtcgcagcttcacttacaccagctgctctgtgagcaaggcttggtgccctggacaaggcccttcccctttagggaggtccagcctcgcaagctgaaacctcccctcggctcagccctataccaggcggccacagcaggactggccacacccacgccgcacctcatccgtgcacgcgtcggagcacggccagccttccgccacgagccagctgggaagggccgcggccgcctaaagccccagtcaacccagcctgtgtctgagcagacagggcgaacaagcaggccacaccgtctcgagggaggaggccagatgcggccagcgtctccaacagggtgaccatccgctcggcttgctgagcgtttaaacaaatgtttagacaggctgtggggactcccctgagttgagccttggccaggggtccggtgctgtcgcgggaaacctccagccttgttcttcaaaccactcagctcatgtgttttgcactgactagtactgaataatacaaccactcttatttaatgttagtattatttatttgacaactcagtgtctaacagcttgatatgcaggtccttgcatcctacatttctttaggaagttacccatttgtaactttaaaaacaggaaaaatatcagttggcaaatgcaatcttttttttttttaagctaaaggtgggtgaactggaatgaaaatctttctgatgttgtgtctataagcagccttgatgggatatgttagaagtgtcatgaaagtgtgattctacttttgcagaaaaatctaaagatcaatttatatagctttattttttactttatcaaagtatacagaattttaatatgcatatattgtgtctgacttaaaattataatgtctgcgtcaccatttaaaatgtctgttcattatgtaatgtaataaaagaaggtcttcaaaaatgtatttaacatgaatggtatccatagttgtcatcatcataaatactggagtttatttttaaattattaaacatagtaggtgcattaacataaatcagtctccacacagtaacatttaactgataattcattaatcagctttgaaaaattaaattgttaattaaaccaatctaacatttcagtaaagtttattttgtatgcttctgtttttaacttttatttctgtagataaactgactggataatattatattggacttttctctagattatctaagcaggagacctgaatctgcttgcaataaagaataaaagtctgcttcagtttctttataaagaaactcacacaa

SEQ ID NO: 109798 - DNA, 5786 bp, Homo sapiens
  Payload ID: 1557
  Gene Symbol: ATP11A
  Gene Name: ATPase, class VI, type 11A
  ENST ID: ENST00000471555
  CDS Start-End: 1-1058
cttcgatattcccccgagtgatagaaggcaaagttgaccagatccgagccagagtggagcgtaacgcagtggaggggctccgaactttgtgtgttgcttataaaaggctgatccaagaagaatatgaaggcatttgtaagctgctgcaggctgccaaagtggcccttcaagatcgagagaaaaagttagcagaagcctatgagcaaatagagaaagatcttactctgcttggtgctacagctgttgaggaccggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctgtccggactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcagattgttaaattaatcaaattttcaaaagagcacccaatcacgttagcaattggcgatggtgcaaatgatgtcagcatgattctggaagcgcacgtgggcataggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataagaacgtctgcttcatcttccctcagtttttataccagttcttctgtgggttttcacaacagggacgtcgccaagaatgccctgctgcgctggcgcgtgttcatctactggacgctcctgggactgtttgacgcactggtgttcttctttggtgcttatttcgtgtttgaaaatacaactgtgacaagcaacgggcagatatttggaaactggacgtttggaacgctggtattcaccgtgatggtgttcacagttacactaaagcttgcattggacacacactactggacttggatcaaccattttgtcatctgggggtcgctgctgttctacgttgtcttttcgcttctctggggaggagtgatctggccgttcctcaactaccagaggatgtactacgtgttcatccagatgctgtccagcgggcccgcctggctggccatcgtgctgctggtgaccatcagcctccttcccgacgtcctcaagaaagtcctgtgccggcagctgtggccaacagcaacagagagagtccagactaagagccagtgcctttctgtcgagcagtcaaccatctttatgctttctcagacttccagcagcctgagtttctgatggaacaagagcccaggctaccagagcacctgtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtggttgttgagccacaccagtggcctctgggcattcggctcaacgcaggagggacattctgctggcccaccctgcgcgctgtcatgcagaggccattcccccaggcctgtgtcttcacccacctgccatcattggcctttgctgtcactgggagagaagagccgtccagggacccatggtggcccacatgtggatgccacatgctgctgtttcctgcttgcccggccaccacccatgccctccatagggtgaggtggagccatggtggtgcgtcctttactcaacaaccctccaatccggatgctgtgggaagggccgggtcactcggataccatcatccctgcggatgcaccgccgtaccctgctcatctgggagtggtttccctgcggttacgtccaagcccgcctgccctgtgtgttggggctggctgagtttcggtctccccatcaccggccgcctcgtggagaaggcagtgccacgtgggaggacaaggccacgccggcagcttccagccctgccgcagaagtgccaggatgtccatcagccactcgccagggcacggagccgtcagtccactgttacgggagaatgttgatttcgcgggtgcgagggccgggagacagatacttggctgtgatgagcagacatcctctgtccccgtggaggggtcaacaccaaggtggtgttcgtgcaccagaacctgtctcgggctgacgggggtggcacacaggacacgggtggatcccaacaggcagcaccgcacctctgcccgcctcccgcactgcagctccgcccgccgggctctgcgtccccacgtcccctcgtcccatccccacgtcccctcatcccgtcacctcgtccccacatccccttgccccgtcacctcgtcctcatgtccccttgtcctgtcacctcgtccccacgtcccctcgtctcctcatccccacgtcctctcgtccccttgtcccgtccccacataccctcgtccccatgtccccacgcagggctctccttcgtcttaggatctgtccagcgctgctctgggtgggttagcaaccccagggctgctgtgataggaagtccctgttgttctccgtactggcatttctatttctagaaataatatttgacatagccttaatggtccttaaagaagacatttcagtgtgagattcagacttcagacgctgaaactgctgcctttcaggaaagcaccaccaacgctggaggaggagccggccctcacgcccgccccgcgccacgctgtggaacggggctccggcaagtgaaacccagagggtgtttccgaggtgctcgacagtaggtatttttggaagctcagatttcaccatttgattgtataatcttttacctataaaatatttatttgaagtagagggtaaatcagcggtaagaacagtgaacacagtggttgggataaaataaggtgacaaacatcacaccaaagatgagggtagcgagcaactggcttgagcagacagaacggggaagactccactctgtcccgaggggccagccgcaggcgtccccagggccaccctgccctgaggtccttgtgtggccgccctggcttggcagccctgcccacgctgcccccgcaaacaatggtgtgtgcgtttttacagccctttttaggaacccaatatgggcataaatgtaacacctgtagcgggggcagattctctgtatgttcagttaacaaattatttgtaatgtatttttttagaaatcttaaaattgcctttgcactgaagtattttcatagctgtttatatctcttttattcatttatttaacatactgtctaattttaaaaataggtttttaaagctttcatttttaagtttatgaaattttggccactttacatttagattctggtgagagttttgactgaatgttccaatctctgatgaatgcgaattttcagatttgattttattctctacacacacctcttcttttcttggtatttctggtggcagtgattagttgaacagcacatttaaggcacgataatttgctacactttttctttacaatttgttgcaatttcatctgctttctatgtttcattgttaattgccatccttcagccttaaaaatagaagattctcacgtgaaggtttagtaagttgggtcccagctctgcctgtgtggagatagtcaccatgtacctctgacaacaagttttagtgtgaaagtcactaaacttttacacactcccaaacgtctttttaaaaattgcttgggaaattattaaatgaatgtgcctgatgatttgaaatagacaaggggcacgagataaaaaagaaaaggatgagaagatcctcagtgaatgacgttgcagggtcttcatgcaattttccacctcgcagtagttagtatttacttgccttaaactaactttgaagcaagtaatgtcaactttgagcactttgttgagttttgaaaaatcttatttgttgctgcacaggttaataaattatcaatttgtaattcagcatgttggtcagagacacggtcactgattcacacccagtccctgccacagaccgtctcagacacgcacagtgggcctgctgcatgattcacacccagtccctgccacagaccgtctcagacacgcacagtgggcctgctgcatgattcacacccagtccctgccacagaccgtctcagacacgcacagtgggcctgctgcatgcgtgttacctggcttttggctccacgctcactcatagccatgtccacatgggggcttgcacacaggatcactcacatatgtacatgtacccaccacaaacgtgcaagctcctgcacacatgcatgcacacaaacgtgtacacaagtgtgagctcctacacgcatacacacacacacgtgtacatgcaccaaagcatgtgtgacctacagacatgcagaacatgcacgtgtacacataccacagacacgcgtgtgcatgctcctacacaatacatatgcacatatcatgaacagcgtaagttcctacacacggacgtgtgatacacacatgcatgtacaggtaagcacacatgtacaagctcctacaggcttgctctcacacacgtgtatgcacagcagagagacgtatgagcttctactgcacacatgcacacacacacgcacacgtacattcactacaaacgtgcagcctcctgcacacgtgcacattcatgtgtacaccacaaatgagttcccagacgtgtaaacacacgtgcacacatcgtacacatgtgagctcccacacgtacacacagatgcacatggacacaccccaaacacgcacaggctcctacacacatgcacacacgtgtacaccacaaacgagctcccagacatgtaaacacacgtctcccacacgtgagctcccacacgtacacatgcacatgtacgcaccacaaacacatgcgcaggctcctgcaggcgtgaatacacacatgcacacacatatacacacatgtgccacaaacaagtgcacactgtcctggtgtcctgcactgcatcctgcctccttgctgaggggcccctgtgagaggcctctggatgggcatgggaagatgggctccctggcccccagcccatgcctccctgggatgaagagtccccctcctggcagaatgtctgggctttgcagagcaggccccgggggtgaagtcgcagcttcacttacaccagctgctctgtgagcaaggcttggtgccctggacaaggcccttcccctttagggaggtccagcctcgcaagctgaaacctcccctcggctcagccctataccaggcggccacagcaggactggccacacccacgccgcacctcatccgtgcacgcgtcggagcacggccagccttccgccacgagccagctgggaagggccgcggccgc

SEQ ID NO: 109799 - DNA, 885 bp, Homo sapiens
  Payload ID: 1557
  Gene Symbol: ATP11A
  Gene Name: ATPase, class VI, type 11A
  ENST ID: ENST00000610419
  CDS Start-End: 1-189
gatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcaggtgctgcccgcccgtcctcgatagctggtggtcagggcgtccaaaacactgaaaaccttccgttaggtctcaccgcctcagattgttaaacaatctagcagggtaccacctgttaaaaatagaagcaaccgtgatagagatttaaaacgcagatcttgttttgcttgtcgggccagcttctgtgattagtgggtgatgaccagtcagatgtatgacccttccagatgcagtggccaggacagctgccctggctgacttctgttaaaaaaaaaaaaaaaagctatctcaatcactcctgagaatctacactaaaggtgtaagggaagggagctgacattactgagcacctagtgtgtgcctcctacagatacgaatgcatttagtctcaaaataaccctctcagacaaatgagggcaccagctttacaaatgggaataatttgccgaaaaggctgcagatgggaaatgccacgaggattcaacttgtcttgtccatcaaactccaaacgtctcacgcggccatgttcttgtgggaaacgcacacctgaagttttttctttaaatagttttgaaagcactatggaatgtattgtaaacatggatgtctttctggtatcaggaagcctagaaaagttctgactttgttataccacattttagatatgataggccaatttctcttgaactgttcatgaataaatccatcattggtcagagcaaa

SEQ ID NO: 109800 - DNA, 7325 bp, Homo sapiens
  Payload ID: 1558
  Gene Symbol: ATP11B
  Gene Name: ATPase, class VI, type 11B
  Uniprot ID: Q9Y2G3
  ENST ID: ENST00000323116
  CDS Start-End: 261-3794
ggtcaataatgaaggtggctgcggcgcggcggcaggctcagctgcgccgggcgggggcggcgccggggccgcgcctgtaggactcggggccgacgccgcgggatggggacgcggcgcggggagtgaggcagtggcggcggcggcggtaagcggaacttcggcccgaggggctcgcccgctcccgcctctgtcttgtcggcctccacctgcagccccgcggcccccgcgccccgcgggacccggacggcgacgacgggggaatgtggcgctggatccggcagcagctgggttttgacccaccacatcagagtgacacaagaaccatctacgtagccaacaggtttcctcagaatggcctttacacacctcagaaatttatagataacaggatcatttcatctaagtacactgtgtggaattttgttccaaaaaatttatttgaacagttcagaagagtggcaaacttttattttcttattatatttttggttcagcttatgattgatacacctaccagtccagttaccagtggacttccattattctttgtgataacagtaactgccataaagcagggatatgaagattggttacggcataactcagataatgaagtaaatggagctcctgtttatgttgttcgaagtggtggccttgtaaaaactagatcaaaaaacattcgggtgggtgatattgttcgaatagccaaagatgaaatttttcctgcagacttggtgcttctgtcctcagatcgactggatggttcctgtcacgttacaactgctagtttggacggagaaactaacctgaagacacatgtggcagttccagaaacagcattattacaaacagttgccaatttggacactctagtagctgtaatagaatgccagcaaccagaagcagacttatacagattcatgggacgaatgatcataacccaacaaatggaagaaattgtaagacctctggggccggagagtctcctgcttcgtggagccagattaaaaaacacaaaagaaatttttggtgttgcggtatacactggaatggaaactaagatggcattaaattacaagagcaaatcacagaaacgatctgcagtagaaaagtcaatgaatacatttttgataatttatctagtaattcttatatctgaagctgtcatcagcactatcttgaagtatacatggcaagctgaagaaaaatgggatgaaccttggtataaccaaaaaacagaacatcaaagaaatagcagtaagattctgagatttatttcagacttccttgcttttttggttctctacaatttcatcattccaatttcattatatgtgacagtcgaaatgcagaaatttcttggatcattttttattggctgggatcttgatctgtatcatgaagaatcagatcagaaagctcaagtcaatacttccgatctgaatgaagagcttggacaggtagagtacgtgtttacagataaaactggtacactgacagaaaatgagatgcagtttcgggaatgttcaattaatggcatgaaataccaagaaattaatggtagacttgtacccgaaggaccaacaccagactcttcagaaggaaacttatcttatcttagtagtttatcccatcttaacaacttatcccatcttacaaccagttcctctttcagaaccagtcctgaaaatgaaactgaactaattaaagaacatgatctcttctttaaagcagtcagtctctgtcacactgtacagattagcaatgttcaaactgactgcactggtgatggtccctggcaatccaacctggcaccatcgcagttggagtactatgcatcttcaccagatgaaaaggctctagtagaagctgctgcaaggattggtattgtgtttattggcaattctgaagaaactatggaggttaaaactcttggaaaactggaacggtacaaactgcttcatattctggaatttgattcagatcgtaggagaatgagtgtaattgttcaggcaccttcaggtgagaagttattatttgctaaaggagctgagtcatcaattctccctaaatgtataggtggagaaatagaaaaaaccagaattcatgtagatgaatttgctttgaaagggctaagaactctgtgtatagcatatagaaaatttacatcaaaagagtatgaggaaatagataaacgcatatttgaagccaggactgccttgcagcagcgggaagagaaattggcagctgttttccagttcatagagaaagacctgatattacttggagccacagcagtagaagacagactacaagataaagttcgagaaactattgaagcattgagaatggctggtatcaaagtatgggtacttactggggataaacatgaaacagctgttagtgtgagtttatcatgtggccattttcatagaaccatgaacatccttgaacttataaaccagaaatcagacagcgagtgtgctgaacaattgaggcagcttgccagaagaattacagaggatcatgtgattcagcatgggctggtagtggatgggaccagcctatctcttgcactcagggagcatgaaaaactatttatggaagtttgcagaaattgttcagctgtattatgctgtcgtatggctccactgcagaaagcaaaagtaataagactaataaaaatatcacctgagaaacctataacattggctgttggtgatggtgctaatgacgtaagcatgatacaagaagcccatgttggcataggaatcatgggtaaagaaggaagacaggctgcaagaaacagtgactatgcaatagccagatttaagttcctctccaaattgctttttgttcatggtcatttttattatattagaatagctacccttgtacagtattttttttataagaatgtgtgctttatcacaccccagtttttatatcagttctactgtttgttttctcagcaaacattgtatgacagcgtgtacctgactttatacaatatttgttttacttccctacctattctgatatatagtcttttggaacagcatgtagaccctcatgtgttacaaaataagcccaccctttatcgagacattagtaaaaaccgcctcttaagtattaaaacatttctttattggaccatcctgggcttcagtcatgcctttattttcttttttggatcctatttactaatagggaaagatacatctctgcttggaaatggccagatgtttggaaactggacatttggcactttggtcttcacagtcatggttattacagtcacagtaaagatggctctggaaactcatttttggacttggatcaaccatctcgttacctggggatctattatattttattttgtattttccttgttttatggagggattctctggccatttttgggctcccagaatatgtattttgtgtttattcagctcctgtcaagtggttctgcttggtttgccataatcctcatggttgttacatgtctatttcttgatatcataaagaaggtctttgaccgacacctccaccctacaagtactgaaaaggcacagcttactgaaacaaatgcaggtatcaagtgcttggactccatgtgctgtttcccggaaggagaagcagcgtgtgcatctgttggaagaatgctggaacgagttataggaagatgtagtccaacccacatcagcagatcatggagtgcatcggatcctttctataccaacgacaggagcatcttgactctctccacaatggactcatctacttgttaaaggggcagtagtactttgtgggagccagttcacctcctttcctaaaattcagtgtgatcaccctgttaatggccacactagctctgaaattaatttccaaaatctttgtagtagttcatacccactcagagttataatggcaaacaaacagaaagcattagtacaagcccctcccaacacccttaatttgaatctgaacatgttaaaatttgagaataaagagacatttttcatctctttgtctggtttgtcccttgtgcttatgggactcctaatggcatttcagtctgttgctgaggccattatattttaatataaatgtagaaaaaagagagaaatcttagtaaagagtattttttagtattagcttgattattgactcttctatttaaatctgcttctgtaaattatgctgaaagtttgccttgagaactctatttttttattagagttatatttaaagcttttcatgggaaaagttaatgtgaatactgaggaattttggtccctcagtgacctgtgttgttaattcattaatgcattctgagttcacagagcaaattaggagaatcatttccaaccattatttactgcagtatggggagtaaatttataccaattcctctaactgtactgtaacacagcctgtaaagttagccatataaatgcaagggtatatcatatatacaaatcaggaatcaggtccgttcaccgaacttcaaattgatgtttactaatatttttgtgacagagtataaagaccctatagtgggtaaattagatactattagcatattattaatttaatgtctttatcattggatcttttgcatgctttaatctggttaacatatttaaatttgctttttttctctttacctgaaggctctgtgtatagtatttcatgacatcgttgtacagtttaactatatcaataaaaagtttggacagtatttaaatattgcaaatatgtttaattatacaaatcagaatagtatgggtaattaaatgaatacaaaaagaagagcctctttctgcagccgacttagacatgctcttccctttctataagctagattttagaataaagggtttcagttaataatcttattttcaggttatgtcatctaacttatagcaaactaccacaatacagtgagttctgccagtgtcccagtacaaggcatatttcaggtgtggctgtggaatgtaaaaatgctcaacttgtatcaggtaatgttagcaataaattaaatgctaagaatgattaatcgggtacatgttactgtaattaactcattgcacttcaaaacctaacttccatcctgaatttatcaagtagttcagtattgtcatttgtttttgttttattgaaaagtaatgttgtcttaagatttagaagtgattattagcttgagaactattacccagctctaagcaaataatgattgtatacatattaagataatggttaaatgcggttttaccaagttttcccttgaaaatgtaattcctttatggagatttattgtgcagccctaagcttccttcccatttcatgaatataaggcttctagaattggactggcaggggaaagaatggtagagacagaaattaagactttatccttgtttgcttgtaaactattattttcttgctaatgtaacatttgtctgttccagtgatgtaaggatattaagttattaagctaaatattaattttcaaaaatagtccttctttaacttagatatttcatagctggatttaggaagatctgttattctggaagtactaaaaagaataatacaacgtacaatgtctgcattcactaattcatgttccagaagaggaaataatgaagatatactcagtagagtactaggtgggaggatatggaaatttgctcataaaatctcttataaaacgtgcatataacaaaatgacacccagtaggcctgcattacatttacatgaccgtgtttatttgccatcaaataaactgagtactgacaccagacaaagactccaaagtcataaaatagcctatgaccaactgcagcaagacaggaggtcagctcgcctataatggtgcttaaagtgtgattgatgtaattttctgtactcaccatttgaagttagttaaggagaactttatttttttaaaaaaagtaaatggcaaccactagtgtgctcatcctgaactgttactccaaatccactccgtttttaaagcaaaattatcttgtgattttaagaaaagagttttctatttatttaagaaagtaacaatgcagtctgcaagctttcagtagttttctagtgctatattcatcctgtaaaactcttactacgtaaccagtaatcacaaggaaagtgtcccctttgcatatttctttaaaattctttctttggaaagtatgatgttgataattaacttacccttatctgccaaaaccagagcaaaatgctaaatacgttattgctaatcagtggtctcaaatcgatttgcctccctttgcctcgtctgagggctgtaagcctgaagatagtggcaagcaccaagtcagtttccaaaattgcccctcagctgctttaagtgactcagcaccctgcctcagcttcagcaggcgtaggctcaccctgggcggagcaaagtatgggccagggagaactacagctacgaagacctgctgtcgagttgagaaaaggggagaatttatggtctgaattttctaactgtcctctttcttgggtctaaagctcataatacacaaaggcttccagacctgagccacacccaggccctatcctgaacaggagactaaacagaggcaaatcaaccctaggaaatacttgcattctgccctacggttagtaccaggactgaggtcatttctactggaaaagattgtgagattgaacttatctgatcgcttgagactcctaataggcaggagtcaaggccactagaaaattgacagttaagagccaaaagtttttaaaatatgctactctgaaaaatctcgtgaaggctgtaggaaaagggagaatcttccatgttggtgtttttcctgtaaagatcagtttggggtatgatataagcaggtattaataaaaataacacaccaaagagttacgtaaaacatgttttattaattttggtccccacgtacagacattttatttctattttgaaatgagttatctattttcataaaagtaaaacactattaaagtgctgttttatgtgaaataacttgaatgttgttcctataaaaaatagatcataactcatgatatgtttgtaatcatggtaatttagatttttatgaggaatgagtatctggaaatattgtagcaatacttggtttaaaattttggacctgagacactgtggctgtctaatgtaatcctttaaaaattctctgcattgtcagtaaatgtagtatattattgtacagctactcataattttttaaagtttatgaagttatatttatcaaataaaaactttcctatataattaaaa

SEQ ID NO: 109801 - DNA, 716 bp, Homo sapiens
  Payload ID: 1558
  Gene Symbol: ATP11B
  Gene Name: ATPase, class VI, type 11B
  ENST ID: ENST00000482070
  CDS Start-End: 1-716
gggaccagcctatctcttgcactcagggagcatgaaaaactatttatggaagtttgcagaaattgttcagctgtattatgctgtcgtatggctccactgcagaaagcaaaagtaataagactaataaaaatatcacctgagaaacctataacattggctgttggtgatggtgctaatgacgtaagcatgatacaagaagcccatgttggcataggaatcatgggtaaagaaggaagacaggctgcaagaaacagtgactatgcaatagccagatttaagttcctctccaaattgctttttgttcatggtcatttttattatattagaatagctacccttgtacagtattttttttataagacattgtatgacagcgtgtacctgactttatacaatatttgttttacttccctacctattctgatatatagtcttttggaacagcatgtagaccctcatgtgttacaaaataagcccaccctttatcgagacattagtaaaaaccgcctcttaagtattaaaacatttctttattggaccatcctgggcttcagtcatgcctttattttcttttttggatcctatttactaatagggaaagatacatctctgcttggaaatggccagatgtttggaaactggacatttggcactttggtcttcacagtcatggttattacagtcacagtaaagatggctctggaaactcatttttg

SEQ ID NO: 109802 - DNA, 2390 bp, Homo sapiens
  Payload ID: 1558
  Gene Symbol: ATP11B
  Gene Name: ATPase, class VI, type 11B
  ENST ID: ENST00000466758
  CDS Start-End: 1-327
cagaaatcagacagcgagtgtgctgaacaattgaggcagcttgccagaagaattacagaggatcatgtgattcagcatgggctggtagtggatgggaccagcctatctcttgcactcagggagcatgaaaaactatttatggaagtttgcagaaattgttcagctgtattatgctgtcgtatggctccactgcagaaagcaaaagtaataagactaataaaaatatcacctgagaaacctataacattggctgttggtgatggtgctaatgacgaatcatgggtaaagaaggaagacaggctgcaagaaacagtgactatgcaatagccagatttaagttcctctccaaattgctttttgttcatggtcatttttattatattagaatagctacccttgtacagtattttttttataagaatgtgtgctttatcacaccccagtttttatatcagttctactgtttgttttctcagcaaacattgtatgacagcgtgtacctgactttatacaatatttgttttacttccctacctattctgatatatagtcttttggaacagcatgtagaccctcatgtgttacaaaataagcccaccctttatcgagacattagtaaaaaccgcctcttaagtattaaaacatttctttattggaccatcctgggcttcagtcatgcctttattttcttttttggatcctatttactaatagggaaagatacatctctgcttggaaatggccagatgtttggaaactggacatttggcactttggtcttcacagtcatggttattacagtcacagtaaagatggctctggaaactcatttttggacttggatcaaccatctcgttacctggggatctattatattttattttgtattttccttgttttatggagggattctctggccatttttgggctcccagaatatgtattttgtgtttattcagctcctgtcaagtggttctgcttggtttgccataatcctcatggttgttacatgtctatttcttgatatcataaagaaggtctttgaccgacacctccaccctacaagtactgaaaaggcacagatgtactccaacacagttgctttaagtgacgagttcatcgcactgcagccattgtcgagggcaaggaatcagctgagcaaacttaggtctgggattacagaagtaagccaccgcacctggcccatattcttagcttactgaaacaaatgcaggtatcaagtgcttggactccatgtgctgtttcccggaaggagaagcagcgtgtgcatctgttggaagaatgctggaacgagttataggaagatgtagtccaacccacatcagcagatcatggagtgcatcggatcctttctataccaacgacaggagcatcttgactctctccacaatggactcatctacttgttaaaggggcagtagtactttgtgggagccagttcacctcctttcctaaaattcagtgtgatcaccctgttaatggccacactagctctgaaattaatttccaaaatctttgtagtagttcatacccactcagagttataatggcaaacaaacagaaagcattagtacaagcccctcccaacacccttaatttgaatctgaacatgttaaaatttgagaataaagagacatttttcatctctttgtctggtttgtcccttgtgcttatgggactcctaatggcatttcagtctgttgctgaggccattatattttaatataaatgtagaaaaaagagagaaatcttagtaaagagtattttttagtattagcttgattattgactcttctatttaaatctgcttctgtaaattatgctgaaagtttgccttgagaactctatttttttattagagttatatttaaagcttttcatgggaaaagttaatgtgaatactgaggaattttggtccctcagtgacctgtgttgttaattcattaatgcattctgagttcacagagcaaattaggagaatcatttccaaccattatttactgcagtatggggagtaaatttataccaattcctctaactgtactgtaacacagcctgtaaagttagccatataaatgcaagggtatatcatatatacaaatcaggaatcaggtccgttcaccgaacttcaaattgatgtttactaatatttttgtgacagagtataaagaccctatagtgggtaaattagatactattagcatattattaatttaatgtctttatcattggatcttttgcatgctttaatctggttaacatatttaaatttgctttttttctctttacctgaaggctctgtgtatagtatttcatgacatcgttgtacagtttaactatatcaataaaaagtttggacagtatttaaa

SEQ ID NO: 109803 - DNA, 3259 bp, Homo sapiens
  Payload ID: 1558
  Gene Symbol: ATP11B
  Gene Name: ATPase, class VI, type 11B
  ENST ID: ENST00000498086
  CDS Start-End: 1-2912
atttggacactctagtagctgtaatagaatgccagcaaccagaagcagacttatacagattcatgggacgaatgatcataacccaacaaatggaagaaattgtaagacctctggggccggagagtctcctgcttcgtggagccagattaaaaaacacaaaagaaatttttggtgttgcggtatacactggaatggaaactaagatggcattaaattacaagagcaaatcacagaaacgatctgcagtagaaaagtcaatgaatacatttttgataatttatctagtaattcttatatctgaagctgtcatcagcactatcttgaagtatacatggcaagctgaagaaaaatgggatgaaccttggtataaccaaaaaacagaacatcaaagaaatagcagtaagattctgagatttatttcagacttccttgcttttttggttctctacaatttcatcattccaatttcattatatgtgacagtcgaaatgcagaaatttcttggatcattttttattggctgggatcttgatctgtatcatgaagaatcagatcagaaagctcaagtcaatacttccgatctgaatgaagagcttggacaggtagagtacgtgtttacagataaaactggtacactgacagaaaatgagatgcagtttcgggaatgttcaattaatggcatgaaataccaagaaattaatggtagacttgtacccgaaggaccaacaccagactcttcagaaggaaacttatcttatcttagtagtttatcccatcttaacaacttatcccatcttacaaccagttcctctttcagaaccagtcctgaaaatgaaactgaactaattaaagaacatgatctcttctttaaagcagtcagtctctgtcacactgtacagattagcaatgttcaaactgactgcactggtgatggtccctggcaatccaacctggcaccatcgcagttggagtactatgcatcttcaccagatgaaaaggctctagtagaagctgctgcaaggattggtattgtgtttattggcaattctgaagaaactatggaggttaaaactcttggaaaactggaacggtacaaactgcttcatattctggaatttgattcagatcgtaggagaatgagtgtaattgttcaggcaccttcaggtgagaagttattatttgctaaaggagctgagtcatcaattctccctaaatgtataggtggagaaatagaaaaaaccagaattcatgtagatgaatttgctttgaaagggctaagaactctgtgtatagcatatagaaaatttacatcaaaagagtatgaggaaatagataaacgcatatttgaagccaggactgccttgcagcagcgggaagagaaattggcagctgttttccagttcatagagaaagacctgatattacttggagccacagcagtagaagacagactacaagataaagttcgagaaactattgaagcattgagaatggctggtatcaaagtatgggtacttactggggataaacatgaaacagctgttagtgtgagtttatcatgtggccattttcatagaaccatgaacatccttgaacttataaaccagaaatcagacagcgagtgtgctgaacaattgaggcagcttgccagaagaattacagaggatcatgtgattcagcatgggctggtagtggatgggaccagcctatctcttgcactcagggagcatgaaaaactatttatggaagtttgcagaaattgttcagctgtattatgctgtcgtatggctccactgcagaaagcaaaagtaataagactaataaaaatatcacctgagaaacctataacattggctgttggtgatggtgctaatgacgtaagcatgatacaagaagcccatgttggcataggaatcatgggtaaagaaggaagacaggctgcaagaaacagtgactatgcaatagccagatttaagttcctctccaaattgctttttgttcatggtcatttttattatattagaatagctacccttgtacagtattttttttataagaatgtgtgctttatcacaccccagtttttatatcagttctactgtttgttttctcagcaaacattgtatgacagcgtgtacctgactttatacaatatttgttttacttccctacctattctgatatatagtcttttggaacagcatgtagaccctcatgtgttacaaaataagcccaccctttatcgagacattagtaaaaaccgcctcttaagtattaaaacatttctttattggaccatcctgggcttcagtcatgcctttattttcttttttggatcctatttactaatagggaaagatacatctctgcttggaaatggccagatgtttggaaactggacatttggcactttggtcttcacagtcatggttattacagtcacagtaaagatggctctggaaactcatttttggacttggatcaaccatctcgttacctggggatctattatattttattttgtattttccttgttttatggagggattctctggccatttttgggctcccagaatatgtattttgtgtttattcagctcctgtcaagtggttctgcttggtttgccataatcctcatggttgttacatgtctatttcttgatatcataaagaaggtctttgaccgacacctccaccctacaagtactgaaaaggcacagatgtactccaacacagttgctttaagtgacgagttcatcgcactgcagccattgtcgagggcaaggaatcagctgagcaaacttagcttactgaaacaaatgcaggtatcaagtgcttggactccatgtgctgtttcccggaaggagaagcagcgtgtgcatctgttggaagaatgctggaacgagttataggaagatgtagtccaacccacatcagcagatcatggagtgcatcggatcctttctataccaacgacaggagcatcttgactctctccacaatggactcatctacttgttaaaggggcagtagtactttgtgggagccagttcacctcctttcctaaaattcagtgtgatcaccctgttaatggccacactagctctgaaattaatttccaaaatctttgtagtagttcatacccactcagagttataatggcaaacaaacagaaagcattagtacaagcccctcccaacacccttaatttgaatctgaacatgttaaaatttgagaataaagagacatttttcatctc

SEQ ID NO: 109804 - DNA, 963 bp, Homo sapiens
  Payload ID: 1558
  Gene Symbol: ATP11B
  Gene Name: ATPase, class VI, type 11B
  ENST ID: ENST00000493826
  CDS Start-End: 258-845
caataatgaaggtggctgcggcgcggcggcaggctcagctgcgccgggcgggggcggcgccggggccgcgcctgtaggactcggggccgacgccgcgggatggggacgcggcgcggggagtgaggcagtggcggcggcggcggtaagcggaacttcggcccgaggggctcgcccgctcccgcctctgtcttgtcggcctccacctgcagccccgcggcccccgcgccccgcgggacccggacggcgacgacgggggaatgtggcgctggatccggcagcagctgggttttgacccaccacatcagagtgacacaagaaccatctacgtagccaacaggtttcctcagaatggcctttacacacctcagaaatttatagataacaggatcatttcatctaagtacactgtgtggaattttgttccaaaaaatttatttgaacagttcagaagagtggcaaacttttattttcttattatatttttggttcagcttatgattgatacacctaccagtccagttaccagtggacttccattattctttgtgataacagtaactgccataaagcagggatatgaagattggttacggcataactcagataatgaagtaaatggagctcctgtttatgttgttcgaagtggtggccttgtaaaaactagatcaaaaaacattcgggtgggtgatattgttcgaatagccaaagatgaaatttttcctgcagacttggtgcttctgtcctcagatcgactggatggttcctgtcacgttacaactgctagtttggacggagaaactaacctgaaggtttgcttgcatatgtttgagtattgctcttggtgaacaaagtgtctttggattataattatacttaactttggttaaagtagtaaagtttgaccagattaaggggaagtttttaaaattactatttcaaaaataaaaaggttttaagaaagaa

SEQ ID NO: 109805 - DNA, 488 bp, Homo sapiens
  Payload ID: 1558
  Gene Symbol: ATP11B
  Gene Name: ATPase, class VI, type 11B
  ENST ID: ENST00000484691
  CDS Start-End: 1-358
gccatttttgggctcccagaatatgtattttgtgtttattcagctcctgtcaagtggttctgcttggtttgccataatcctcatggttgttacatgtctatttcttgatatcataaagaaggtctttgaccgacacctccaccctacaagtactgaaaaggcacagatgtactccaacacagttgctttaagtgacgagttcatcgcactgcagccattgtcgagggcaaggaatcagctgagcaaacttagcttactgaaacaaatgcaggtatcaagtgcttggactccatgtgctgtttcccggaaggagaagcagcgtgtgcatctgttggaagaatgctggaacgagttataggaagatgtagtccaacccacatcagcaggtgtgaaatctctctaagtagcctttgctgcagatgagtatcctatctggaacaggatgaacctgccgctctagatacctaataaatcagcagctggtttta

SEQ ID NO: 109806 - DNA, 1660 bp, Homo sapiens
  Payload ID: 1558
  Gene Symbol: ATP11B
  Gene Name: ATPase, class VI, type 11B
  ENST ID: ENST00000491699
  CDS Start-End: 1-442
gatggctctggaaactcatttttggacttggatcaaccatctcgttacctggggatctattatattttattttgtattttccttgttttatggagggattctctggccatttttgggctcccagaatatgtattttgtgtttattcagctcctgtcaagtggttctgcttggtttgccataatcctcatggttgttacatgtctatttcttgatatcataaagaaggtctttgaccgacacctccaccctacaagtactgaaaaggcacagcttactgaaacaaatgcaggtatcaagtgcttggactccatgtgctgtttcccggaaggagaagcagcgtgtgcatctgttggaagaatgctggaacgagttataggaagatgtagtccaacccacatcagcaggtgtgaaatctctctaagtagcctttgctgcagatgagtatcctatctggaacaggatgaacctgccgctctagatacctaataaatcagcagctggttttaccaactgaagcaggaagtctgctatttattagcactctttggtggtagatttcactttgtggctttggggtaagggctttttcactcacaaaggaagagaaagcacctttgaagagacttcatctaatgaacaaaaaattttgtttcataatctttctaaaatgtgctcagtaggagtgtgtttatggtactcttttatggtttgtataactttcttttttaaattatacatatactatttcctttttatttttttaaaatttttttgctttttgtctttacaaaataatctcaacataacagtgaagtcaaaggctttccttttcttactctgtatgtatattttccagttggttatttgaggctttgaggtatttataaacacaaaaggctgtatttctgctcccctacctcttcttatgtctgtaatgaagttttgaaatgagtcatgatttttaagtttcttttgcttggtatttattgcctaattaaaagtgtatgagttagaacaggctttttaaattatggagtaaaagaatcttagcatttttgtcccctcctaaatctgtttcttgaatgagatttatcaccatgcctgctgttgtgcaccataacgaaaaaaaacaccttttggtaaacaccatttaaaattcatttaaacttgcaatggatttatttattcatacatttccccaagagttatatcactatttagaggatgttagggggtagaaagagctttttccacacttggtgttctttaggtgaatgataccatattctcaaaatcagggcagcagtacacggtatgcatggaggtacaaatgggcagggagagatgttggttgccattgtcccaaatgtgctacatgaatattagcactttctacatgtgccagggcttggaaaaggttggaaattaccccaggaacaggttataaagagtgaagaaggcactactcctatctactggaaaaaggatttttattatttggttagctttgtgttttaaaaaaatgatgagtatgatatcattcatctgttataaaattcaggtaacttttactggtgaacttgttagttctcactttagctttagcttagccatgcctttatgatacaattgaatttataaatagcattcttatgttaa

SEQ ID NO: 109807 - DNA, 6115 bp, Homo sapiens
  Payload ID: 1559
  Gene Symbol: ATP11C
  Gene Name: ATPase, class VI, type 11C
  Uniprot ID: Q8NB49
  ENST ID: ENST00000327569
  CDS Start-End: 100-3498
ttacaaggatcacaggggttggtacaagttgcttgataatctgcagcattctctctgagatttagctgccattgtgttgccaaatttctgcatgtcagtatgcagatggtcccatctctccctccagcctctgagtgtgctggagaagagaaacgagttggcacacgcacagtgtttgttggcaatcatccagtttcggaaacagaagcttacattgcacaaagattttgtgataatagaatagtctcatctaagtatacactttggaattttctcccaaagaatctgtttgaacagtttagaagaattgcaaatttttattttctcataatcttccttgtacaggtcacagtagacacaccaactagcccagttaccagtggacttccacttttctttgttataactgttacagccatcaagcagggatatgaggattgtctgagacacagagctgacaatgaagtcaacaaaagcactgtttacattattgaaaatgcaaagcgagtgagaaaagaaagtgaaaaaatcaaggttggtgatgtagtagaagtacaggcagatgaaacctttccctgtgatcttattcttctatcatcttgcaccactgatggaacctgttatgtcactacagccagtcttgatggggaatccaattgcaagacacattatgcagtacgtgataccattgcactgtgtacagcagaatccatcgataccctccgagcagcaattgaatgtgaacagcctcaacctgacctctacaaatttgttgggcgaatcaatatctacagtaatagtcttgaggctgttgccaggtctttgggacctgaaaatctcttgctgaaaggagctacgctaaaaaataccgagaagatatatggagttgctgtttacactggaatggaaaccaaaatggctttgaactaccaagggaaatctcagaaacgttctgctgttgaaaaatctattaatgctttcctgattgtatatttatttatcttactgaccaaagctgcagtatgcactactctaaagtatgtttggcaaagtaccccatacaatgatgaaccttggtataaccaaaagactcagaaagagcgagagaccttgaaggttttaaaaatgttcaccgacttcctatcatttatggttctattcaactttatcattcctgtctccatgtacgtcacagtagaaatgcagaaattcttgggctccttcttcatctcatgggataaggacttttatgatgaagaaattaatgaaggagccctggttaacacatcagaccttaatgaagaacttggtcaggtggattatgtatttacagataagactggaacactcactgaaaacagcatggaattcattgaatgctgcatagatggccacaaatataaaggtgtaactcaagaggttgatggattatctcaaactgatggaactttaacatattttgacaaagtagataagaatcgagaagagctgtttctacgtgccttgtgtttatgtcatactgtagaaatcaaaacaaacgatgctgttgatggagctacagaatcagctgaattaacctatatctcctcttcaccagatgaaatagctttggtgaaaggagctaaaaggtacgggttcacatttttaggaaatcgaaatggatatatgagagtagagaaccaaagaaaagaaatagaagaatatgaacttcttcacaccttaaactttgatgctgtccggcgacgtatgagtgtaattgtgaagactcaagaaggagacatacttctcttttgtaaaggagcagactcggcagtttttcccagagtgcaaaatcatgaaattgagttaactaaagtccatgtggaacgtaatgcaatggatgggtatcggacactctgtgtagccttcaaagaaattgctccagatgattatgaaagaattaacagacagctcatagaggcaaaaatggccttacaagacagagaagaaaaaatggaaaaagttttcgatgatattgagacaaacatgaatttaattggagccactgcagttgaagacaagctacaagatcaagctgcagagaccattgaagctctgcatgcagcaggcctgaaagtctgggtgctcactggggacaagatggagacagctaaatccacatgctatgcctgccgccttttccagaccaacactgagctcttagaactaaccacaaaaaccattgaagaaagtgaaaggaaagaagatcgattacatgaattattgatagaatatcgcaagaaattgctgcatgagtttcctaaaagtactagaagctttaaaaaagcatggacagaacatcaggaatatggattaatcatagatggctccacattgtcactcatactaaattctagtcaagactctagttcaaacaattacaaaagcattttcctacaaatatgtatgaagtgtactgcagtgctctgctgtcggatggcaccattacagaaagcccagattgtcagaatggtgaagaatttaaaaggcagcccaataactctgtcgataggtgatggtgccaatgatgttagtatgatcttggaatcccatgtgggaataggtattaaaggcaaagaaggtcgccaagcagctaggaatagcgattattctgttccaaagtttaaacacttaaagaaactgctgttggctcatggacatctatattatgtgagaatagcacaccttgtacagtacttcttctataagaacctttgtttcattttgccacagtttttgtaccagttcttctgtggattctcacaacagccactgtatgatgctgcttaccttacaatgtacaatatctgcttcacatccttgcccatcctggcctatagtctactggaacagcacatcaacattgacactctgacctcagatccccgattgtatatgaaaatttctggcaatgccatgctacagttgggccccttcttatattggacatttctggctgcctttgaagggacagtgttcttctttgggacttactttctttttcagactgcatccctagaagaaaatggaaaggtatacggaaactggacttttggaaccattgtttttacagtcttagtattcactgtaaccctgaagcttgccttggatacccgattctggacgtggataaatcactttgtgatttggggttctttagccttctatgtatttttctcattcttctggggaggaattatttggccttttctcaagcaacagagaatgtattttgtatttgcccaaatgctgtcttctgtatccacatggttggctataattcttctaatatttatcagcctgttccctgagattcttctgatagtattaaagaatgtaagaagaagaagtgccaggagaaatctgagctgtagaagggcatctgactcattatccgccagaccttcagtcagacctcttcttttacgaacattctcagacgaatctaatgtattgtaacagaatccgaatcttgaactgcctatgttattgtcctacaagcatactgacagtggttacagctaaaaaagaaagcatgaagaaacaactacaaaaagttatcatctcaggatacttgatacgcaacacactaaaccactctcatgtctagagttcacaataaatgttcattaaaataccaaatgattctcttaagcatttaccattattgtaagtagcctttatggccaaagctgtaagttaagaattatatgaaagttgaaagcaagaatacttagaattctggctttagttagagtaatataactcaaatgggtgctcttttaacccatgaactttgtgaatggatttaaatacaatagtatgaagtagaagttatgcaatgagaatgaatagattttgctaatactactttttttgcctggcagaagaaatagactatttggatcacatttctcattcctcctaaatgatcatcttaattttttttcccaagtacataaggaatacttgaaaatacagaataactaaatagtatcaatgcatcagacagaatagttaatcccttctgtttacccatgtgctactaatgtcttggtagaatattcttgccaaaaaaataccttgaacgcttatgtggaaagtgttaacttacgggtatttttgtgggaatagaaaaaaattgtttattttttattcttctgaattaaaccccacttatgggtgtaagcctactagacttgaaaataaagtataaaacatttccaatcacttagtagcccctcaaagtagttagaaaataaacagatttttccagtgttgattttactgggatctgcagtaaggtggtttaaaccatagttatataaaaataaaggtcattctgaatatcagccttttataattttatgtgaagaggaagaaatatagcttattttaaacttttgacggtttttatttgaaagagattgcatttatgcatatatgcagtgctttttcttaaacttggccaatttggaaagggggaaggagccaccccaaaacggtggttcagcttgtagagccatgactctgtgaagatgaatgttgtctcttaacttggacagggaaatggtctaactctaaaccatgtaactgaccttagtaaagtccttgactaactgaactagaaggaaggtttagccttctaattagttcacttgaaacataaatgtgaaatgtcttcattcaatgttaaacacatacttttttggatataaatgaccatatttatttgactgctagtttttttgttttttttttgtctttctggcatgcctgtactattattaatgtttatattgtaccttgatttggaaaagtattggagttaatctgtattatatttatatagtccatatggcacatttgattcttccacatatattttgtgttaatgtttaggtatgatttttttctaaattctagaaaagaacataatttcagttatcagaagccattccatcattatagaccctttttcattatttcatttgctctcatatatcagtattatttttgagcattttgttacatgtcattcacaacttacctaagtgtgctgtgttctggtagcccgtatttgaggtaagctgctgaaaacaaaagtctctatattctttgcctattccaaagagctaaaaaagtctaacccaggaaagcttttgatattttgtgtttgttttcttgttcttatggttgttgttgctgtattatgattgctgttttacataaaatctatgggaactgtgaatacagacaagagagccacagtagagaggcttgtttaatgcagtaccattggagagttaacagaataatctagtagaaaaataactggttgcatgtaaaattccttccagccagaaagaaagaaagacaaggagtaagggggatttagagttatgtctcagctacacattacattgtgatactgcagctcaaattcagaatggcaatgatacatgatatcatggcctagatccttgagagggacctggctttcctttttaaaagatattttactgaagagctaaaaactggccagtgtggggttagcagatcgaataacttgaaatagaccatgcagtattcctagcactcaatgtaatcaccctatttgtgacagagaaagggaaaaaaatataataagatcatctacctataatttgaataattttgagctatcaaaatgtctttgtaattttcacaaccgctgtccattgtttgaggatgttacctactaaactgaaaacattcattccatatctacttacacatacaccagcaacagtataaatgtaagcctaactttgcaaaattcgtaataatttagtgatggaattttttaataacatgcagtatataaatgtgcagattttatgcgtgttgacaaaatcatttttcagcttgcaaaatgggactgcaatattacatttttcacttaagcagttttttacatctacgttgttgctttctaaaatgaatgtgaatgccatcttttatgactgcaacttgccttttccattacagaaatttttgtttgatgtaatcaataaactttggtatgatatgattg

SEQ ID NO: 109808 - DNA, 6010 bp, Homo sapiens
  Payload ID: 1559
  Gene Symbol: ATP11C
  Gene Name: ATPase, class VI, type 11C
  Uniprot ID: Q8NB49
  ENST ID: ENST00000361648
  CDS Start-End: 100-3459
ttacaaggatcacaggggttggtacaagttgcttgataatctgcagcattctctctgagatttagctgccattgtgttgccaaatttctgcatgtcagtatgcagatggtcccatctctccctccagcctctgagtgtgctggagaagagaaacgagttggcacacgcacagtgtttgttggcaatcatccagtttcggaaacagaagcttacattgcacaaagattttgtgataatagaatagtctcatctaagtatacactttggaattttctcccaaagaatctgtttgaacagtttagaagaattgcaaatttttattttctcataatcttccttgtacaggtcacagtagacacaccaactagcccagttaccagtggacttccacttttctttgttataactgttacagccatcaagcagggatatgaggattgtctgagacacagagctgacaatgaagtcaacaaaagcactgtttacattattgaaaatgcaaagcgagtgagaaaagaaagtgaaaaaatcaaggttggtgatgtagtagaagtacaggcagatgaaacctttccctgtgatcttattcttctatcatcttgcaccactgatggaacctgttatgtcactacagccagtcttgatggggaatccaattgcaagacacattatgcagtacgtgataccattgcactgtgtacagcagaatccatcgataccctccgagcagcaattgaatgtgaacagcctcaacctgacctctacaaatttgttgggcgaatcaatatctacagtaatagtcttgaggctgttgccaggtctttgggacctgaaaatctcttgctgaaaggagctacgctaaaaaataccgagaagatatatggagttgctgtttacactggaatggaaaccaaaatggctttgaactaccaagggaaatctcagaaacgttctgctgttgaaaaatctattaatgctttcctgattgtatatttatttatcttactgaccaaagctgcagtatgcactactctaaagtatgtttggcaaagtaccccatacaatgatgaaccttggtataaccaaaagactcagaaagagcgagagaccttgaaggttttaaaaatgttcaccgacttcctatcatttatggttctattcaactttatcattcctgtctccatgtacgtcacagtagaaatgcagaaattcttgggctccttcttcatctcatgggataaggacttttatgatgaagaaattaatgaaggagccctggttaacacatcagaccttaatgaagaacttggtcaggtggattatgtatttacagataagactggaacactcactgaaaacagcatggaattcattgaatgctgcatagatggccacaaatataaaggtgtaactcaagaggttgatggattatctcaaactgatggaactttaacatattttgacaaagtagataagaatcgagaagagctgtttctacgtgccttgtgtttatgtcatactgtagaaatcaaaacaaacgatgctgttgatggagctacagaatcagctgaattaacctatatctcctcttcaccagatgaaatagctttggtgaaaggagctaaaaggtacgggttcacatttttaggaaatcgaaatggatatatgagagtagagaaccaaagaaaagaaatagaagaatatgaacttcttcacaccttaaactttgatgctgtccggcgacgtatgagtgtaattgtgaagactcaagaaggagacatacttctcttttgtaaaggagcagactcggcagtttttcccagagtgcaaaatcatgaaattgagttaactaaagtccatgtggaacgtaatgcaatggatgggtatcggacactctgtgtagccttcaaagaaattgctccagatgattatgaaagaattaacagacagctcatagaggcaaaaatggccttacaagacagagaagaaaaaatggaaaaagttttcgatgatattgagacaaacatgaatttaattggagccactgcagttgaagacaagctacaagatcaagctgcagagaccattgaagctctgcatgcagcaggcctgaaagtctgggtgctcactggggacaagatggagacagctaaatccacatgctatgcctgccgccttttccagaccaacactgagctcttagaactaaccacaaaaaccattgaagaaagtgaaaggaaagaagatcgattacatgaattattgatagaatatcgcaagaaattgctgcatgagtttcctaaaagtactagaagctttaaaaaagcatggacagaacatcaggaatatggattaatcatagatggctccacattgtcactcatactaaattctagtcaagactctagttcaaacaattacaaaagcattttcctacaaatatgtatgaagtgtactgcagtgctctgctgtcggatggcaccattacagaaagcccagattgtcagaatggtgaagaatttaaaaggcagcccaataactctgtcgataggtgatggtgccaatgatgttagtatgatcttggaatcccatgtgggaataggtattaaaggcaaagaaggtcgccaagcagctaggaatagcgattattctgttccaaagtttaaacacttaaagaaactgctgttggctcatggacatctatattatgtgagaatagcacaccttgtacagtacttcttctataagaacctttgtttcattttgccacagtttttgtaccagttcttctgtggattctcacaacagccactgtatgatgctgcttaccttacaatgtacaatatctgcttcacatccttgcccatcctggcctatagtctactggaacagcacatcaacattgacactctgacctcagatccccgattgtatatgaaaatttctggcaatgccatgctacagttgggccccttcttatattggacatttctggctgcctttgaagggacagtgttcttctttgggacttactttctttttcagactgcatccctagaagaaaatggaaaggtatacggaaactggacttttggaaccattgtttttacagtcttagtattcactgtaaccctgaagcttgccttggatacccgattctggacgtggataaatcactttgtgatttggggttctttagccttctatgtatttttctcattcttctggggaggaattatttggccttttctcaagcaacagagaatgtattttgtatttgcccaaatgctgtcttctgtatccacatggttggctataattcttctaatatttatcagcctgttccctgagattcttctgatagtattaaagaatgtaagaagaagaagtgccaggaatccgaatcttgaactgcctatgttattgtcctacaagcatactgacagtggttacagctaaaaaagaaagcatgaagaaacaactacaaaaagttatcatctcaggatacttgatacgcaacacactaaaccactctcatgtctagagttcacaataaatgttcattaaaataccaaatgattctcttaagcatttaccattattgtaagtagcctttatggccaaagctgtaagttaagaattatatgaaagttgaaagcaagaatacttagaattctggctttagttagagtaatataactcaaatgggtgctcttttaacccatgaactttgtgaatggatttaaatacaatagtatgaagtagaagttatgcaatgagaatgaatagattttgctaatactactttttttgcctggcagaagaaatagactatttggatcacatttctcattcctcctaaatgatcatcttaattttttttcccaagtacataaggaatacttgaaaatacagaataactaaatagtatcaatgcatcagacagaatagttaatcccttctgtttacccatgtgctactaatgtcttggtagaatattcttgccaaaaaaataccttgaacgcttatgtggaaagtgttaacttacgggtatttttgtgggaatagaaaaaaattgtttattttttattcttctgaattaaaccccacttatgggtgtaagcctactagacttgaaaataaagtataaaacatttccaatcacttagtagcccctcaaagtagttagaaaataaacagatttttccagtgttgattttactgggatctgcagtaaggtggtttaaaccatagttatataaaaataaaggtcattctgaatatcagccttttataattttatgtgaagaggaagaaatatagcttattttaaacttttgacggtttttatttgaaagagattgcatttatgcatatatgcagtgctttttcttaaacttggccaatttggaaagggggaaggagccaccccaaaacggtggttcagcttgtagagccatgactctgtgaagatgaatgttgtctcttaacttggacagggaaatggtctaactctaaaccatgtaactgaccttagtaaagtccttgactaactgaactagaaggaaggtttagccttctaattagttcacttgaaacataaatgtgaaatgtcttcattcaatgttaaacacatacttttttggatataaatgaccatatttatttgactgctagtttttttgttttttttttgtctttctggcatgcctgtactattattaatgtttatattgtaccttgatttggaaaagtattggagttaatctgtattatatttatatagtccatatggcacatttgattcttccacatatattttgtgttaatgtttaggtatgatttttttctaaattctagaaaagaacataatttcagttatcagaagccattccatcattatagaccctttttcattatttcatttgctctcatatatcagtattatttttgagcattttgttacatgtcattcacaacttacctaagtgtgctgtgttctggtagcccgtatttgaggtaagctgctgaaaacaaaagtctctatattctttgcctattccaaagagctaaaaaagtctaacccaggaaagcttttgatattttgtgtttgttttcttgttcttatggttgttgttgctgtattatgattgctgttttacataaaatctatgggaactgtgaatacagacaagagagccacagtagagaggcttgtttaatgcagtaccattggagagttaacagaataatctagtagaaaaataactggttgcatgtaaaattccttccagccagaaagaaagaaagacaaggagtaagggggatttagagttatgtctcagctacacattacattgtgatactgcagctcaaattcagaatggcaatgatacatgatatcatggcctagatccttgagagggacctggctttcctttttaaaagatattttactgaagagctaaaaactggccagtgtggggttagcagatcgaataacttgaaatagaccatgcagtattcctagcactcaatgtaatcaccctatttgtgacagagaaagggaaaaaaatataataagatcatctacctataatttgaataattttgagctatcaaaatgtctttgtaattttcacaaccgctgtccattgtttgaggatgttacctactaaactgaaaacattcattccatatctacttacacatacaccagcaacagtataaatgtaagcctaactttgcaaaattcgtaataatttagtgatggaattttttaataacatgcagtatataaatgtgcagattttatgcgtgttgacaaaatcatttttcagcttgcaaaatgggactgcaatattacatttttcacttaagcagttttttacatctacgttgttgctttctaaaatgaatgtgaatgccatcttttatgactgcaacttgccttttccattacagaaatttttgtttgatgtaatcaataaactttggtatgatatgattg

SEQ ID NO: 109809 - DNA, 6924 bp, Homo sapiens
  Payload ID: 1559
  Gene Symbol: ATP11C
  Gene Name: ATPase, class VI, type 11C
  ENST ID: ENST00000370557
  CDS Start-End: 1029-4370
cgctgcgcagcagcaacgacacaaagcctgactttacaacctcagagaaagtggaagtaagaaggcttaggtgggcaggcaggacgagagaaagactgagaggagggaaagccgcgtaggtgggagtacagcggcgcgagggtcgagggggaaccctcgtcggtgcagatgaggagggtgggctttcagaactagtcccccctcgcaccccgccccgcccctcccgcgctggggtcttcacggtgccctgcctcagagcccggctccaccacgcccggaagagggagtctggccgtcggctggctcagggcgggccggttggctgtacccaggctccctggcccgagtgcgggaccagagcgcggggcggcgcggcagccgcggaccgaggaggggctgcgagcgaaacggcgcggcgcggcacggcggacgagttagggccggggcgagggaggctgtggctcccgacagagacaggggagtagtgtcgggctgaggcgaggtgaggcgcggggtgcctcgggagggttccccgtgccccgaggggggcggccgcggagtccagcggggaggcgggcggtggtgccgcgtcggggaagagcgcatcccgcggggtgccgagcccggcgctggcggagagacgggggcgccccctccccacaggaggagcctcgcgctcctccgccatccttcccccgcgcggcgggctcgccttctcagtgggtgctgcgcgagctgccggcccggggtgccggggccagataagggcgatccgcggggccgccgcccccgggtcaggcaggccgggggcgggccgcgagtgaggcggggcggcggctaggctgcgggcggctggggggcgggggagcgcggagagccgaggggggcaggcggcgagcgggtggcccggccgcccgcctcgctgctccgcttggcgccgccggcccacgccgcagtgtgttttgtggacggcgccttcccagacagcccggtagagcccagctcagcgcccggcagccttcgacgcgatgttccgccggagcttgaatcgtttttgtgctggagaagagaaacgagttggcacacgcacagtgtttgttggcaatcatccagtttcggaaacagaagcttacattgcacaaagattttgtgataatagaatagtctcatctaagtatacactttggaattttctcccaaagaatctgtttgaacagtttagaagaattgcaaatttttattttctcataatcttccttgtacaggtcacagtagacacaccaactagcccagttaccagtggacttccacttttctttgttataactgttacagccatcaagcagggatatgaggattgtctgagacacagagctgacaatgaagtcaacaaaagcactgtttacattattgaaaatgcaaagcgagtgagaaaagaaagtgaaaaaatcaaggttggtgatgtagtagaagtacaggcagatgaaacctttccctgtgatcttattcttctatcatcttgcaccactgatggaacctgttatgtcactacagccagtcttgatggggaatccaattgcaagacacattatgcagtacgtgataccattgcactgtgtacagcagaatccatcgataccctccgagcagcaattgaatgtgaacagcctcaacctgacctctacaaatttgttgggcgaatcaatatctacagtaatagtcttgaggctgttgccaggtctttgggacctgaaaatctcttgctgaaaggagctacgctaaaaaataccgagaagatatatggagttgctgtttacactggaatggaaaccaaaatggctttgaactaccaagggaaatctcagaaacgttctgctgttgaaaaatctattaatgctttcctgattgtatatttatttatcttactgaccaaagctgcagtatgcactactctaaagtatgtttggcaaagtaccccatacaatgatgaaccttggtataaccaaaagactcagaaagagcgagagaccttgaaggttttaaaaatgttcaccgacttcctatcatttatggttctattcaactttatcattcctgtctccatgtacgtcacagtagaaatgcagaaattcttgggctccttcttcatctcatgggataaggacttttatgatgaagaaattaatgaaggagccctggttaacacatcagaccttaatgaagaacttggtcaggtggattatgtatttacagataagactggaacactcactgaaaacagcatggaattcattgaatgctgcatagatggccacaaatataaaggtgtaactcaagaggttgatggattatctcaaactgatggaactttaacatattttgacaaagtagataagaatcgagaagagctgtttctacgtgccttgtgtttatgtcatactgtagaaatcaaaacaaacgatgctgttgatggagctacagaatcagctgaattaacctatatctcctcttcaccagatgaaatagctttggtgaaaggagctaaaaggtacgggttcacatttttaggaaatcgaaatggatatatgagagtagagaaccaaagaaaagaaatagaagaatatgaacttcttcacaccttaaactttgatgctgtccggcgacgtatgagtgtaattgtgaagactcaagaaggagacatacttctcttttgtaaaggagcagactcggcagtttttcccagagtgcaaaatcatgaaattgagttaactaaagtccatgtggaacgtaatgcaatggatgggtatcggacactctgtgtagccttcaaagaaattgctccagatgattatgaaagaattaacagacagctcatagaggcaaaaatggccttacaagacagagaagaaaaaatggaaaaagttttcgatgatattgagacaaacatgaatttaattggagccactgcagttgaagacaagctacaagatcaagctgcagagaccattgaagctctgcatgcagcaggcctgaaagtctgggtgctcactggggacaagatggagacagctaaatccacatgctatgcctgccgccttttccagaccaacactgagctcttagaactaaccacaaaaaccattgaagaaagtgaaaggaaagaagatcgattacatgaattattgatagaatatcgcaagaaattgctgcatgagtttcctaaaagtactagaagctttaaaaaagcatggacagaacatcaggaatatggattaatcatagatggctccacattgtcactcatactaaattctagtcaagactctagttcaaacaattacaaaagcattttcctacaaatatgtatgaagtgtactgcagtgctctgctgtcggatggcaccattacagaaagcccagattgtcagaatggtgaagaatttaaaaggcagcccaataactctgtcgataggtgatggtgccaatgatgttagtatgatcttggaatcccatgtgggaataggcaaagaaggtcgccaagcagctaggaatagcgattattctgttccaaagtttaaacacttaaagaaactgctgttggctcatggacatctatattatgtgagaatagcacaccttgtacagtacttcttctataagaacctttgtttcattttgccacagtttttgtaccagttcttctgtggattctcacaacagccactgtatgatgctgcttaccttacaatgtacaatatctgcttcacatccttgcccatcctggcctatagtctactggaacagcacatcaacattgacactctgacctcagatccccgattgtatatgaaaatttctggcaatgccatgctacagttgggccccttcttatattggacatttctggctgcctttgaagggacagtgttcttctttgggacttactttctttttcagactgcatccctagaagaaaatggaaaggtatacggaaactggacttttggaaccattgtttttacagtcttagtattcactgtaaccctgaagcttgccttggatacccgattctggacgtggataaatcactttgtgatttggggttctttagccttctatgtatttttctcattcttctggggaggaattatttggccttttctcaagcaacagagaatgtattttgtatttgcccaaatgctgtcttctgtatccacatggttggctataattcttctaatatttatcagcctgttccctgagattcttctgatagtattaaagaatgtaagaagaagaagtgccaggaatccgaatcttgaactgcctatgttattgtcctacaagcatactgacagtggttacagctaaaaaagaaagcatgaagaaacaactacaaaaagttatcatctcaggatacttgatacgcaacacactaaaccactctcatgtctagagttcacaataaatgttcattaaaataccaaatgattctcttaagcatttaccattattgtaagtagcctttatggccaaagctgtaagttaagaattatatgaaagttgaaagcaagaatacttagaattctggctttagttagagtaatataactcaaatgggtgctcttttaacccatgaactttgtgaatggatttaaatacaatagtatgaagtagaagttatgcaatgagaatgaatagattttgctaatactactttttttgcctggcagaagaaatagactatttggatcacatttctcattcctcctaaatgatcatcttaattttttttcccaagtacataaggaatacttgaaaatacagaataactaaatagtatcaatgcatcagacagaatagttaatcccttctgtttacccatgtgctactaatgtcttggtagaatattcttgccaaaaaaataccttgaacgcttatgtggaaagtgttaacttacgggtatttttgtgggaatagaaaaaaattgtttattttttattcttctgaattaaaccccacttatgggtgtaagcctactagacttgaaaataaagtataaaacatttccaatcacttagtagcccctcaaagtagttagaaaataaacagatttttccagtgttgattttactgggatctgcagtaaggtggtttaaaccatagttatataaaaataaaggtcattctgaatatcagccttttataattttatgtgaagaggaagaaatatagcttattttaaacttttgacggtttttatttgaaagagattgcatttatgcatatatgcagtgctttttcttaaacttggccaatttggaaagggggaaggagccaccccaaaacggtggttcagcttgtagagccatgactctgtgaagatgaatgttgtctcttaacttggacagggaaatggtctaactctaaaccatgtaactgaccttagtaaagtccttgactaactgaactagaaggaaggtttagccttctaattagttcacttgaaacataaatgtgaaatgtcttcattcaatgttaaacacatacttttttggatataaatgaccatatttatttgactgctagtttttttgttttttttttgtctttctggcatgcctgtactattattaatgtttatattgtaccttgatttggaaaagtattggagttaatctgtattatatttatatagtccatatggcacatttgattcttccacatatattttgtgttaatgtttaggtatgatttttttctaaattctagaaaagaacataatttcagttatcagaagccattccatcattatagaccctttttcattatttcatttgctctcatatatcagtattatttttgagcattttgttacatgtcattcacaacttacctaagtgtgctgtgttctggtagcccgtatttgaggtaagctgctgaaaacaaaagtctctatattctttgcctattccaaagagctaaaaaagtctaacccaggaaagcttttgatattttgtgtttgttttcttgttcttatggttgttgttgctgtattatgattgctgttttacataaaatctatgggaactgtgaatacagacaagagagccacagtagagaggcttgtttaatgcagtaccattggagagttaacagaataatctagtagaaaaataactggttgcatgtaaaattccttccagccagaaagaaagaaagacaaggagtaagggggatttagagttatgtctcagctacacattacattgtgatactgcagctcaaattcagaatggcaatgatacatgatatcatggcctagatccttgagagggacctggctttcctttttaaaagatattttactgaagagctaaaaactggccagtgtggggttagcagatcgaataacttgaaatagaccatgcagtattcctagcactcaatgtaatcaccctatttgtgacagagaaagggaaaaaaatataataagatcatctacctataatttgaataattttgagctatcaaaatgtctttgtaattttcacaaccgctgtccattgtttgaggatgttacctactaaactgaaaacattcattccatatctacttacacatacaccagcaacagtataaatgtaagcctaactttgcaaaattcgtaataatttagtgatggaattttttaataacatgcagtatataaatgtgcagattttatgcgtgttgacaaaatcatttttcagcttgcaaaatgggactgcaatattacatttttcacttaagcagttttttacatctacgttgttgctttctaaaatgaatgtgaatgccatcttttatgactgcaacttgccttttccattacagaaatttttgtttgatgtaatcaataaactttggtatgatatgattgata

SEQ ID NO: 109810 - DNA, 3165 bp, Homo sapiens
  Payload ID: 1559
  Gene Symbol: ATP11C
  Gene Name: ATPase, class VI, type 11C
  ENST ID: ENST00000450801
  CDS Start-End: 1-519
actctgacctcagatccccgattgtatatgaaaatttctggcaatgccatgctacagttgggccccttcttatattggacatttctggctgcctttgaagggacagtgttcttctttgggacttactttctttttcagactgcatccctagaagaaaatggaaaggtatacggaaactggacttttggaaccattgtttttacagtcttagtattcactgtaaccctgaagcttgccttggatacccgattctggacgtggataaatcactttgtgatttggggttctttagccttctatgtatttttctcattcttctggggaggaattatttggccttttctcaagcaacagagaatgtattttgtatttgcccaaatgctgtcttctgtatccacatggttggctataattcttctaatatttatcagcctgttccctgagattcttctgatagtattaaagaatgtaagaagaagaagtgccagggttcatcacttaatttcctcttctgcataaaaagtatagtaaaaacttcgttatccaatgcaggtgaatccgaatcttgaactgcctatgttattgtcctacaagcatactgacagtggttacagctaaaaaagaaagcatgaagaaacaactacaaaaagttatcatctcaggatacttgatacgcaacacactaaaccactctcatgtctagagttcacaataaatgttcattaaaataccaaatgattctcttaagcatttaccattattgtaagtagcctttatggccaaagctgtaagttaagaattatatgaaagttgaaagcaagaatacttagaattctggctttagttagagtaatataactcaaatgggtgctcttttaacccatgaactttgtgaatggatttaaatacaatagtatgaagtagaagttatgcaatgagaatgaatagattttgctaatactactttttttgcctggcagaagaaatagactatttggatcacatttctcattcctcctaaatgatcatcttaattttttttcccaagtacataaggaatacttgaaaatacagaataactaaatagtatcaatgcatcagacagaatagttaatcccttctgtttacccatgtgctactaatgtcttggtagaatattcttgccaaaaaaataccttgaacgcttatgtggaaagtgttaacttacgggtatttttgtgggaatagaaaaaaattgtttattttttattcttctgaattaaaccccacttatgggtgtaagcctactagacttgaaaataaagtataaaacatttccaatcacttagtagcccctcaaagtagttagaaaataaacagatttttccagtgttgattttactgggatctgcagtaaggtggtttaaaccatagttatataaaaataaaggtcattctgaatatcagccttttataattttatgtgaagaggaagaaatatagcttattttaaacttttgacggtttttatttgaaagagattgcatttatgcatatatgcagtgctttttcttaaacttggccaatttggaaagggggaaggagccaccccaaaacggtggttcagcttgtagagccatgactctgtgaagatgaatgttgtctcttaacttggacagggaaatggtctaactctaaaccatgtaactgaccttagtaaagtccttgactaactgaactagaaggaaggtttagccttctaattagttcacttgaaacataaatgtgaaatgtcttcattcaatgttaaacacatacttttttggatataaatgaccatatttatttgactgctagtttttttgttttttttttgtctttctggcatgcctgtactattattaatgtttatattgtaccttgatttggaaaagtattggagttaatctgtattatatttatatagtccatatggcacatttgattcttccacatatattttgtgttaatgtttaggtatgatttttttctaaattctagaaaagaacataatttcagttatcagaagccattccatcattatagaccctttttcattatttcatttgctctcatatatcagtattatttttgagcattttgttacatgtcattcacaacttacctaagtgtgctgtgttctggtagcccgtatttgaggtaagctgctgaaaacaaaagtctctatattctttgcctattccaaagagctaaaaaagtctaacccaggaaagcttttgatattttgtgtttgttttcttgttcttatggttgttgttgctgtattatgattgctgttttacataaaatctatgggaactgtgaatacagacaagagagccacagtagagaggcttgtttaatgcagtaccattggagagttaacagaataatctagtagaaaaataactggttgcatgtaaaattccttccagccagaaagaaagaaagacaaggagtaagggggatttagagttatgtctcagctacacattacattgtgatactgcagctcaaattcagaatggcaatgatacatgatatcatggcctagatccttgagagggacctggctttcctttttaaaagatattttactgaagagctaaaaactggccagtgtggggttagcagatcgaataacttgaaatagaccatgcagtattcctagcactcaatgtaatcaccctatttgtgacagagaaagggaaaaaaatataataagatcatctacctataatttgaataattttgagctatcaaaatgtctttgtaattttcacaaccgctgtccattgtttgaggatgttacctactaaactgaaaacattcattccatatctacttacacatacaccagcaacagtataaatgtaagcctaactttgcaaaattcgtaataatttagtgatggaattttttaataacatgcagtatataaatgtgcagattttatgcgtgttgacaaaatcatttttcagcttgcaaaatgggactgcaatattacatttttcacttaagcagttttttacatctacgttgttgctttctaaaatgaatgtgaatgccatcttttatgactgcaacttgccttttccattacagaaatttttgtttgatgtaatcaataaactttggtatgatatg

SEQ ID NO: 109811 - DNA, 606 bp, Homo sapiens
  Payload ID: 1559
  Gene Symbol: ATP11C
  Gene Name: ATPase, class VI, type 11C
  ENST ID: ENST00000422228
  CDS Start-End: 1-606
ttgaatgctgcatagatggccacaaatataaaggtgtaactcaagaggttgatggattatctcaaactgatggaactttaacatattttgacaaagtagataagaatcgagaagagctgtttctacgtgccttgtgtttatgtcatactgtagaaatcaaaacaaacgatgctgttgatggagctacagaatcagctgaattaacctatatctcctcttcaccagatgaaatagctttggtgaaaggagctaaaagatatgaacttcttcacaccttaaactttgatgctgtccggcgacgtatgagtgtaattgtgaagactcaagaaggagacatacttctcttttgtaaaggagcagactcggcagtttttcccagagtgcaaaatcatgaaattgagttaactaaagtccatgtggaacgtaatgcaatggatgggtatcggacactctgtgtagccttcaaagaaattgctccagatgattatgaaagaattaacagacagctcatagaggcaaaaatggccttacaagacagagaagaaaaaatggaaaaagttttcgatgatattgagacaaacatgaatttaattggagccactgcag

SEQ ID NO: 109812 - DNA, 3113 bp, Homo sapiens
  Payload ID: 1559
  Gene Symbol: ATP11C
  Gene Name: ATPase, class VI, type 11C
  ENST ID: ENST00000433868
  CDS Start-End: 1-496
tgaagggacagtgttcttctttgggacttactttctttttcagactgcatccctagaagaaaatggaaaggtatacggaaactggacttttggaaccattgtttttacagtcttagtattcactgtaaccctgaagcttgccttggatacccgattctggacgtggataaatcactttgtgatttggggttctttagccttctatgtatttttctcattcttctggggaggaattatttggccttttctcaagcaacagagaatgtattttgtatttgcccaaatgctgtcttctgtatccacatggttggctataattcttctaatatttatcagcctgttccctgagattcttctgatagtattaaagaatgtaagaagaagaagtgccaggagaaatctgagctgtagaagggcatctgactcattatccgccagaccttcagtcagacctcttcttttacgaacattctcagacgaatctaatgtattgtaacagaatccgaatcttgaactgcctatgttattgtcctacaagcatactgacagtggttacagctaaaaaagaaagcatgaagaaacaactacaaaaagttatcatctcaggatacttgatacgcaacacactaaaccactctcatgtctagagttcacaataaatgttcattaaaataccaaatgattctcttaagcatttaccattattgtaagtagcctttatggccaaagctgtaagttaagaattatatgaaagttgaaagcaagaatacttagaattctggctttagttagagtaatataactcaaatgggtgctcttttaacccatgaactttgtgaatggatttaaatacaatagtatgaagtagaagttatgcaatgagaatgaatagattttgctaatactactttttttgcctggcagaagaaatagactatttggatcacatttctcattcctcctaaatgatcatcttaattttttttcccaagtacataaggaatacttgaaaatacagaataactaaatagtatcaatgcatcagacagaatagttaatcccttctgtttacccatgtgctactaatgtcttggtagaatattcttgccaaaaaaataccttgaacgcttatgtggaaagtgttaacttacgggtatttttgtgggaatagaaaaaaattgtttattttttattcttctgaattaaaccccacttatgggtgtaagcctactagacttgaaaataaagtataaaacatttccaatcacttagtagcccctcaaagtagttagaaaataaacagatttttccagtgttgattttactgggatctgcagtaaggtggtttaaaccatagttatataaaaataaaggtcattctgaatatcagccttttataattttatgtgaagaggaagaaatatagcttattttaaacttttgacggtttttatttgaaagagattgcatttatgcatatatgcagtgctttttcttaaacttggccaatttggaaagggggaaggagccaccccaaaacggtggttcagcttgtagagccatgactctgtgaagatgaatgttgtctcttaacttggacagggaaatggtctaactctaaaccatgtaactgaccttagtaaagtccttgactaactgaactagaaggaaggtttagccttctaattagttcacttgaaacataaatgtgaaatgtcttcattcaatgttaaacacatacttttttggatataaatgaccatatttatttgactgctagtttttttgttttttttttgtctttctggcatgcctgtactattattaatgtttatattgtaccttgatttggaaaagtattggagttaatctgtattatatttatatagtccatatggcacatttgattcttccacatatattttgtgttaatgtttaggtatgatttttttctaaattctagaaaagaacataatttcagttatcagaagccattccatcattatagaccctttttcattatttcatttgctctcatatatcagtattatttttgagcattttgttacatgtcattcacaacttacctaagtgtgctgtgttctggtagcccgtatttgaggtaagctgctgaaaacaaaagtctctatattctttgcctattccaaagagctaaaaaagtctaacccaggaaagcttttgatattttgtgtttgttttcttgttcttatggttgttgttgctgtattatgattgctgttttacataaaatctatgggaactgtgaatacagacaagagagccacagtagagaggcttgtttaatgcagtaccattggagagttaacagaataatctagtagaaaaataactggttgcatgtaaaattccttccagccagaaagaaagaaagacaaggagtaagggggatttagagttatgtctcagctacacattacattgtgatactgcagctcaaattcagaatggcaatgatacatgatatcatggcctagatccttgagagggacctggctttcctttttaaaagatattttactgaagagctaaaaactggccagtgtggggttagcagatcgaataacttgaaatagaccatgcagtattcctagcactcaatgtaatcaccctatttgtgacagagaaagggaaaaaaatataataagatcatctacctataatttgaataattttgagctatcaaaatgtctttgtaattttcacaaccgctgtccattgtttgaggatgttacctactaaactgaaaacattcattccatatctacttacacatacaccagcaacagtataaatgtaagcctaactttgcaaaattcgtaataatttagtgatggaattttttaataacatgcagtatataaatgtgcagattttatgcgtgttgacaaaatcatttttcagcttgcaaaatgggactgcaatattacatttttcacttaagcagttttttacatctacgttgttgctttctaaaatgaatgtgaatgccatcttttatgactgcaacttgccttttccattacagaaatttttgtttgatgtaatcaataaactttggtatgatatgattg

SEQ ID NO: 109813 - DNA, 8289 bp, Homo sapiens
  Payload ID: 1560
  Gene Symbol: ATP7A
  Gene Name: ATPase, Cu++ transporting, alpha polypeptide
  Uniprot ID: Q04656
  ENST ID: ENST00000343533
  CDS Start-End: 202-4470
ccgccgcggcggggggtgggaaaagagaagcagagggaggagttgttgctgccgccgccgcagccgcagctactgtgacttctccgattgtgtgagctttgttggagcctgcgtacgtggatttatcgctgccacggtctgcgtagctccagaggtttaaccataggatagagaaaccaggaatgtaatgaggaaatcaaaatggatccaagtatgggtgtgaattctgttaccatttctgttgagggtatgacttgcaattcctgtgtttggaccattgagcagcagattggaaaagtgaatggtgtgcatcacattaaggtatcactggaagaaaaaaatgcaactattatttatgaccctaaactacagactccaaagaccctacaggaagctattgatgacatgggctttgatgctgttatccataatcctgaccctctccctgttttaactgacaccttgtttctgactgttacggcgtcactgactttgccatgggaccatatccaaagcacattgctgaagaccaagggtgtgacagacattaaaatttaccctcagaaaagaactgtagcagtgacaataatcccttctatagtgaatgccaatcagataaaagagctggttccagaactcagtttagatactgggacactggagaaaaagtcaggagcttgtgaagatcatagtatggctcaagctggtgaagtcgtgctgaagatgaaagtggaagggatgacctgccattcatgtactagcactattgaaggaaaaattgggaaactgcaaggtgttcagcgaattaaagtctccctggacaatcaagaagctactattgtttatcaacctcatcttatctcagtagaggaaatgaaaaagcagattgaagctatgggctttccagcatttgtcaaaaagcagcccaagtacctcaaattgggagctattgatgtagaacgtctaaagaacacaccagttaaatcctcagaagggtcacagcaaaggagtccatcatataccaatgattcaacagccactttcatcattgatggcatgcattgtaaatcatgtgtgtcaaatattgaaagtactttatctgcactccaatatgtaagcagcatagtagtttctttagagaataggtctgccattgtgaagtataatgcaagctcagtcactccagaatccctgagaaaagcaatagaggctgtatcaccggggctatatagagttagtatcacaagtgaagttgagagtacctcaaactctccctccagctcatctcttcagaagattcctttgaatgtagttagccagcctctgacacaagaaactgtgataaacattgatggcatgacttgtaattcctgtgtgcagtctattgagggtgtcatatcaaaaaagccaggtgtaaaatccatacgagtctcccttgcaaatagcaatgggactgttgagtatgatcctctactaacctctccagaaacgttgagaggagcaatagaagacatgggatttgatgctaccttgtcagacacgaatgagccgttggtagtaatagctcagccttcatcggaaatgccgcttttgacttcaactaatgaattttatactaaagggatgacaccagttcaagacaaggaggaaggaaagaattcatctaagtgttacatacaggtcactggcatgacttgcgcttcctgtgtagcaaacattgaacggaatttaaggcgggaagaaggaatatattctatacttgtggccctgatggctggcaaggcagaagtaaggtataatcctgctgttatacaacccccaatgatagcagagttcatccgagaacttggatttggagccactgtgatagaaaatgctgatgaaggagatggtgttttggaacttgttgtgaggggaatgacgtgtgcctcctgcgtacataaaatagagtctagtctcacaaaacacagagggatcctatactgctccgtggccctggcaaccaacaaagcacatattaaatatgacccagaaattattggtcctagagatattatccatacaattgaaagcttaggttttgaagcttctttggtcaagaaggatcggtcagcaagtcacttagatcataaacgagaaataagacaatggagacggtcttttcttgtgagtctgtttttctgtattcctgtaatggggctgatgatatatatgatggttatggaccaccactttgcaactcttcaccataatcaaaacatgagtaaagaagaaatgatcaaccttcattcttctatgttcctggagcgccagattcttccaggattgtctgttatgaatttgctgtcctttttattgtgtgtacctgtacagggcaaaacatcagaggctcttgcaaagttaatttcactacaagctacagaagcaactattgtaactcttgattctgataatatcctcctcagtgaagaacaagtggatgtggaacttgtacaacgtggagatatcattaaagtagttccaggaggcaaatttccagtggatggtcgtgttattgaaggacattctatggtagatgagtccctcatcacaggggaggcaatgcctgtggctaagaaacctggcagcacagtgattgctggttccattaaccagaacgggtcactgcttatctgcgcaacacatgttggagcagacacaaccctttctcaaattgtcaaacttgtggaagaggcacaaacatcaaaggctcctatccagcagtttgcagacaaactcagtggctattttgttccttttattgtttttgtttccattgccaccctcttggtatggattgtaattggatttctgaattttgaaattgtggaaacctactttcctggctacaatagaagtatctcccgaacagaaacgataatacgatttgctttccaagcctctatcacagttctgtgtattgcatgtccctgttcactgggactggccactccaactgctgtgatggtgggtacaggagtaggtgctcaaaatggcatactaataaaaggtggagagccattggagatggctcataaggtaaaggtagtggtatttgataagactggaaccattactcacggaaccccagtggtgaatcaagtaaaggttctaactgaaagtaacagaatatcacaccataaaatcttggccattgtgggaactgctgaaagtaacagtgaacaccctctaggaacagccataaccaaatattgcaaacaggagctggacactgaaaccttgggtacctgcatagatttccaggttgtgccaggctgtggtattagctgtaaagtcaccaatattgaaggcttgctacataagaataactggaatatagaggacaataatattaaaaatgcatccctggttcaaattgatgccagtaatgaacagtcatcaacttcgtcttccatgattattgatgcccagatctcaaatgctcttaatgctcagcagtataaagtcctcattggtaaccgggagtggatgattagaaatggtcttgtcattaataacgatgtaaatgatttcatgactgaacatgagagaaaaggtcggactgctgtattagtagcagttgatgatgagctgtgtggcttgatagccattgcagacacagtgaagcctgaagcagaactggctatccatattctgaaatctatgggcttagaagtagttctgatgactggagacaacagtaaaacagctagatctattgcttctcaggttggcattactaaggtgtttgctgaagttctaccttctcacaaggttgctaaagtgaagcaacttcaagaggaggggaaacgggtagcaatggtgggagatggaatcaatgactccccagctctggcaatggctaatgtgggaattgctattggcacaggcacagatgtagccattgaagcagctgatgtggttttgataaggaatgatcttctggatgtagtggcaagtattgacttatcaagaaagacagtcaagaggattcggataaattttgtctttgctctaatttataatctggttggaattcccatagctgctggagtttttatgcccattggtttggttttgcagccctggatgggatctgcagcaatggctgcttcatctgtttctgtagtactttcttctctcttccttaaactttacaggaaaccaacttacgagagttatgaactgcctgcccggagccagataggacagaagagtccttcagaaatcagcgttcatgttggaatagatgatacctcaaggaattctcctaaactgggtttgctggaccggattgttaattatagcagagcctctataaactcactactgtctgataaacgctccctaaacagtgttgttaccagtgaacctgacaagcactcactcctggtgggagacttcagggaagatgatgacactgcattataaaaggccatggagagtgctgccagtttaacttgtcatgcactgacacagcattcatgatgttaccttcacttttcaaaatattgtagaaggatttttctcatgctcttatattagggattctatttgagttgcgtttatctgttggcaaaaatatctttttcaaggcatcagctctgaacctagctttatttaaactgaatttccagtatatttttgttttcactaacaacagataaggtagagcagtgaggtttacaacaagccctacaattagagattgctgaactgctgctaaagtgattttttttttatttgaccaaaaaaaaaaaggcccaagaagaagaaaatgaaaaatttgaagatttgagagcatgaagatattcatgcttttgaactcaaaatattgaagatactctcaagcctgtatccctgccccactggggagcaatgactttcaaagcactgtgtataaaacatctagttttagaagggaaacagttgaaactgtttaaaaatagatgtgccttatttattgcaggctttctttcccccattctccctgcatccttgtccttgcaggtgcttttttagatgctccaatatgtcttcttttgttattttctttcgagctaaccaagtttaggtggtttttcattgattaaaaataactgacaactgttctaatattttgctcctttttaaattttgtagctcaaaagaccttaaaggtctgtagggttccctgcctcccatctttccactgttgtaaaaagtatatcaaattattccttcaagtttcctagctctgtgctcagtttcagttcactcctgccaagttggactctaagttattcttcatgtagtctgctgatctcagtctggaaacttaacattatgagccttttctgctcaaaaaattttcaaagattaaaactattatacatatacaggtcatataaaattacctggattcactaaatttgtttgttgttgttgttgttgttgttgttgttgttgagacagagtcttgttttgcagcccaggctggagtgcagtggcaccatcttggctcactgcaacctctgcctaccggattcaaggaattctccctgcctcagcctcctgagtagctaggattacaggtgcctgccaccacacccggctaattttcatatttttcagtagagacggggtttcgccatgttggctagcctggtcttaaactcctaacctcaggtgatccacccgccttggcctcccaaagtgctgggattacaggtgtgagcctccatgcccagcctaaatttgtattttttgaattgagtataatcactttgctagtatatataatttaatagattttatttatcttttagtgtttcagataacctctcaaaaagactttaaaataatgctattacacaaagctgcatttaccaaaaaatacagtaaaatcataatacagaaactaaaatttccctaggttatgacgctttttagctaaatatatactcttctctagtttaaaacatttgaacttgcctagttagtgtggttggcaaatttaggagcttgttcccattgccaaatggatttagaaattcccttgtgagtgcctggtagctaatacactggtcagagatctggtacttgtaagactatttaaatttctttgttagttgcaagatggatttcatatgcagaatatgtaaatgaagaggactcataagtaaattcctaacattttgttcccattaccagaagcaaagctgctgctaacccaacatctggcacataggatttgtactcggtaaatgttagttcttttctccccttgaggtcagtaataaatacaaaaaaatcatttttctagagcagagtcttaaaatcaggtgggggtaggggatggagttcttcctttcctaccccttttctcttttatcctttcatatatacacatgcaaagtttacaaccttattccatgctgtctttcagatttagaaaagatctaatttctgtctcagctgtcttaaagagagaactgaagcttttgatgaaggtgctattaatctagaaaggcaaacccatttcactgaaatatcaatgggtttgcatatctaggccctttttttagaccaatgcctatgccatcctccatgctttcagtttgagttttattatttattattttaattccagtggcccatcttataatacaacttgtttcttctagaagacagagctgatagggtaaatgttgaaaaaagaagcatgcctccttctccctcccacccacctcaagcagttgaacacagccagttattcttccattattatgtgtaccttggagtcatcctcttggtcttgtattcatattgtgggacagtgggaatagcagcttgtagtattgaaataatcaaagagataatttcagctcttacaacaagaacagaaaacatgctaattagaaaaagtcctgctttaagtaatatgtagccacatttgaatcctctaccacaagtcttttttgcaatcttgaactttcattagcttcaaagagaagctgtatttacaggagaaagaggtgattatggagggaatcaaaaatactgctttcagttagtagctagctttaagtcaggagttagtaatgagaaattttataaatgtgtatttctgtgtattcacatacatatatatatacacacatatatatgtacatacacatacatacatattaccatactgaagggaaatggatttatatttgaatttgatatttgaatatttgaagttctctatttatatttcatttatcactcttctgtattcactcagcaaccatgcccttagtctgaagataacaaggatactttaatatccagtgccggttcagactcacctatgtggcaccttaaacttaaatatccaaagatgccttttgaatttcaaagattaaaacacagctagagtagtagtattgtagtctcaagatgtatggtgtgtcatttgtgaaaatagaaacgttatttttcctagtttagtatcaacattttagaatgtcaaatttgatgccttgtgaacaagtaattttatattgtgctttaattttttaaaaagtattctttattcatatgtatagaatgcttaaaatagcactgtagacaagatgtttccaaaactttaagtgcgcatatcttttctgtatacagcttaaaatcaaaaatgtatgttaagagaattttttctattacttatggatcatgctttaaaatgatttttcttgatatttattttactccattttgtttttttctctgggtgaggcatctggttactggttattttaaaaagaataaagacattcctggaatcactccttttgggtttttgtttgttttgtttcttttctacatttttaagtattattttacaaaatagaaaaaatatagattcatgccaaattattacctatttttacactaactttctgcagtccctccatctggtatgagtaaccagatagagcacaaagcatgagttcttgttcttcagttaaaagagcttctttcacagtgttgataacaaatgccttttgtagccaaaaccaggcgtctcaaccttacgtttttagttaaagaaatgtttagctaaacgttgttgaacattgattgtttggtaccgaaaacagcagtggacgatgttgtgcaatatccatctactgtagttaagatattcagtagtttgtttttcataagcatgtaattgatcatatttctgccaaggatgtgccttcaactttataattatagtgttgt

SEQ ID NO: 109814 - DNA, 4775 bp, Homo sapiens
  Payload ID: 1560
  Gene Symbol: ATP7A
  Gene Name: ATPase, Cu++ transporting, alpha polypeptide
  Uniprot ID: Q04656
  ENST ID: ENST00000350425
  CDS Start-End: 131-955
actgtgacttctccgattgtgtgagctttgttggagcctgcgtacgtggatttatcgctgccacggtctgcgtagctccagaggtttaaccataggatagagaaaccaggaatgtaatgaggaaatcaaaatggatccaagtatgggtgtgaattctgttaccatttctgttgagggtatgacttgcaattcctgtgtttggaccattgagcagcagattggaaaagtgaatggtgtgcatcacattaaggtatcactggaagaaaaaaatgcaactattatttatgaccctaaactacagactccaaagaccctacaggaagctattgatgacatgggctttgatgctgttatccataatcctgaccctctccctgttttaactgacaccttgtttctgactgttacggcgtcactgactttgccatgggaccatatccaaagcacattgctgaagaccaagggtgtgacagacattaaaatttaccctcagaaaagaactgtagcagtgacaataatcccttctatagtgaatgccaatcagataaaagagctggttccagaactcagtttagatactgggacactggagaaaaagtcaggagcttgtgaagatcatagtatggctcaagctggtgaagtcgtgctgaagatgaaagtggaagggatgacctgccattcatgtactagcactattgaaggaaaaattgggaaactgcaaggtgttcagcgaattaaagtctccctggacaatcaagaagctactattgtttatcaacctcatcttatctcagtagaggaaatgaaaaagcagattgaagctatgggctttccagcatttgtcaaaaagcagcccaagtacctcaaattgggagctattgatgtagaacgtctaaagaacacaccagttaaatcctcagaagggtcacagcaaaggagtccatcataccaatgattcaacagccactttcatcattgatggcatgcattgtaaatcatgtgtgtcaaatattgaaagtactttatctgcactccaatatgtaagcagcatagtagtttctttagagaataggtctgccattgtgaagtataatgcaagctcagtcactccagaatccctgagaaaagcaatagaggctgtatcaccggggctatatagagttagtatcacaagtgaagttgagagtacctcaaactctccctccagctcatctcttcagaagattcctttgaatgtagttagccagcctctgacacaagaaactgtgataaacattgatggcatgacttgtaattcctgtgtgcagtctattgagggtgtcatatcaaaaaagccaggtgtaaaatccatacgagtctcccttgcaaatagcaatgggactgttgagtatgatcctctactaacctctccagaaacgttgagaggagcaatagaagacatgggatttgatgctaccttgtcagacacgaatgagccgttggtagtaatagctcagccttcatcggaaatgccgcttttgacttcaactaatgaattttatactaaagggatgacaccagttcaagacaaggaggaaggaaagaattcatctaagtgttacatacaggtcactggcatgacttgcgcttcctgtgtagcaaacattgaacggaatttaaggcgggaagaaggaatatattctatacttgtggccctgatggctggcaaggcagaagtaaggtataatcctgctgttatacaacccccaatgatagcagagttcatccgagaacttggatttggagccactgtgatagaaaatgctgatgaaggagatggtgttttggaacttgttgtgaggggaatgacgtgtgcctcctgcgtacataaaatagagtctagtctcacaaaacacagagggatcctatactgctccgtggccctggcaaccaacaaagcacatattaaatatgacccagaaattattggtcctagagatattatccatacaattgaaagcttaggttttgaagcttctttggtcaagaaggatcggtcagcaagtcacttagatcataaacgagaaataagacaatggagacggtcttttcttgtgagtctgtttttctgtattcctgtaatggggctgatgatatatatgatggttatggaccaccactttgcaactcttcaccataatcaaaacatgagtaaagaagaaatgatcaaccttcattcttctatgttcctggagcgccagattcttccaggattgtctgttatgaatttgctgtcctttttattgtgtgtacctgtacagtttttcggaggctggtacttctacattcaggcttataaagcactgaagcataagacagcaaatatggacgtactgattgtgctggcaaccaccattgcatttgcctactctttgattattcttctagttgcaatgtatgagagagccaaagtgaaccctattactttctttgacacaccccctatgctgtttgtgtttattgcactaggccgatggctggaacatatagcaaagggcaaaacatcagaggctcttgcaaagttaatttcactacaagctacagaagcaactattgtaactcttgattctgataatatcctcctcagtgaagaacaagtggatgtggaacttgtacaacgtggagatatcattaaagtagttccaggaggcaaatttccagtggatggtcgtgttattgaaggacattctatggtagatgagtccctcatcacaggggaggcaatgcctgtggctaagaaacctggcagcacagtgattgctggttccattaaccagaacgggtcactgcttatctgcgcaacacatgttggagcagacacaaccctttctcaaattgtcaaacttgtggaagaggcacaaacatcaaaggctcctatccagcagtttgcagacaaactcagtggctattttgttccttttattgtttttgtttccattgccaccctcttggtatggattgtaattggatttctgaattttgaaattgtggaaacctactttcctggctacaatagaagtatctcccgaacagaaacgataatacgatttgctttccaagcctctatcacagttctgtgtattgcatgtccctgttcactgggactggccactccaactgctgtgatggtgggtacaggagtaggtgctcaaaatggcatactaataaaaggtggagagccattggagatggctcataaggtaaaggtagtggtatttgataagactggaaccattactcacggaaccccagtggtgaatcaagtaaaggttctaactgaaagtaacagaatatcacaccataaaatcttggccattgtgggaactgctgaaagtaacagtgaacaccctctaggaacagccataaccaaatattgcaaacaggagctggacactgaaaccttgggtacctgcatagatttccaggttgtgccaggctgtggtattagctgtaaagtcaccaatattgaaggcttgctacataagaataactggaatatagaggacaataatattaaaaatgcatccctggttcaaattgatgccagtaatgaacagtcatcaacttcgtcttccatgattattgatgcccagatctcaaatgctcttaatgctcagcagtataaagtcctcattggtaaccgggagtggatgattagaaatggtcttgtcattaataacgatgtaaatgatttcatgactgaacatgagagaaaaggtcggactgctgtattagtagcagttgatgatgagctgtgtggcttgatagccattgcagacacagtgaagcctgaagcagaactggctatccatattctgaaatctatgggcttagaagtagttctgatgactggagacaacagtaaaacagctagatctattgcttctcaggttggcattactaaggtgtttgctgaagttctaccttctcacaaggttgctaaagtgaagcaacttcaagaggaggggaaacgggtagcaatggtgggagatggaatcaatgactccccagctctggcaatggctaatgtgggaattgctattggcacaggcacagatgtagccattgaagcagctgatgtggttttgataaggaatgatcttctggatgtagtggcaagtattgacttatcaagaaagacagtcaagaggattcggataaattttgtctttgctctaatttataatctggttggaattcccatagctgctggagtttttatgcccattggtttggttttgcagccctggatgggatctgcagcaatggctgcttcatctgtttctgtagtactttcttctctcttccttaaactttacaggaaaccaacttacgagagttatgaactgcctgcccggagccagataggacagaagagtccttcagaaatcagcgttcatgttggaatagatgatacctcaaggaattctcctaaactgggtttgctggaccggattgttaattatagcagagcctctataaactcactactgtctgataaacgctccctaaacagtgttgttaccagtgaacctgacaagcactcactcctggtgggagacttcagggaagatgatgacactgcattataaaaggccatggagagtgctgccagtttaacttgtcatgcactgacacagcattcatgatgttaccttcacttttcaaaatattgtagaaggatttttctcatgctcttatattagggattctatttgagttgcgtttatctgttg

SEQ ID NO: 109815 - DNA, 8483 bp, Homo sapiens
  Payload ID: 1560
  Gene Symbol: ATP7A
  Gene Name: ATPase, Cu++ transporting, alpha polypeptide
  Uniprot ID: Q04656
  ENST ID: ENST00000341514
  CDS Start-End: 156-4658
tgctgccgccgccgcagccgcagctactgtgacttctccgattgtgtgagctttgttggagcctgcgtacgtggatttatcgctgccacggtctgcgtagctccagaggtttaaccataggatagagaaaccaggaatgtaatgaggaaatcaaaatggatccaagtatgggtgtgaattctgttaccatttctgttgagggtatgacttgcaattcctgtgtttggaccattgagcagcagattggaaaagtgaatggtgtgcatcacattaaggtatcactggaagaaaaaaatgcaactattatttatgaccctaaactacagactccaaagaccctacaggaagctattgatgacatgggctttgatgctgttatccataatcctgaccctctccctgttttaactgacaccttgtttctgactgttacggcgtcactgactttgccatgggaccatatccaaagcacattgctgaagaccaagggtgtgacagacattaaaatttaccctcagaaaagaactgtagcagtgacaataatcccttctatagtgaatgccaatcagataaaagagctggttccagaactcagtttagatactgggacactggagaaaaagtcaggagcttgtgaagatcatagtatggctcaagctggtgaagtcgtgctgaagatgaaagtggaagggatgacctgccattcatgtactagcactattgaaggaaaaattgggaaactgcaaggtgttcagcgaattaaagtctccctggacaatcaagaagctactattgtttatcaacctcatcttatctcagtagaggaaatgaaaaagcagattgaagctatgggctttccagcatttgtcaaaaagcagcccaagtacctcaaattgggagctattgatgtagaacgtctaaagaacacaccagttaaatcctcagaagggtcacagcaaaggagtccatcatataccaatgattcaacagccactttcatcattgatggcatgcattgtaaatcatgtgtgtcaaatattgaaagtactttatctgcactccaatatgtaagcagcatagtagtttctttagagaataggtctgccattgtgaagtataatgcaagctcagtcactccagaatccctgagaaaagcaatagaggctgtatcaccggggctatatagagttagtatcacaagtgaagttgagagtacctcaaactctccctccagctcatctcttcagaagattcctttgaatgtagttagccagcctctgacacaagaaactgtgataaacattgatggcatgacttgtaattcctgtgtgcagtctattgagggtgtcatatcaaaaaagccaggtgtaaaatccatacgagtctcccttgcaaatagcaatgggactgttgagtatgatcctctactaacctctccagaaacgttgagaggagcaatagaagacatgggatttgatgctaccttgtcagacacgaatgagccgttggtagtaatagctcagccttcatcggaaatgccgcttttgacttcaactaatgaattttatactaaagggatgacaccagttcaagacaaggaggaaggaaagaattcatctaagtgttacatacaggtcactggcatgacttgcgcttcctgtgtagcaaacattgaacggaatttaaggcgggaagaaggaatatattctatacttgtggccctgatggctggcaaggcagaagtaaggtataatcctgctgttatacaacccccaatgatagcagagttcatccgagaacttggatttggagccactgtgatagaaaatgctgatgaaggagatggtgttttggaacttgttgtgaggggaatgacgtgtgcctcctgcgtacataaaatagagtctagtctcacaaaacacagagggatcctatactgctccgtggccctggcaaccaacaaagcacatattaaatatgacccagaaattattggtcctagagatattatccatacaattgaaagcttaggttttgaagcttctttggtcaagaaggatcggtcagcaagtcacttagatcataaacgagaaataagacaatggagacggtcttttcttgtgagtctgtttttctgtattcctgtaatggggctgatgatatatatgatggttatggaccaccactttgcaactcttcaccataatcaaaacatgagtaaagaagaaatgatcaaccttcattcttctatgttcctggagcgccagattcttccaggattgtctgttatgaatttgctgtcctttttattgtgtgtacctgtacagtttttcggaggctggtacttctacattcaggcttataaagcactgaagcataagacagcaaatatggacgtactgattgtgctggcaaccaccattgcatttgcctactctttgattattcttctagttgcaatgtatgagagagccaaagtgaaccctattactttctttgacacaccccctatgctgtttgtgtttattgcactaggccgatggctggaacatatagcaaagggcaaaacatcagaggctcttgcaaagttaatttcactacaagctacagaagcaactattgtaactcttgattctgataatatcctcctcagtgaagaacaagtggatgtggaacttgtacaacgtggagatatcattaaagtagttccaggaggcaaatttccagtggatggtcgtgttattgaaggacattctatggtagatgagtccctcatcacaggggaggcaatgcctgtggctaagaaacctggcagcacagtgattgctggttccattaaccagaacgggtcactgcttatctgcgcaacacatgttggagcagacacaaccctttctcaaattgtcaaacttgtggaagaggcacaaacatcaaaggctcctatccagcagtttgcagacaaactcagtggctattttgttccttttattgtttttgtttccattgccaccctcttggtatggattgtaattggatttctgaattttgaaattgtggaaacctactttcctggctacaatagaagtatctcccgaacagaaacgataatacgatttgctttccaagcctctatcacagttctgtgtattgcatgtccctgttcactgggactggccactccaactgctgtgatggtgggtacaggagtaggtgctcaaaatggcatactaataaaaggtggagagccattggagatggctcataaggtaaaggtagtggtatttgataagactggaaccattactcacggaaccccagtggtgaatcaagtaaaggttctaactgaaagtaacagaatatcacaccataaaatcttggccattgtgggaactgctgaaagtaacagtgaacaccctctaggaacagccataaccaaatattgcaaacaggagctggacactgaaaccttgggtacctgcatagatttccaggttgtgccaggctgtggtattagctgtaaagtcaccaatattgaaggcttgctacataagaataactggaatatagaggacaataatattaaaaatgcatccctggttcaaattgatgccagtaatgaacagtcatcaacttcgtcttccatgattattgatgcccagatctcaaatgctcttaatgctcagcagtataaagtcctcattggtaaccgggagtggatgattagaaatggtcttgtcattaataacgatgtaaatgatttcatgactgaacatgagagaaaaggtcggactgctgtattagtagcagttgatgatgagctgtgtggcttgatagccattgcagacacagtgaagcctgaagcagaactggctatccatattctgaaatctatgggcttagaagtagttctgatgactggagacaacagtaaaacagctagatctattgcttctcaggttggcattactaaggtgtttgctgaagttctaccttctcacaaggttgctaaagtgaagcaacttcaagaggaggggaaacgggtagcaatggtgggagatggaatcaatgactccccagctctggcaatggctaatgtgggaattgctattggcacaggcacagatgtagccattgaagcagctgatgtggttttgataaggaatgatcttctggatgtagtggcaagtattgacttatcaagaaagacagtcaagaggattcggataaattttgtctttgctctaatttataatctggttggaattcccatagctgctggagtttttatgcccattggtttggttttgcagccctggatgggatctgcagcaatggctgcttcatctgtttctgtagtactttcttctctcttccttaaactttacaggaaaccaacttacgagagttatgaactgcctgcccggagccagataggacagaagagtccttcagaaatcagcgttcatgttggaatagatgatacctcaaggaattctcctaaactgggtttgctggaccggattgttaattatagcagagcctctataaactcactactgtctgataaacgctccctaaacagtgttgttaccagtgaacctgacaagcactcactcctggtgggagacttcagggaagatgatgacactgcattataaaaggccatggagagtgctgccagtttaacttgtcatgcactgacacagcattcatgatgttaccttcacttttcaaaatattgtagaaggatttttctcatgctcttatattagggattctatttgagttgcgtttatctgttggcaaaaatatctttttcaaggcatcagctctgaacctagctttatttaaactgaatttccagtatatttttgttttcactaacaacagataaggtagagcagtgaggtttacaacaagccctacaattagagattgctgaactgctgctaaagtgattttttttttatttgaccaaaaaaaaaaaggcccaagaagaagaaaatgaaaaatttgaagatttgagagcatgaagatattcatgcttttgaactcaaaatattgaagatactctcaagcctgtatccctgccccactggggagcaatgactttcaaagcactgtgtataaaacatctagttttagaagggaaacagttgaaactgtttaaaaatagatgtgccttatttattgcaggctttctttcccccattctccctgcatccttgtccttgcaggtgcttttttagatgctccaatatgtcttcttttgttattttctttcgagctaaccaagtttaggtggtttttcattgattaaaaataactgacaactgttctaatattttgctcctttttaaattttgtagctcaaaagaccttaaaggtctgtagggttccctgcctcccatctttccactgttgtaaaaagtatatcaaattattccttcaagtttcctagctctgtgctcagtttcagttcactcctgccaagttggactctaagttattcttcatgtagtctgctgatctcagtctggaaacttaacattatgagccttttctgctcaaaaaattttcaaagattaaaactattatacatatacaggtcatataaaattacctggattcactaaatttgtttgttgttgttgttgttgttgttgttgttgttgagacagagtcttgttttgcagcccaggctggagtgcagtggcaccatcttggctcactgcaacctctgcctaccggattcaaggaattctccctgcctcagcctcctgagtagctaggattacaggtgcctgccaccacacccggctaattttcatatttttcagtagagacggggtttcgccatgttggctagcctggtcttaaactcctaacctcaggtgatccacccgccttggcctcccaaagtgctgggattacaggtgtgagcctccatgcccagcctaaatttgtattttttgaattgagtataatcactttgctagtatatataatttaatagattttatttatcttttagtgtttcagataacctctcaaaaagactttaaaataatgctattacacaaagctgcatttaccaaaaaatacagtaaaatcataatacagaaactaaaatttccctaggttatgacgctttttagctaaatatatactcttctctagtttaaaacatttgaacttgcctagttagtgtggttggcaaatttaggagcttgttcccattgccaaatggatttagaaattcccttgtgagtgcctggtagctaatacactggtcagagatctggtacttgtaagactatttaaatttctttgttagttgcaagatggatttcatatgcagaatatgtaaatgaagaggactcataagtaaattcctaacattttgttcccattaccagaagcaaagctgctgctaacccaacatctggcacataggatttgtactcggtaaatgttagttcttttctccccttgaggtcagtaataaatacaaaaaaatcatttttctagagcagagtcttaaaatcaggtgggggtaggggatggagttcttcctttcctaccccttttctcttttatcctttcatatatacacatgcaaagtttacaaccttattccatgctgtctttcagatttagaaaagatctaatttctgtctcagctgtcttaaagagagaactgaagcttttgatgaaggtgctattaatctagaaaggcaaacccatttcactgaaatatcaatgggtttgcatatctaggccctttttttagaccaatgcctatgccatcctccatgctttcagtttgagttttattatttattattttaattccagtggcccatcttataatacaacttgtttcttctagaagacagagctgatagggtaaatgttgaaaaaagaagcatgcctccttctccctcccacccacctcaagcagttgaacacagccagttattcttccattattatgtgtaccttggagtcatcctcttggtcttgtattcatattgtgggacagtgggaatagcagcttgtagtattgaaataatcaaagagataatttcagctcttacaacaagaacagaaaacatgctaattagaaaaagtcctgctttaagtaatatgtagccacatttgaatcctctaccacaagtcttttttgcaatcttgaactttcattagcttcaaagagaagctgtatttacaggagaaagaggtgattatggagggaatcaaaaatactgctttcagttagtagctagctttaagtcaggagttagtaatgagaaattttataaatgtgtatttctgtgtattcacatacatatatatatacacacatatatatgtacatacacatacatacatattaccatactgaagggaaatggatttatatttgaatttgatatttgaatatttgaagttctctatttatatttcatttatcactcttctgtattcactcagcaaccatgcccttagtctgaagataacaaggatactttaatatccagtgccggttcagactcacctatgtggcaccttaaacttaaatatccaaagatgccttttgaatttcaaagattaaaacacagctagagtagtagtattgtagtctcaagatgtatggtgtgtcatttgtgaaaatagaaacgttatttttcctagtttagtatcaacattttagaatgtcaaatttgatgccttgtgaacaagtaattttatattgtgctttaattttttaaaaagtattctttattcatatgtatagaatgcttaaaatagcactgtagacaagatgtttccaaaactttaagtgcgcatatcttttctgtatacagcttaaaatcaaaaatgtatgttaagagaattttttctattacttatggatcatgctttaaaatgatttttcttgatatttattttactccattttgtttttttctctgggtgaggcatctggttactggttattttaaaaagaataaagacattcctggaatcactccttttgggtttttgtttgttttgtttcttttctacatttttaagtattattttacaaaatagaaaaaatatagattcatgccaaattattacctatttttacactaactttctgcagtccctccatctggtatgagtaaccagatagagcacaaagcatgagttcttgttcttcagttaaaagagcttctttcacagtgttgataacaaatgccttttgtagccaaaaccaggcgtctcaaccttacgtttttagttaaagaaatgtttagctaaacgttgttgaacattgattgtttggtaccgaaaacagcagtggacgatgttgtgcaatatccatctactgtagttaagatattcagtagtttgtttttcataagcatgtaattgatcatatttctgccaaggatgtgccttcaactttataattatagtgttgtaaaata

SEQ ID NO: 109816 - DNA, 6638 bp, Homo sapiens
  Payload ID: 1561
  Gene Symbol: ATP7B
  Gene Name: ATPase, Cu++ transporting, beta polypeptide
  Uniprot ID: P35670
  ENST ID: ENST00000242839
  CDS Start-End: 158-4555
ttcccggacccctgtttgctttagagccgagccgcgccgatgccctcacactctgcgcctcctctcccgggactttaacaccccgctctcctccaccgaccaggtgaccttttgctctgagccagatcagagaagaattcggtgtccgtgcgggacgatgcctgagcaggagagacagatcacagccagagaaggggccagtcggaaaatcttatctaagctttctttgcctacccgtgcctgggaaccagcaatgaagaagagttttgcttttgacaatgttggctatgaaggtggtctggatggcctgggcccttcttctcaggtggccaccagcacagtcaggatcttgggcatgacttgccagtcatgtgtgaagtccattgaggacaggatttccaatttgaaaggcatcatcagcatgaaggtttccctggaacaaggcagtgccactgtgaaatatgtgccatcggttgtgtgcctgcaacaggtttgccatcaaattggggacatgggcttcgaggccagcattgcagaaggaaaggcagcctcctggccctcaaggtccttgcctgcccaggaggctgtggtcaagctccgggtggagggcatgacctgccagtcctgtgtcagctccattgaaggcaaggtccggaaactgcaaggagtagtgagagtcaaagtctcactcagcaaccaagaggccgtcatcacttatcagccttatctcattcagcccgaagacctcagggaccatgtaaatgacatgggatttgaagctgccatcaagagcaaagtggctcccttaagcctgggaccaattgatattgagcggttacaaagcactaacccaaagagacctttatcttctgctaaccagaattttaataattctgagaccttggggcaccaaggaagccatgtggtcaccctccaactgagaatagatggaatgcattgtaagtcttgcgtcttgaatattgaagaaaatattggccagctcctaggggttcaaagtattcaagtgtccttggagaacaaaactgcccaagtaaagtatgacccttcttgtaccagcccagtggctctgcagagggctatcgaggcacttccacctgggaattttaaagtttctcttcctgatggagccgaagggagtgggacagatcacaggtcttccagttctcattcccctggctccccaccgagaaaccaggtccagggcacatgcagtaccactctgattgccattgccggcatgacctgtgcatcctgtgtccattccattgaaggcatgatctcccaactggaaggggtgcagcaaatatcggtgtctttggccgaagggactgcaacagttctttataatccctctgtaattagcccagaagaactcagagctgctatagaagacatgggatttgaggcttcagtcgtttctgaaagctgttctactaaccctcttggaaaccacagtgctgggaattccatggtgcaaactacagatggtacacctacatctgtgcaggaagtggctccccacactgggaggctccctgcaaaccatgccccggacatcttggcaaagtccccacaatcaaccagagcagtggcaccgcagaagtgcttcttacagatcaaaggcatgacctgtgcatcctgtgtgtctaacatagaaaggaatctgcagaaagaagctggtgttctctccgtgttggttgccttgatggcaggaaaggcagagatcaagtatgacccagaggtcatccagcccctcgagatagctcagttcatccaggacctgggttttgaggcagcagtcatggaggactacgcaggctccgatggcaacattgagctgacaatcacagggatgacctgcgcgtcctgtgtccacaacatagagtccaaactcacgaggacaaatggcatcacttatgcctccgttgcccttgccaccagcaaagcccttgttaagtttgacccggaaattatcggtccacgggatattatcaaaattattgaggaaattggctttcatgcttccctggcccagagaaaccccaacgctcatcacttggaccacaagatggaaataaagcagtggaagaagtctttcctgtgcagcctggtgtttggcatccctgtcatggccttaatgatctatatgctgatacccagcaacgagccccaccagtccatggtcctggaccacaacatcattccaggactgtccattctaaatctcatcttctttatcttgtgtacctttgtccagctcctcggtgggtggtacttctacgttcaggcctacaaatctctgagacacaggtcagccaacatggacgtgctcatcgtcctggccacaagcattgcttatgtttattctctggtcatcctggtggttgctgtggctgagaaggcggagaggagccctgtgacattcttcgacacgccccccatgctctttgtgttcattgccctgggccggtggctggaacacttggcaaagagcaaaacctcagaagccctggctaaactcatgtctctccaagccacagaagccaccgttgtgacccttggtgaggacaatttaatcatcagggaggagcaagtccccatggagctggtgcagcggggcgatatcgtcaaggtggtccctgggggaaagtttccagtggatgggaaagtcctggaaggcaataccatggctgatgagtccctcatcacaggagaagccatgccagtcactaagaaacccggaagcactgtaattgcggggtctataaatgcacatggctctgtgctcattaaagctacccacgtgggcaatgacaccactttggctcagattgtgaaactggtggaagaggctcagatgtcaaaggcacccattcagcagctggctgaccggtttagtggatattttgtcccatttatcatcatcatgtcaactttgacgttggtggtatggattgtaatcggttttatcgattttggtgttgttcagagatactttcctaaccccaacaagcacatctcccagacagaggtgatcatccggtttgctttccagacgtccatcacggtgctgtgcattgcctgcccctgctccctggggctggccacgcccacggctgtcatggtgggcaccggggtggccgcgcagaacggcatcctcatcaagggaggcaagcccctggagatggcgcacaagataaagactgtgatgtttgacaagactggcaccattacccatggcgtccccagggtcatgcgggtgctcctgctgggggatgtggccacactgcccctcaggaaggttctggctgtggtggggactgcggaggccagcagtgaacaccccttgggcgtggcagtcaccaaatactgtaaagaggaacttggaacagagaccttgggatactgcacggacttccaggcagtgccaggctgtggaattgggtgcaaagtcagcaacgtggaaggcatcctggcccacagtgagcgccctttgagtgcaccggccagtcacctgaatgaggctggcagccttcccgcagaaaaagatgcagtcccccagaccttctctgtgctgattggaaaccgtgagtggctgaggcgcaacggtttaaccatttctagcgatgtcagtgacgctatgacagaccacgagatgaaaggacagacagccatcctggtggctattgacggtgtgctctgtgggatgatcgcaatcgcagacgctgtcaagcaggaggctgccctggctgtgcacacgctgcagagcatgggtgtggacgtggttctgatcacgggggacaaccggaagacagccagagctattgccacccaggttggcatcaacaaagtctttgcagaggtgctgccttcgcacaaggtggccaaggtccaggagctccagaataaagggaagaaagtcgccatggtgggggatggggtcaatgactccccggccttggcccaggcagacatgggtgtggccattggcaccggcacggatgtggccatcgaggcagccgacgtcgtccttatcagaaatgatttgctggatgtggtggctagcattcacctttccaagaggactgtccgaaggatacgcatcaacctggtcctggcactgatttataacctggttgggatacccattgcagcaggtgtcttcatgcccatcggcattgtgctgcagccctggatgggctcagcggccatggcagcctcctctgtgtctgtggtgctctcatccctgcagctcaagtgctataagaagcctgacctggagaggtatgaggcacaggcgcatggccacatgaagcccctgacggcatcccaggtcagtgtgcacataggcatggatgacaggtggcgggactcccccagggccacaccatgggaccaggtcagctatgtcagccaggtgtcgctgtcctccctgacgtccgacaagccatctcggcacagcgctgcagcagacgatgatggggacaagtggtctctgctcctgaatggcagggatgaggagcagtacatctgatgacttcaggcaggcgggccggggcagggacttgcctccactcaccacaagctgagcaggacagccagcagcaggatgggctgagctagcctccagctttggggacttccgctccctggatatgtccagtcatcctgccctgcagcacgcggccttgtctgggtgcagctgggcttggcctggagaggacggccctgcctgcctcttggcctcacgggaccgtcagcatgggctttgtcttggactctagtccttggctggactgtagaaggtgagaggcgagtcaccctcctcacagacctctgcttggagtatttaggatgactgctgtgaaatggagaacagtttcatcaggaccaaaaaacctcactgggcctttccagagaactgcagacctcactgtcagggtctttctgatgacgcctgtctgtgtgcatcatgtttctgagaccacagtttacctcaggtgtgcctgttgctttcttcctgcatagtctgttcctttcttcgtacatagtctgttccttttctctcctgtgtgcttgtcagtggggacccctcgcaaccctgcctgtcacctgggagggtgggaccaatgtccttgtggtctttgctgctgctctcaggcgcttctccaatgctctggagtgtgcatttcagcttgaacctgcttcctggctcacacatccccagccagggagcttgccacactcttcttcaagttgaggagagttcttttttgcttaaagcccccttctccatggagtgttggcttctcaatagagtgttgttgctgaccagctggagtgagggcctcagagcctgacctgagagtccgtactcggcttcctgtggggtgtaggttctcgcgattcaggacgtccttccatatccctgcccagcctgtggtgcttgaaacgtttgccccatgggaaacgtatgtgtgcaggagcctccctgcacggcccaaggggcttcgttttcagtcttctgactgtcacctcgtggggttcagtagagaattcatgtgactagcgcctggccttgtgtggcttggaggaaatggtactgcccaaataggaggaaaacacagcctccctgagcctgcattctgcacgctgcccaggggcttcagaaaaggagtggccacagcaccccgaagggagcatctgtttacctggcagtggctctcagagcagcagaacgggttcagttttagactctgaagttggttgtgattgacagaaccctttgggagcaaactagtagagttggattaaattctgggtgaaacccttttctcccacacaaaatagttttagtgatttttttcattgtccattacttgccaggggcagttttagcagcacttttgatagattacgtctaatcctcccaaccaaccagcagggtagctattactgtccacattttacaggcaaggaaacaggctccaagaggctgaggactttgcccaggatgacatagccaatggacaagcagtgtctgtcagctgtgaaggcttcactcttattgtccttctaccttgaatagaagttttcctgataagaataaacgaggaaaaggtccttgcctcctggaagaacaaatctaccaggtgatctattcattgtttcaactcagaatgcacttgattcaggaggtcatctgaccttcaccttggatggttagtttcactttttacatatagtttttgcagggttttattttataaaatccaagcgcgctgttgattgtgttttccttgttttcagcccccccactccagcccgcagcacatttccgctgtccgtcagtaattgtgtcctctctttatgcttgcttggggaatgttgttttctgactaggctgatcattatctaaagaatctaattctgttgatttttaaaacttttaggaccataaacgttgtgttcatatatggacatggaaatatttatataattttatagaaaataaccttttagatggtcaaagtgtaaggagtttttttgtcagataatcatttctacttcaaaaacatttcatgcaatattagaataaagttcctgtcattcctcta

SEQ ID NO: 109817 - DNA, 5861 bp, Homo sapiens
  Payload ID: 1561
  Gene Symbol: ATP7B
  Gene Name: ATPase, Cu++ transporting, beta polypeptide
  Uniprot ID: P35670
  ENST ID: ENST00000344297
  CDS Start-End: 3-3779
cgatgcctgagcaggagagacagatcacagccagagaaggggccagtcggaaaatcttatctaagctttctttgcctacccgtgcctgggaaccagcaatgaagaagagttttgcttttgacaatgttggctatgaaggtggtctggatggcctgggcccttcttctcaggtggccaccagcacagtcaggatcttgggcatgacttgccagtcatgtgtgaagtccattgaggacaggatttccaatttgaaaggcatcatcagcatgaaggtttccctggaacaaggcagtgccactgtgaaatatgtgccatcggttgtgtgcctgcaacaggtttgccatcaaattggggacatgggcttcgaggccagcattgcagaaggaaaggcagcctcctggccctcaaggtccttgcctgcccaggaggctgtggtcaagctccgggtggagggcatgacctgccagtcctgtgtcagctccattgaaggcaaggtccggaaactgcaaggagtagtgagagtcaaagtctcactcagcaaccaagaggccgtcatcacttatcagccttatctcattcagcccgaagacctcagggaccatgtaaatgacatgggatttgaagctgccatcaagagcaaagtggctcccttaagcctgggaccaattgatattgagcggttacaaagcactaacccaaagagacctttatcttctgctaaccagaattttaataattctgagaccttggggcaccaaggaagccatgtggtcaccctccaactgagaatagatggaatgcattgtaagtcttgcgtcttgaatattgaagaaaatattggccagctcctaggggttcaaagtattcaagtgtccttggagaacaaaactgcccaagtaaagtatgacccttcttgtaccagcccagtggctctgcagagggctatcgaggcacttccacctgggaattttaaagtttctcttcctgatggagccgaagggagtgggacagatcacaggtcttccagttctcattcccctggctccccaccgagaaaccaggtccagggcacatgcagtaccactctgattgccattgccggcatgacctgtgcatcctgtgtccattccattgaaggcatgatctcccaactggaaggggtgcagcaaatatcggtgtctttggccgaagggactgcaacagttctttataatccctctgtaattagcccagaagaactcagagctgctatagaagacatgggatttgaggcttcagtcgtttctgaaagctgttctactaaccctcttggaaaccacagtgctgggaattccatggtgcaaactacagatggtacacctacatctgtgcaggaagtggctccccacactgggaggctccctgcaaaccatgccccggacatcttggcaaagtccccacaatcaaccagagcagtggcaccgcagaagtgcttcttacagatcaaaggcatgacctgtgcatcctgtgtgtctaacatagaaaggaatctgcagaaagaagctggtgttctctccgtgttggttgccttgatggcaggaaaggcagagatcaagtatgacccagaggtcatccagcccctcgagatagctcagttcatccaggacctgggttttgaggcagcagtcatggaggactacgcaggctccgatggcaacattgagctgacaatcacagggatgacctgcgcgtcctgtgtccacaacatagagtccaaactcacgaggacaaatggcatcacttatgcctccgttgcccttgccaccagcaaagcccttgttaagtttgacccggaaattatcggtccacgggatattatcaaaattattgagagcaaaacctcagaagccctggctaaactcatgtctctccaagccacagaagccaccgttgtgacccttggtgaggacaatttaatcatcagggaggagcaagtccccatggagctggtgcagcggggcgatatcgtcaaggtggtccctgggggaaagtttccagtggatgggaaagtcctggaaggcaataccatggctgatgagtccctcatcacaggagaagccatgccagtcactaagaaacccggaagcactgtaattgcggggtctataaatgcacatggctctgtgctcattaaagctacccacgtgggcaatgacaccactttggctcagattgtgaaactggtggaagaggctcagatgtcaaagaaccccaacaagcacatctcccagacagaggtgatcatccggtttgctttccagacgtccatcacggtgctgtgcattgcctgcccctgctccctggggctggccacgcccacggctgtcatggtgggcaccggggtggccgcgcagaacggcatcctcatcaagggaggcaagcccctggagatggcgcacaagataaagactgtgatgtttgacaagactggcaccattacccatggcgtccccagggtcatgcgggtgctcctgctgggggatgtggccacactgcccctcaggaaggttctggctgtggtggggactgcggaggccagcagtgaacaccccttgggcgtggcagtcaccaaatactgtaaagaggaacttggaacagagaccttgggatactgcacggacttccaggcagtgccaggctgtggaattgggtgcaaagtcagcaacgtggaaggcatcctggcccacagtgagcgccctttgagtgcaccggccagtcacctgaatgaggctggcagccttcccgcagaaaaagatgcagtcccccagaccttctctgtgctgattggaaaccgtgagtggctgaggcgcaacggtttaaccatttctagcgatgtcagtgacgctatgacagaccacgagatgaaaggacagacagccatcctggtggctattgacggtgtgctctgtgggatgatcgcaatcgcagacgctgtcaagcaggaggctgccctggctgtgcacacgctgcagagcatgggtgtggacgtggttctgatcacgggggacaaccggaagacagccagagctattgccacccaggttggcatcaacaaagtctttgcagaggtgctgccttcgcacaaggtggccaaggtccaggagctccagaataaagggaagaaagtcgccatggtgggggatggggtcaatgactccccggccttggcccaggcagacatgggtgtggccattggcaccggcacggatgtggccatcgaggcagccgacgtcgtccttatcagaaatgatttgctggatgtggtggctagcattcacctttccaagaggactgtccgaaggatacgcatcaacctggtcctggcactgatttataacctggttgggatacccattgcagcaggtgtcttcatgcccatcggcattgtgctgcagccctggatgggctcagcggccatggcagcctcctctgtgtctgtggtgctctcatccctgcagctcaagtgctataagaagcctgacctggagaggtatgaggcacaggcgcatggccacatgaagcccctgacggcatcccaggtcagtgtgcacataggcatggatgacaggtggcgggactcccccagggccacaccatgggaccaggtcagctatgtcagccaggtgtcgctgtcctccctgacgtccgacaagccatctcggcacagcgctgcagcagacgatgatggggacaagtggtctctgctcctgaatggcagggatgaggagcagtacatctgatgacttcaggcaggcgggccggggcagggacttgcctccactcaccacaagctgagcaggacagccagcagcaggatgggctgagctagcctccagctttggggacttccgctccctggatatgtccagtcatcctgccctgcagcacgcggccttgtctgggtgcagctgggcttggcctggagaggacggccctgcctgcctcttggcctcacgggaccgtcagcatgggctttgtcttggactctagtccttggctggactgtagaaggtgagaggcgagtcaccctcctcacagacctctgcttggagtatttaggatgactgctgtgaaatggagaacagtttcatcaggaccaaaaaacctcactgggcctttccagagaactgcagacctcactgtcagggtctttctgatgacgcctgtctgtgtgcatcatgtttctgagaccacagtttacctcaggtgtgcctgttgctttcttcctgcatagtctgttcctttcttcgtacatagtctgttccttttctctcctgtgtgcttgtcagtggggacccctcgcaaccctgcctgtcacctgggagggtgggaccaatgtccttgtggtctttgctgctgctctcaggcgcttctccaatgctctggagtgtgcatttcagcttgaacctgcttcctggctcacacatccccagccagggagcttgccacactcttcttcaagttgaggagagttcttttttgcttaaagcccccttctccatggagtgttggcttctcaatagagtgttgttgctgaccagctggagtgagggcctcagagcctgacctgagagtccgtactcggcttcctgtggggtgtaggttctcgcgattcaggacgtccttccatatccctgcccagcctgtggtgcttgaaacgtttgccccatgggaaacgtatgtgtgcaggagcctccctgcacggcccaaggggcttcgttttcagtcttctgactgtcacctcgtggggttcagtagagaattcatgtgactagcgcctggccttgtgtggcttggaggaaatggtactgcccaaataggaggaaaacacagcctccctgagcctgcattctgcacgctgcccaggggcttcagaaaaggagtggccacagcaccccgaagggagcatctgtttacctggcagtggctctcagagcagcagaacgggttcagttttagactctgaagttggttgtgattgacagaaccctttgggagcaaactagtagagttggattaaattctgggtgaaacccttttctcccacacaaaatagttttagtgatttttttcattgtccattacttgccaggggcagttttagcagcacttttgatagattacgtctaatcctcccaaccaaccagcagggtagctattactgtccacattttacaggcaaggaaacaggctccaagaggctgaggactttgcccaggatgacatagccaatggacaagcagtgtctgtcagctgtgaaggcttcactcttattgtccttctaccttgaatagaagttttcctgataagaataaacgaggaaaaggtccttgcctcctggaagaacaaatctaccaggtgatctattcattgtttcaactcagaatgcacttgattcaggaggtcatctgaccttcaccttggatggttagtttcactttttacatatagtttttgcagggttttattttataaaatccaagcgcgctgttgattgtgttttccttgttttcagcccccccactccagcccgcagcacatttccgctgtccgtcagtaattgtgtcctctctttatgcttgcttggggaatgttgttttctgactaggctgatcattatctaaagaatctaattctgttgatttttaaaacttttaggaccataaacgttgtgttcatatatggacatggaaatatttatataattttatagaaaataaccttttagatggtcaaagtgtaaggagtttttttgtcagataatcatttctacttcaaaaacatttcatgcaatattagaataaagttcctgtcattcctct

SEQ ID NO: 109818 - DNA, 6304 bp, Homo sapiens
  Payload ID: 1561
  Gene Symbol: ATP7B
  Gene Name: ATPase, Cu++ transporting, beta polypeptide
  Uniprot ID: P35670
  ENST ID: ENST00000400366
  CDS Start-End: 158-4222
ttcccggacccctgtttgctttagagccgagccgcgccgatgccctcacactctgcgcctcctctcccgggactttaacaccccgctctcctccaccgaccaggtgaccttttgctctgagccagatcagagaagaattcggtgtccgtgcgggacgatgcctgagcaggagagacagatcacagccagagaaggggccagtcggaaaatcttatctaagctttctttgcctacccgtgcctgggaaccagcaatgaagaagagttttgcttttgacaatgttggctatgaaggtggtctggatggcctgggcccttcttctcaggtggccaccagcacagtcaggatcttgggcatgacttgccagtcatgtgtgaagtccattgaggacaggatttccaatttgaaaggcatcatcagcatgaaggtttccctggaacaaggcagtgccactgtgaaatatgtgccatcggttgtgtgcctgcaacaggtttgccatcaaattggggacatgggcttcgaggccagcattgcagaaggaaaggcagcctcctggccctcaaggtccttgcctgcccaggaggctgtggtcaagctccgggtggagggcatgacctgccagtcctgtgtcagctccattgaaggcaaggtccggaaactgcaaggagtagtgagagtcaaagtctcactcagcaaccaagaggccgtcatcacttatcagccttatctcattcagcccgaagacctcagggaccatgtaaatgacatgggatttgaagctgccatcaagagcaaagtggctcccttaagcctgggaccaattgatattgagcggttacaaagcactaacccaaagagacctttatcttctgctaaccagaattttaataattctgagaccttggggcaccaaggaagccatgtggtcaccctccaactgagaatagatggaatgcattgcatgatctcccaactggaaggggtgcagcaaatatcggtgtctttggccgaagggactgcaacagttctttataatccctctgtaattagcccagaagaactcagagctgctatagaagacatgggatttgaggcttcagtcgtttctgaaagctgttctactaaccctcttggaaaccacagtgctgggaattccatggtgcaaactacagatggtacacctacatctgtgcaggaagtggctccccacactgggaggctccctgcaaaccatgccccggacatcttggcaaagtccccacaatcaaccagagcagtggcaccgcagaagtgcttcttacagatcaaaggcatgacctgtgcatcctgtgtgtctaacatagaaaggaatctgcagaaagaagctggtgttctctccgtgttggttgccttgatggcaggaaaggcagagatcaagtatgacccagaggtcatccagcccctcgagatagctcagttcatccaggacctgggttttgaggcagcagtcatggaggactacgcaggctccgatggcaacattgagctgacaatcacagggatgacctgcgcgtcctgtgtccacaacatagagtccaaactcacgaggacaaatggcatcacttatgcctccgttgcccttgccaccagcaaagcccttgttaagtttgacccggaaattatcggtccacgggatattatcaaaattattgaggaaattggctttcatgcttccctggcccagagaaaccccaacgctcatcacttggaccacaagatggaaataaagcagtggaagaagtctttcctgtgcagcctggtgtttggcatccctgtcatggccttaatgatctatatgctgatacccagcaacgagccccaccagtccatggtcctggaccacaacatcattccaggactgtccattctaaatctcatcttctttatcttgtgtacctttgtccagctcctcggtgggtggtacttctacgttcaggcctacaaatctctgagacacaggtcagccaacatggacgtgctcatcgtcctggccacaagcattgcttatgtttattctctggtcatcctggtggttgctgtggctgagaaggcggagaggagccctgtgacattcttcgacacgccccccatgctctttgtgttcattgccctgggccggtggctggaacacttggcaaagagcaaaacctcagaagccctggctaaactcatgtctctccaagccacagaagccaccgttgtgacccttggtgaggacaatttaatcatcagggaggagcaagtccccatggagctggtgcagcggggcgatatcgtcaaggtggtccctgggggaaagtttccagtggatgggaaagtcctggaaggcaataccatggctgatgagtccctcatcacaggagaagccatgccagtcactaagaaacccggaagcactgtaattgcggggtctataaatgcacatggctctgtgctcattaaagctacccacgtgggcaatgacaccactttggctcagattgtgaaactggtggaagaggctcagatgtcaaaggcacccattcagcagctggctgaccggtttagtggatattttgtcccatttatcatcatcatgtcaactttgacgttggtggtatggattgtaatcggttttatcgattttggtgttgttcagagatactttcctaaccccaacaagcacatctcccagacagaggtgatcatccggtttgctttccagacgtccatcacggtgctgtgcattgcctgcccctgctccctggggctggccacgcccacggctgtcatggtgggcaccggggtggccgcgcagaacggcatcctcatcaagggaggcaagcccctggagatggcgcacaagataaagactgtgatgtttgacaagactggcaccattacccatggcgtccccagggtcatgcgggtgctcctgctgggggatgtggccacactgcccctcaggaaggttctggctgtggtggggactgcggaggccagcagtgaacaccccttgggcgtggcagtcaccaaatactgtaaagaggaacttggaacagagaccttgggatactgcacggacttccaggcagtgccaggctgtggaattgggtgcaaagtcagcaacgtggaaggcatcctggcccacagtgagcgccctttgagtgcaccggccagtcacctgaatgaggctggcagccttcccgcagaaaaagatgcagtcccccagaccttctctgtgctgattggaaaccgtgagtggctgaggcgcaacggtttaaccatttctagcgatgtcagtgacgctatgacagaccacgagatgaaaggacagacagccatcctggtggctattgacggtgtgctctgtgggatgatcgcaatcgcagacgctgtcaagcaggaggctgccctggctgtgcacacgctgcagagcatgggtgtggacgtggttctgatcacgggggacaaccggaagacagccagagctattgccacccaggttggcatcaacaaagtctttgcagaggtgctgccttcgcacaaggtggccaaggtccaggagctccagaataaagggaagaaagtcgccatggtgggggatggggtcaatgactccccggccttggcccaggcagacatgggtgtggccattggcaccggcacggatgtggccatcgaggcagccgacgtcgtccttatcagaaatgatttgctggatgtggtggctagcattcacctttccaagaggactgtccgaaggatacgcatcaacctggtcctggcactgatttataacctggttgggatacccattgcagcaggtgtcttcatgcccatcggcattgtgctgcagccctggatgggctcagcggccatggcagcctcctctgtgtctgtggtgctctcatccctgcagctcaagtgctataagaagcctgacctggagaggtatgaggcacaggcgcatggccacatgaagcccctgacggcatcccaggtcagtgtgcacataggcatggatgacaggtggcgggactcccccagggccacaccatgggaccaggtcagctatgtcagccaggtgtcgctgtcctccctgacgtccgacaagccatctcggcacagcgctgcagcagacgatgatggggacaagtggtctctgctcctgaatggcagggatgaggagcagtacatctgatgacttcaggcaggcgggccggggcagggacttgcctccactcaccacaagctgagcaggacagccagcagcaggatgggctgagctagcctccagctttggggacttccgctccctggatatgtccagtcatcctgccctgcagcacgcggccttgtctgggtgcagctgggcttggcctggagaggacggccctgcctgcctcttggcctcacgggaccgtcagcatgggctttgtcttggactctagtccttggctggactgtagaaggtgagaggcgagtcaccctcctcacagacctctgcttggagtatttaggatgactgctgtgaaatggagaacagtttcatcaggaccaaaaaacctcactgggcctttccagagaactgcagacctcactgtcagggtctttctgatgacgcctgtctgtgtgcatcatgtttctgagaccacagtttacctcaggtgtgcctgttgctttcttcctgcatagtctgttcctttcttcgtacatagtctgttccttttctctcctgtgtgcttgtcagtggggacccctcgcaaccctgcctgtcacctgggagggtgggaccaatgtccttgtggtctttgctgctgctctcaggcgcttctccaatgctctggagtgtgcatttcagcttgaacctgcttcctggctcacacatccccagccagggagcttgccacactcttcttcaagttgaggagagttcttttttgcttaaagcccccttctccatggagtgttggcttctcaatagagtgttgttgctgaccagctggagtgagggcctcagagcctgacctgagagtccgtactcggcttcctgtggggtgtaggttctcgcgattcaggacgtccttccatatccctgcccagcctgtggtgcttgaaacgtttgccccatgggaaacgtatgtgtgcaggagcctccctgcacggcccaaggggcttcgttttcagtcttctgactgtcacctcgtggggttcagtagagaattcatgtgactagcgcctggccttgtgtggcttggaggaaatggtactgcccaaataggaggaaaacacagcctccctgagcctgcattctgcacgctgcccaggggcttcagaaaaggagtggccacagcaccccgaagggagcatctgtttacctggcagtggctctcagagcagcagaacgggttcagttttagactctgaagttggttgtgattgacagaaccctttgggagcaaactagtagagttggattaaattctgggtgaaacccttttctcccacacaaaatagttttagtgatttttttcattgtccattacttgccaggggcagttttagcagcacttttgatagattacgtctaatcctcccaaccaaccagcagggtagctattactgtccacattttacaggcaaggaaacaggctccaagaggctgaggactttgcccaggatgacatagccaatggacaagcagtgtctgtcagctgtgaaggcttcactcttattgtccttctaccttgaatagaagttttcctgataagaataaacgaggaaaaggtccttgcctcctggaagaacaaatctaccaggtgatctattcattgtttcaactcagaatgcacttgattcaggaggtcatctgaccttcaccttggatggttagtttcactttttacatatagtttttgcagggttttattttataaaatccaagcgcgctgttgattgtgttttccttgttttcagcccccccactccagcccgcagcacatttccgctgtccgtcagtaattgtgtcctctctttatgcttgcttggggaatgttgttttctgactaggctgatcattatctaaagaatctaattctgttgatttttaaaacttttaggaccataaacgttgtgttcatatatggacatggaaatatttatataattttatagaaaataaccttttagatggtcaaagtgtaaggagtttttttgtcagataatcatttctacttcaaaaacatttcatgcaatattagaataaagttcctgtcattcctct

SEQ ID NO: 109819 - DNA, 3252 bp, Homo sapiens
  Payload ID: 1561
  Gene Symbol: ATP7B
  Gene Name: ATPase, Cu++ transporting, beta polypeptide
  ENST ID: ENST00000400370
  CDS Start-End: 75-3182
cgctctcctccaccgaccaggtgaccttttgctctgagccagatcagagaagaattcggtgtccgtgcgggacgatgcctgagcaggagagacagatcacagccagagaaggggccagtcggaaaatcttatctaagctttctttgcctacccgtgcctgggaaccagcaatgaagaagagttttgcttttgacaatgttggctatgaaggtggtctggatggcctgggcccttcttctcaggtggccaccagcacagtcaggatcttgggcatgacttgccagtcatgtgtgaagtccattgaggacaggatttccaatttgaaaggcatcatcagcatgaaggtttccctggaacaaggcagtgccactgtgaaatatgtgccatcggttgtgtgcctgcaacaggtttgccatcaaattggggacatgggcttcgaggccagcattgcagaaggaaaggcagcctcctggccctcaaggtccttgcctgcccaggaggctgtggtcaagctccgggtggagggcatgacctgccagtcctgtgtcagctccattgaaggcaaggtccggaaactgcaaggagtagtgagagtcaaagtctcactcagcaaccaagaggccgtcatcacttatcagccttatctcattcagcccgaagacctcagggaccatgtaaatgacatgggatttgaagctgccatcaagagcaaagtggctcccttaagcctgggaccaattgatattgagcggttacaaagcactaacccaaagagacctttatcttctgctaaccagaattttaataattctgagaccttggggcaccaaggaagccatgtggtcaccctccaactgagaatagatggaatgcattgtaagtcttgcgtcttgaatattgaagaaaatattggccagctcctaggggttcaaagtattcaagtgtccttggagaacaaaactgcccaagtaaagtatgacccttcttgtaccagcccagtggctctgcagagggctatcgaggcacttccacctgggaattttaaagtttctcttcctgatggagccgaagggagtgggacagatcacaggtcttccagttctcattcccctggctccccaccgagaaaccaggtccagggcacatgcagtaccactctgattgccattgccggcatgacctgtgcatcctgtgtccattccattgaaggcatgatctcccaactggaaggggtgcagcaaatatcggtgtctttggccgaagggactgcaacagttctttataatccctctgtaattagcccagaagaactcagagctgctatagaagacatgggatttgaggcttcagtcgtttctggagaagccatgccagtcactaagaaacccggaagcactgtaattgcggggtctataaatgcacatggctctgtgctcattaaagctacccacgtgggcaatgacaccactttggctcagattgtgaaactggtggaagaggctcagatgtcaaaggcacccattcagcagctggctgaccggtttagtggatattttgtcccatttatcatcatcatgtcaactttgacgttggtggtatggattgtaatcggttttatcgattttggtgttgttcagagatactttcctaaccccaacaagcacatctcccagacagaggtgatcatccggtttgctttccagacgtccatcacggtgctgtgcattgcctgcccctgctccctggggctggccacgcccacggctgtcatggtgggcaccggggtggccgcgcagaacggcatcctcatcaagggaggcaagcccctggagatggcgcacaagataaagactgtgatgtttgacaagactggcaccattacccatggcgtccccagggtcatgcgggtgctcctgctgggggatgtggccacactgcccctcaggaaggttctggctgtggtggggactgcggaggccagcagtgaacaccccttgggcgtggcagtcaccaaatactgtaaagaggaacttggaacagagaccttgggatactgcacggacttccaggcagtgccaggctgtggaattgggtgcaaagtcagcaacgtggaaggcatcctggcccacagtgagcgccctttgagtgcaccggccagtcacctgaatgaggctggcagccttcccgcagaaaaagatgcagtcccccagaccttctctgtgctgattggaaaccgtgagtggctgaggcgcaacggtttaaccatttctagcgatgtcagtgacgctatgacagaccacgagatgaaaggacagacagccatcctggtggctattgacggtgtgctctgtgggatgatcgcaatcgcagacgctgtcaagcaggaggctgccctggctgtgcacacgctgcagagcatgggtgtggacgtggttctgatcacgggggacaaccggaagacagccagagctattgccacccaggttggcatcaacaaagtctttgcagaggtgctgccttcgcacaaggtggccaaggtccaggagctccagaataaagggaagaaagtcgccatggtgggggatggggtcaatgactccccggccttggcccaggcagacatgggtgtggccattggcaccggcacggatgtggccatcgaggcagccgacgtcgtccttatcagaaatgatttgctggatgtggtggctagcattcacctttccaagaggactgtccgaaggatacgcatcaacctggtcctggcactgatttataacctggttgggatacccattgcagcaggtgtcttcatgcccatcggcattgtgctgcagccctggatgggctcagcggccatggcagcctcctctgtgtctgtggtgctctcatccctgcagctcaagtgctataagaagcctgacctggagaggtatgaggcacaggcgcatggccacatgaagcccctgacggcatcccaggtcagtgtgcacataggcatggatgacaggtggcgggactcccccagggccacaccatgggaccaggtcagctatgtcagccaggtgtcgctgtcctccctgacgtccgacaagccatctcggcacagcgctgcagcagacgatgatggggacaagtggtctctgctcctgaatggcagggatgaggagcagtacatctgatgacttcaggcaggcgggccggggcagggacttgcctccactcaccacaagctgagcaggacagccagca

SEQ ID NO: 109820 - DNA, 4340 bp, Homo sapiens
  Payload ID: 1561
  Gene Symbol: ATP7B
  Gene Name: ATPase, Cu++ transporting, beta polypeptide
  ENST ID: ENST00000418097
  CDS Start-End: 75-4277
cgctctcctccaccgaccaggtgaccttttgctctgagccagatcagagaagaattcggtgtccgtgcgggacgatgcctgagcaggagagacagatcacagccagagaaggggccagtcggaaaatcttatctaagctttctttgcctacccgtgcctgggaaccagcaatgaagaagagttttgcttttgacaatgttggctatgaaggtggtctggatggcctgggcccttcttctcaggtggccaccagcacagtcaggatcttgggcatgacttgccagtcatgtgtgaagtccattgaggacaggatttccaatttgaaaggcatcatcagcatgaaggtttccctggaacaaggcagtgccactgtgaaatatgtgccatcggttgtgtgcctgcaacaggtttgccatcaaattggggacatgggcttcgaggccagcattgcagaaggaaaggcagcctcctggccctcaaggtccttgcctgcccaggaggctgtggtcaagctccgggtggagggcatgacctgccagtcctgtgtcagctccattgaaggcaaggtccggaaactgcaaggagtagtgagagtcaaagtctcactcagcaaccaagaggccgtcatcacttatcagccttatctcattcagcccgaagacctcagggaccatgtaaatgacatgggatttgaagctgccatcaagagcaaagtggctcccttaagcctgggaccaattgatattgagcggttacaaagcactaacccaaagagacctttatcttctgctaaccagaattttaataattctgagaccttggggcaccaaggaagccatgtggtcaccctccaactgagaatagatggaatgcattgtaagtcttgcgtcttgaatattgaagaaaatattggccagctcctaggggttcaaagtattcaagtgtccttggagaacaaaactgcccaagtaaagtatgacccttcttgtaccagcccagtggctctgcagagggctatcgaggcacttccacctgggaattttaaagtttctcttcctgatggagccgaagggagtgggacagatcacaggtcttccagttctcattcccctggctccccaccgagaaaccaggtccagggcacatgcagtaccactctgattgccattgccggcatgacctgtgcatcctgtgtccattccattgaaggcatgatctcccaactggaaggggtgcagcaaatatcggtgtctttggccgaagggactgcaacagttctttataatccctctgtaattagcccagaagaactcagagctgctatagaagacatgggatttgaggcttcagtcgtttctgaaagctgttctactaaccctcttggaaaccacagtgctgggaattccatggtgcaaactacagatggtacacctacatctgtgcaggaagtggctccccacactgggaggctccctgcaaaccatgccccggacatcttggcaaagtccccacaatcaaccagagcagtggcaccgcagaagtgcttcttacagatcaaaggcatgacctgtgcatcctgtgtgtctaacatagaaaggaatctgcagaaagaagctggtgttctctccgtgttggttgccttgatggcaggaaaggcagagatcaagtatgacccagaggtcatccagcccctcgagatagctcagttcatccaggacctgggttttgaggcagcagtcatggaggactacgcaggctccgatggcaacattgagctgacaatcacagggatgacctgcgcgtcctgtgtccacaacatagagtccaaactcacgaggacaaatggcatcacttatgcctccgttgcccttgccaccagcaaagcccttgttaagtttgacccggaaattatcggtccacgggatattatcaaaattattgaggaaattggctttcatgcttccctggcccagagaaaccccaacgctcatcacttggaccacaagatggaaataaagcagtggaagaagtctttcctgtgcagcctggtgtttggcatccctgtcatggccttaatgatctatatgctgatacccagcaacgagccccaccagtccatggtcctggaccacaacatcattccaggactgtccattctaaatctcatcttctttatcttgtgtacctttgtccagctcctcggtgggtggtacttctacgttcaggcctacaaatctctgagacacaggtcagccaacatggacgtgctcatcgtcctggccacaagcattgcttatgtttattctctggtcatcctggtggttgctgtggctgagaaggcggagaggagccctgtgacattcttcgacacgccccccatgctctttgtgttcattgccctgggccggtggctggaacacttggcaaagagcaaaacctcagaagccctggctaaactcatgtctctccaagccacagaagccaccgttgtgacccttggtgaggacaatttaatcatcagggaggagcaagtccccatggagctggtgcagcggggcgatatcgtcaaggtggtccctgggggaaagtttccagtggatgggaaagtcctggaaggcaataccatggctgatgagtccctcatcacaggagaagccatgccagtcactaagaaacccggaagcactgtaattgcggggtctataaatgcacatggctctgtgctcattaaagctacccacgtgggcaatgacaccactttggctcagattgtgaaactggtggaagaggctcagatgtcaaaggcacccattcagcagctggctgaccggtttagtggatattttgtcccatttatcatcatcatgtcaactttgacgttggtggtatggattgtaatcggttttatcgattttggtgttgttcagagatactttcctataaagactgtgatgtttgacaagactggcaccattacccatggcgtccccagggtcatgcgggtgctcctgctgggggatgtggccacactgcccctcaggaaggttctggctgtggtggggactgcggaggccagcagtgaacaccccttgggcgtggcagtcaccaaatactgtaaagaggaacttggaacagagaccttgggatactgcacggacttccaggcagtgccaggctgtggaattgggtgcaaagtcagcaacgtggaaggcatcctggcccacagtgagcgccctttgagtgcaccggccagtcacctgaatgaggctggcagccttcccgcagaaaaagatgcagtcccccagaccttctctgtgctgattggaaaccgtgagtggctgaggcgcaacggtttaaccatttctagcgatgtcagtgacgctatgacagaccacgagatgaaaggacagacagccatcctggtggctattgacggtgtgctctgtgggatgatcgcaatcgcagacgctgtcaagcaggaggctgccctggctgtgcacacgctgcagagcatgggtgtggacgtggttctgatcacgggggacaaccggaagacagccagagctattgccacccaggttggcatcaacaaagtctttgcagaggtgctgccttcgcacaaggtggccaaggtccaggagctccagaataaagggaagaaagtcgccatggtgggggatggggtcaatgactccccggccttggcccaggcagacatgggtgtggccattggcaccggcacggatgtggccatcgaggcagccgacgtcgtccttatcagaaatgatttgctggatgtggtggctagcattcacctttccaagaggactgtccgaaggatacgcatcaacctggtcctggcactgatttataacctggttgggatacccattgcagcaggtgtcttcatgcccatcggcattgtgctgcagccctggatgggctcagcggccatggcagcctcctctgtgtctgtggtgctctcatccctgcagctcaagtgctataagaagcctgacctggagaggtatgaggcacaggcgcatggccacatgaagcccctgacggcatcccaggtcagtgtgcacataggcatggatgacaggtggcgggactcccccagggccacaccatgggaccaggtcagctatgtcagccaggtgtcgctgtcctccctgacgtccgacaagccatctcggcacagcgctgcagcagacgatgatggggacaagtggtctctgctcctgaatggcagggatgaggagcagtacatctgatgacttcaggcaggcgggccggggcagggacttgcctccactcaccacaagctgagcaggaca

SEQ ID NO: 109821 - DNA, 6404 bp, Homo sapiens
  Payload ID: 1561
  Gene Symbol: ATP7B
  Gene Name: ATPase, Cu++ transporting, beta polypeptide
  ENST ID: ENST00000448424
  CDS Start-End: 158-4321
ttcccggacccctgtttgctttagagccgagccgcgccgatgccctcacactctgcgcctcctctcccgggactttaacaccccgctctcctccaccgaccaggtgaccttttgctctgagccagatcagagaagaattcggtgtccgtgcgggacgatgcctgagcaggagagacagatcacagccagagaaggggccagtcggaaaatcttatctaagctttctttgcctacccgtgcctgggaaccagcaatgaagaagagttttgcttttgacaatgttggctatgaaggtggtctggatggcctgggcccttcttctcaggtggccaccagcacagtcaggatcttgggcatgacttgccagtcatgtgtgaagtccattgaggacaggatttccaatttgaaaggcatcatcagcatgaaggtttccctggaacaaggcagtgccactgtgaaatatgtgccatcggttgtgtgcctgcaacaggtttgccatcaaattggggacatgggcttcgaggccagcattgcagaaggaaaggcagcctcctggccctcaaggtccttgcctgcccaggaggctgtggtcaagctccgggtggagggcatgacctgccagtcctgtgtcagctccattgaaggcaaggtccggaaactgcaaggagtagtgagagtcaaagtctcactcagcaaccaagaggccgtcatcacttatcagccttatctcattcagcccgaagacctcagggaccatgtaaatgacatgggatttgaagctgccatcaagagcaaagtggctcccttaagcctgggaccaattgatattgagcggttacaaagcactaacccaaagagacctttatcttctgctaaccagaattttaataattctgagaccttggggcaccaaggaagccatgtggtcaccctccaactgagaatagatggaatgcattgtaagtcttgcgtcttgaatattgaagaaaatattggccagctcctaggggttcaaagtattcaagtgtccttggagaacaaaactgcccaagtaaagtatgacccttcttgtaccagcccagtggctctgcagagggctatcgaggcacttccacctgggaattttaaagtttctcttcctgatggagccgaagggagtgggacagatcacaggtcttccagttctcattcccctggctccccaccgagaaaccaggtccagggcacatgcagtaccactctgattgccattgccggcatgacctgtgcatcctgtgtccattccattgaaggcatgatctcccaactggaaggggtgcagcaaatatcggtgtctttggccgaagggactgcaacagttctttataatccctctgtaattagcccagaagaactcagagctgctatagaagacatgggatttgaggcttcagtcgtttctgaaagctgttctactaaccctcttggaaaccacagtgctgggaattccatggtgcaaactacagatggtacacctacatctgtgcaggaagtggctccccacactgggaggctccctgcaaaccatgccccggacatcttggcaaagtccccacaatcaaccagagcagtggcaccgcagaagtgcttcttacagatcaaaggcatgacctgtgcatcctgtgtgtctaacatagaaaggaatctgcagaaagaagctggtgttctctccgtgttggttgccttgatggcaggaaaggcagagatcaagtatgacccagaggtcatccagcccctcgagatagctcagttcatccaggacctgggttttgaggcagcagtcatggaggactacgcaggctccgatggcaacattgagctgacaatcacagggatgacctgcgcgtcctgtgtccacaacatagagtccaaactcacgaggacaaatggcatcacttatgcctccgttgcccttgccaccagcaaagcccttgttaagtttgacccggaaattatcggtccacgggatattatcaaaattattgaggaaattggctttcatgcttccctggcccagagaaaccccaacgctcatcacttggaccacaagatggaaataaagcagtggaagaagtctttcctgtgcagcctggtgtttggcatccctgtcatggccttaatgatctatatgctgatacccagcaacgagccccaccagtccatggtcctggaccacaacatcattccaggactgtccattctaaatctcatcttctttatcttgtgtacctttgtccagagcaaaacctcagaagccctggctaaactcatgtctctccaagccacagaagccaccgttgtgacccttggtgaggacaatttaatcatcagggaggagcaagtccccatggagctggtgcagcggggcgatatcgtcaaggtggtccctgggggaaagtttccagtggatgggaaagtcctggaaggcaataccatggctgatgagtccctcatcacaggagaagccatgccagtcactaagaaacccggaagcactgtaattgcggggtctataaatgcacatggctctgtgctcattaaagctacccacgtgggcaatgacaccactttggctcagattgtgaaactggtggaagaggctcagatgtcaaaggcacccattcagcagctggctgaccggtttagtggatattttgtcccatttatcatcatcatgtcaactttgacgttggtggtatggattgtaatcggttttatcgattttggtgttgttcagagatactttcctaaccccaacaagcacatctcccagacagaggtgatcatccggtttgctttccagacgtccatcacggtgctgtgcattgcctgcccctgctccctggggctggccacgcccacggctgtcatggtgggcaccggggtggccgcgcagaacggcatcctcatcaagggaggcaagcccctggagatggcgcacaagataaagactgtgatgtttgacaagactggcaccattacccatggcgtccccagggtcatgcgggtgctcctgctgggggatgtggccacactgcccctcaggaaggttctggctgtggtggggactgcggaggccagcagtgaacaccccttgggcgtggcagtcaccaaatactgtaaagaggaacttggaacagagaccttgggatactgcacggacttccaggcagtgccaggctgtggaattgggtgcaaagtcagcaacgtggaaggcatcctggcccacagtgagcgccctttgagtgcaccggccagtcacctgaatgaggctggcagccttcccgcagaaaaagatgcagtcccccagaccttctctgtgctgattggaaaccgtgagtggctgaggcgcaacggtttaaccatttctagcgatgtcagtgacgctatgacagaccacgagatgaaaggacagacagccatcctggtggctattgacggtgtgctctgtgggatgatcgcaatcgcagacgctgtcaagcaggaggctgccctggctgtgcacacgctgcagagcatgggtgtggacgtggttctgatcacgggggacaaccggaagacagccagagctattgccacccaggttggcatcaacaaagtctttgcagaggtgctgccttcgcacaaggtggccaaggtccaggagctccagaataaagggaagaaagtcgccatggtgggggatggggtcaatgactccccggccttggcccaggcagacatgggtgtggccattggcaccggcacggatgtggccatcgaggcagccgacgtcgtccttatcagaaatgatttgctggatgtggtggctagcattcacctttccaagaggactgtccgaaggatacgcatcaacctggtcctggcactgatttataacctggttgggatacccattgcagcaggtgtcttcatgcccatcggcattgtgctgcagccctggatgggctcagcggccatggcagcctcctctgtgtctgtggtgctctcatccctgcagctcaagtgctataagaagcctgacctggagaggtatgaggcacaggcgcatggccacatgaagcccctgacggcatcccaggtcagtgtgcacataggcatggatgacaggtggcgggactcccccagggccacaccatgggaccaggtcagctatgtcagccaggtgtcgctgtcctccctgacgtccgacaagccatctcggcacagcgctgcagcagacgatgatggggacaagtggtctctgctcctgaatggcagggatgaggagcagtacatctgatgacttcaggcaggcgggccggggcagggacttgcctccactcaccacaagctgagcaggacagccagcagcaggatgggctgagctagcctccagctttggggacttccgctccctggatatgtccagtcatcctgccctgcagcacgcggccttgtctgggtgcagctgggcttggcctggagaggacggccctgcctgcctcttggcctcacgggaccgtcagcatgggctttgtcttggactctagtccttggctggactgtagaaggtgagaggcgagtcaccctcctcacagacctctgcttggagtatttaggatgactgctgtgaaatggagaacagtttcatcaggaccaaaaaacctcactgggcctttccagagaactgcagacctcactgtcagggtctttctgatgacgcctgtctgtgtgcatcatgtttctgagaccacagtttacctcaggtgtgcctgttgctttcttcctgcatagtctgttcctttcttcgtacatagtctgttccttttctctcctgtgtgcttgtcagtggggacccctcgcaaccctgcctgtcacctgggagggtgggaccaatgtccttgtggtctttgctgctgctctcaggcgcttctccaatgctctggagtgtgcatttcagcttgaacctgcttcctggctcacacatccccagccagggagcttgccacactcttcttcaagttgaggagagttcttttttgcttaaagcccccttctccatggagtgttggcttctcaatagagtgttgttgctgaccagctggagtgagggcctcagagcctgacctgagagtccgtactcggcttcctgtggggtgtaggttctcgcgattcaggacgtccttccatatccctgcccagcctgtggtgcttgaaacgtttgccccatgggaaacgtatgtgtgcaggagcctccctgcacggcccaaggggcttcgttttcagtcttctgactgtcacctcgtggggttcagtagagaattcatgtgactagcgcctggccttgtgtggcttggaggaaatggtactgcccaaataggaggaaaacacagcctccctgagcctgcattctgcacgctgcccaggggcttcagaaaaggagtggccacagcaccccgaagggagcatctgtttacctggcagtggctctcagagcagcagaacgggttcagttttagactctgaagttggttgtgattgacagaaccctttgggagcaaactagtagagttggattaaattctgggtgaaacccttttctcccacacaaaatagttttagtgatttttttcattgtccattacttgccaggggcagttttagcagcacttttgatagattacgtctaatcctcccaaccaaccagcagggtagctattactgtccacattttacaggcaaggaaacaggctccaagaggctgaggactttgcccaggatgacatagccaatggacaagcagtgtctgtcagctgtgaaggcttcactcttattgtccttctaccttgaatagaagttttcctgataagaataaacgaggaaaaggtccttgcctcctggaagaacaaatctaccaggtgatctattcattgtttcaactcagaatgcacttgattcaggaggtcatctgaccttcaccttggatggttagtttcactttttacatatagtttttgcagggttttattttataaaatccaagcgcgctgttgattgtgttttccttgttttcagcccccccactccagcccgcagcacatttccgctgtccgtcagtaattgtgtcctctctttatgcttgcttggggaatgttgttttctgactaggctgatcattatctaaagaatctaattctgttgatttttaaaacttttaggaccataaacgttgtgttcatatatggacatggaaatatttatataattttatagaaaataaccttttagatggtcaaagtgtaaggagtttttttgtcagataatcatttctacttcaaaaacatttcatgcaatattagaataaagttcctgtcattcctcta

SEQ ID NO: 109822 - DNA, 4321 bp, Homo sapiens
  Payload ID: 1561
  Gene Symbol: ATP7B
  Gene Name: ATPase, Cu++ transporting, beta polypeptide
  ENST ID: ENST00000634308
  CDS Start-End: 73-2757
ctctcctccaccgaccaggtgaccttttgctctgagccagatcagagaagaattcggtgtccgtgcgggacgatgcctgagcaggagagacagatcacagccagagaaggggccagtcggaaaatcttatctaagctttctttgcctacccgtgcctgggaaccagcaatgaagaagagttttgcttttgacaatgttggctatgaaggtggtctggatggcctgggcccttcttctcaggtggccaccagcacagtcaggatcttgggcatgacttgccagtcatgtgtgaagtccattgaggacaggatttccaatttgaaaggcatcatcagcatgaaggtttccctggaacaaggcagtgccactgtgaaatatgtgccatcggttgtgtgcctgcaacaggtttgccatcaaattggggacatgggcttcgaggccagcattgcagaaggaaaggcagcctcctggccctcaaggtccttgcctgcccaggaggctgtggtcaagctccgggtggagggcatgacctgccagtcctgtgtcagctccattgaaggcaaggtccggaaactgcaaggagtagtgagagtcaaagtctcactcagcaaccaagaggccgtcatcacttatcagccttatctcattcagcccgaagacctcagggaccatgtaaatgacatgggatttgaagctgccatcaagagcaaagtggctcccttaagcctgggaccaattgatattgagcggttacaaagcactaacccaaagagacctttatcttctgctaaccagaattttaataattctgagaccttggggcaccaaggaagccatgtggtcaccctccaactgagaatagatggaatgcattgtaagtcttgcgtcttgaatattgaagaaaatattggccagctcctaggggttcaaagtattcaagtgtccttggagaacaaaactgcccaagtaaagtatgacccttcttgtaccagcccagtggctctgcagagggctatcgaggcacttccacctgggaattttaaagtttctcttcctgatggagccgaagggagtgggacagatcacaggtcttccagttctcattcccctggctccccaccgagaaaccaggtccagggcacatgcagtaccactctgattgccattgccggcatgacctgtgcatcctgtgtccattccattgaaggcatgatctcccaactggaaggggtgcagcaaatatcggtgtctttggccgaagggactgcaacagttctttataatccctctgtaattagcccagaagaactcagagctgctatagaagacatgggatttgaggcttcagtcgtttctgaaagctgttctactaaccctcttggaaaccacagtgctgggaattccatggtgcaaactacagatggtacacctacatctgtgcaggaagtggctccccacactgggaggctccctgcaaaccatgccccggacatcttggcaaagtccccacaatcaaccagagcagtggcaccgcagaagtgcttcttacagatcaaaggcatgacctgtgcatcctgtgtgtctaacatagaaaggaatctgcagaaagaagctggtgttctctccgtgttggttgccttgatggcaggaaaggcagagatcaagtatgacccagaggtcatccagcccctcgagatagctcagttcatccaggacctgggttttgaggcagcagtcatggaggactacgcaggctccgatggcaacattgagctgacaatcacagggatgacctgcgcgtcctgtgtccacaacatagagtccaaactcacgaggacaaatggcatcacttatgcctccgttgcccttgccaccagcaaagcccttgttaagtttgacccggaaattatcggtccacgggatattatcaaaattattgaggaaattggctttcatgcttccctggcccagagaaaccccaacgctcatcacttggaccacaagatggaaataaagcagtggaagaagtctttcctgtgcagcctggtgtttggcatccctgtcatggccttaatgatctatatgctgatacccagcaacgagccccaccagtccatggtcctggaccacaacatcattccaggactgtccattctaaatctcatcttctttatcttgtgtacctttgtccagagcaaaacctcagaagccctggctaaactcatgtctctccaagccacagaagccaccgttgtgacccttggtgaggacaatttaatcatcagggaggagcaagtccccatggagctggtgcagcggggcgatatcgtcaaggtggtccctgggggaaagtttccagtggatgggaaagtcctggaaggcaataccatggctgatgagtccctcatcacaggagaagccatgccagtcactaagaaacccggaagcactgtaattgcggggtctataaatgcacatggctctgtgctcattaaagctacccacgtgggcaatgacaccactttggctcagattgtgaaactggtggaagaggctcagatgtcaaaggcacccattcagcagctggctgaccggtttagtggatattttgtcccatttatcatcatcatgtcaactttgacgttggtggtatggattgtaatcggttttatcgattttggtgttgttcagagatactttcctggaggatgctggcaaatgagaaccccaacaagcacatctcccagacagaggtgatcatccggtttgctttccagacgtccatcacggtgctgtgcattgcctgcccctgctccctggggctggccacgcccacggctgtcatggtgggcaccggggtggccgcgcagaacggcatcctcatcaagggaggcaagcccctggagatggcgcacaagataaagactgtgatgtttgacaagactggcaccattacccatggcgtccccagggtcatgcgggtgctcctgctgggggatgtggccacactgcccctcaggaaggttctggctgtggtggggactgcggaggccagcagtgaacaccccttgggcgtggcagtcaccaaatactgtaaagaggaacttggaacagagaccttgggatactgcacggacttccaggcagtgccaggctgtggaattgggtgcaaagtcagcaacgtggaaggcatcctggcccacagtgagcgccctttgagtgcaccggccagtcacctgaatgaggctggcagccttcccgcagaaaaagatgcagtcccccagaccttctctgtgctgattggaaaccgtgagtggctgaggcgcaacggtttaaccatttctagcgatgtcagtgacgctatgacagaccacgagatgaaaggacagacagccatcctggtggctattgacggtgtgctctgtgggatgatcgcaatcgcagacgctgtcaagcaggaggctgccctggctgtgcacacgctgcagagcatgggtgtggacgtggttctgatcacgggggacaaccggaagacagccagagctattgccacccaggttggcatcaacaaagtctttgcagaggtgctgccttcgcacaaggtggccaaggtccaggagctccagaataaagggaagaaagtcgccatggtgggggatggggtcaatgactccccggccttggcccaggcagacatgggtgtggccattggcaccggcacggatgtggccatcgaggcagccgacgtcgtccttatcagaaatgatttgctggatgtggtggctagcattcacctttccaagaggactgtccgaaggatacgcatcaacctggtcctggcactgatttataacctggttgggatacccattgcagcaggtgtcttcatgcccatcggcattgtgctgcagccctggatgggctcagcggccatggcagcctcctctgtgtctgtggtgctctcatccctgcagctcaagtgctataagaagcctgacctggagaggtatgaggcacaggcgcatggccacatgaagcccctgacggcatcccaggtcagtgtgcacataggcatggatgacaggtggcgggactcccccagggccacaccatgggaccaggtcagctatgtcagccaggtgtcgctgtcctccctgacgtccgacaagccatctcggcacagcgctgcagcagacgatgatggggacaagtggtctctgctcctgaatggcagggatgaggagcagtacatctgatgacttcaggcaggcgggccggggcagggacttgcctccactcaccacaagctgagcaggacagc

SEQ ID NO: 109823 - DNA, 4398 bp, Homo sapiens
  Payload ID: 1561
  Gene Symbol: ATP7B
  Gene Name: ATPase, Cu++ transporting, beta polypeptide
  ENST ID: ENST00000634844
  CDS Start-End: 75-4328
cgctctcctccaccgaccaggtgaccttttgctctgagccagatcagagaagaattcggtgtccgtgcgggacgatgcctgagcaggagagacagatcacagccagagaaggggccagtcggaaaatcttatctaagctttctttgcctacccgtgcctgggaaccagcaatgaagaagagttttgcttttgacaatgttggctatgaaggtggtctggatggcctgggcccttcttctcaggtggccaccagcacagtcaggatcttgggcatgacttgccagtcatgtgtgaagtccattgaggacaggatttccaatttgaaaggcatcatcagcatgaaggtttccctggaacaaggcagtgccactgtgaaatatgtgccatcggttgtgtgcctgcaacaggtttgccatcaaattggggacatgggcttcgaggccagcattgcagaaggaaaggcagcctcctggccctcaaggtccttgcctgcccaggaggctgtggtcaagctccgggtggagggcatgacctgccagtcctgtgtcagctccattgaaggcaaggtccggaaactgcaaggagtagtgagagtcaaagtctcactcagcaaccaagaggccgtcatcacttatcagccttatctcattcagcccgaagacctcagggaccatgtaaatgacatgggatttgaagctgccatcaagagcaaagtggctcccttaagcctgggaccaattgatattgagcggttacaaagcactaacccaaagagacctttatcttctgctaaccagaattttaataattctgagaccttggggcaccaaggaagccatgtggtcaccctccaactgagaatagatggaatgcattgtaagtcttgcgtcttgaatattgaagaaaatattggccagctcctaggggttcaaagtattcaagtgtccttggagaacaaaactgcccaagtaaagtatgacccttcttgtaccagcccagtggctctgcagagggctatcgaggcacttccacctgggaattttaaagtttctcttcctgatggagccgaagggagtgggacagatcacaggtcttccagttctcattcccctggctccccaccgagaaaccaggtccagggcacatgcagtaccactctgattgccattgccggcatgacctgtgcatcctgtgtccattccattgaaggcatgatctcccaactggaaggggtgcagcaaatatcggtgtctttggccgaagggactgcaacagttctttataatccctctgtaattagcccagaagaactcagagctgctatagaagacatgggatttgaggcttcagtcgtttctgaaagctgttctactaaccctcttggaaaccacagtgctgggaattccatggtgcaaactacagatggtacacctacatctgtgcaggaagtggctccccacactgggaggctccctgcaaaccatgccccggacatcttggcaaagtccccacaatcaaccagagcagtggcaccgcagaagtgcttcttacagatcaaaggcatgacctgtgcatcctgtgtgtctaacatagaaaggaatctgcagaaagaagctggtgttctctccgtgttggttgccttgatggcaggaaaggcagagatcaagtatgacccagaggtcatccagcccctcgagatagctcagttcatccaggacctgggttttgaggcagcagtcatggaggactacgcaggctccgatggcaacattgagctgacaatcacagggatgacctgcgcgtcctgtgtccacaacatagagtccaaactcacgaggacaaatggcatcacttatgcctccgttgcccttgccaccagcaaagcccttgttaagtttgacccggaaattatcggtccacgggatattatcaaaattattgaggaaattggctttcatgcttccctggcccagagaaaccccaacgctcatcacttggaccacaagatggaaataaagcagtggaagaagtctttcctgtgcagcctggtgtttggcatccctgtcatggccttaatgatctatatgctgatacccagcaacgagccccaccagtccatggtcctggaccacaacatcattccaggactgtccattctaaatctcatcttctttatcttgtgtacctttgtccaggcggagaggagccctgtgacattcttcgacacgccccccatgctctttgtgttcattgccctgggccggtggctggaacacttggcaaagagcaaaacctcagaagccctggctaaactcatgtctctccaagccacagaagccaccgttgtgacccttggtgaggacaatttaatcatcagggaggagcaagtccccatggagctggtgcagcggggcgatatcgtcaaggtggtccctgggggaaagtttccagtggatgggaaagtcctggaaggcaataccatggctgatgagtccctcatcacaggagaagccatgccagtcactaagaaacccggaagcactgtaattgcggggtctataaatgcacatggctctgtgctcattaaagctacccacgtgggcaatgacaccactttggctcagattgtgaaactggtggaagaggctcagatgtcaaaggcacccattcagcagctggctgaccggtttagtggatattttgtcccatttatcatcatcatgtcaactttgacgttggtggtatggattgtaatcggttttatcgattttggtgttgttcagagatactttcctaaccccaacaagcacatctcccagacagaggtgatcatccggtttgctttccagacgtccatcacggtgctgtgcattgcctgcccctgctccctggggctggccacgcccacggctgtcatggtgggcaccggggtggccgcgcagaacggcatcctcatcaagggaggcaagcccctggagatggcgcacaagataaagactgtgatgtttgacaagactggcaccattacccatggcgtccccagggtcatgcgggtgctcctgctgggggatgtggccacactgcccctcaggaaggttctggctgtggtggggactgcggaggccagcagtgaacaccccttgggcgtggcagtcaccaaatactgtaaagaggaacttggaacagagaccttgggatactgcacggacttccaggcagtgccaggctgtggaattgggtgcaaagtcagcaacgtggaaggcatcctggcccacagtgagcgccctttgagtgcaccggccagtcacctgaatgaggctggcagccttcccgcagaaaaagatgcagtcccccagaccttctctgtgctgattggaaaccgtgagtggctgaggcgcaacggtttaaccatttctagcgatgtcagtgacgctatgacagaccacgagatgaaaggacagacagccatcctggtggctattgacggtgtgctctgtgggatgatcgcaatcgcagacgctgtcaagcaggaggctgccctggctgtgcacacgctgcagagcatgggtgtggacgtggttctgatcacgggggacaaccggaagacagccagagctattgccacccaggttggcatcaacaaagtctttgcagaggtgctgccttcgcacaaggtggccaaggtccaggagctccagaataaagggaagaaagtcgccatggtgggggatggggtcaatgactccccggccttggcccaggcagacatgggtgtggccattggcaccggcacggatgtggccatcgaggcagccgacgtcgtccttatcagaaatgatttgctggatgtggtggctagcattcacctttccaagaggactgtccgaaggatacgcatcaacctggtcctggcactgatttataacctggttgggatacccattgcagcaggtgtcttcatgcccatcggcattgtgctgcagccctggatgggctcagcggccatggcagcctcctctgtgtctgtggtgctctcatccctgcagctcaagtgctataagaagcctgacctggagaggtatgaggcacaggcgcatggccacatgaagcccctgacggcatcccaggtcagtgtgcacataggcatggatgacaggtggcgggactcccccagggccacaccatgggaccaggtcagctatgtcagccaggtgtcgctgtcctccctgacgtccgacaagccatctcggcacagcgctgcagcagacgatgatggggacaagtggtctctgctcctgaatggcagggatgaggagcagtacatctgatgacttcaggcaggcgggccggggcagggacttgcctccactcaccacaagctgagcaggacagccagca

SEQ ID NO: 109824 - DNA, 2328 bp, Homo sapiens
  Payload ID: 1561
  Gene Symbol: ATP7B
  Gene Name: ATPase, Cu++ transporting, beta polypeptide
  ENST ID: ENST00000634296
  CDS Start-End: 1-128
ttgaggaaattggctttcatgcttccctggcccagagaaaccccaacgctcatcacttggaccacaagatggaaataaagcactcctcggtgggtggtacttctacgttcaggcctacaaatctctgagacacaggtcagccaacatggacgtgctcatcgtcctggccacaagcattgcttatgtttattctctggtcatcctggtggttgctgtggctgagaaggcggagaggagccctgtgacattcttcgacacgccccccatgctctttgtgttcattgccctgggccggtggctggaacacttggcaaagagcaaaacctcagaagccctggctaaactcatgtctctccaagccacagaagccaccgttgtgacccttggtgaggacaatttaatcatcagggaggagcaagtccccatggagctggtgcagcggggcgatatcgtcaaggtggtccctgggggaaagtttccagtggatgggaaagtcctggaaggcaataccatggctgatgagtccctcatcacaggagaagccatgccagtcactaagaaacccggaagcactgtaattgcggggtctataaatgcacatggctctgtgctcattaaagctacccacgtgggcaatgacaccactttggctcagattgtgaaactggtggaagaggctcagatgtcaaaggcacccattcagcagctggctgaccggtttagtggatattttgtcccatttatcatcatcatgtcaactttgacgttggtggtatggattgtaatcggttttatcgattttggtgttgttcagagatactttcctaaccccaacaagcacatctcccagacagaggtgatcatccggtttgctttccagacgtccatcacggtgctgtgcattgcctgcccctgctccctggggctggccacgcccacggctgtcatggtgggcaccggggtggccgcgcagaacggcatcctcatcaagggaggcaagcccctggagatggcgcacaaggaacttggaacagagaccttgggatactgcacggacttccaggcagtgccaggctgtggaattgggtgcaaagtcagcaacgtggaaggcatcctggcccacagtgagcgccctttgagtgcaccggccagtcacctgaatgaggctggcagccttcccgcagaaaaagatgcagtcccccagaccttctctgtgctgattggaaaccgtgagtggctgaggcgcaacggtttaaccatttctagcgatgtcagtgacgctatgacagaccacgagatgaaaggacagacagccatcctggtggctattgacggtgtgctctgtgggatgatcgcaatcgcagacgctgtcaagcaggaggctgccctggctgtgcacacgctgcagagcatgggtgtggacgtggttctgatcacgggggacaaccggaagacagccagagctattgccacccaggttggcatcaacaaagtctttgcagaggtgctgccttcgcacaaggtggccaaggtccaggagctccagaataaagggaagaaagtcgccatggtgggggatggggtcaatgactccccggccttggcccaggcagacatgggtgtggccattggcaccggcacggatgtggccatcgaggcagccgacgtcgtccttatcagaaatgatttgctggatgtggtggctagcattcacctttccaagaggactgtccgaaggatacgcatcaacctggtcctggcactgatttataacctggttgggatacccattgcagcaggtgtcttcatgcccatcggcattgtgctgcagccctggatgggctcagcggccatggcagcctcctctgtgtctgtggtgctctcatccctgcagctcaagtgctataagaagcctgacctggagaggtatgaggcacaggcgcatggccacatgaagcccctgacggcatcccaggtcagtgtgcacataggcatggatgacaggtggcgggactcccccagggccacaccatgggaccaggtcagctatgtcagccaggtgtcgctgtcctccctgacgtccgacaagccatctcggcacagcgctgcagcagacgatgatggggacaagtggtctctgctcctgaatggcagggatgaggagcagtacatctgatgacttcaggcaggcgggccggggcagggacttgcctccactcaccacaagctgagcaggacagccagcagcaggatgggctgagctagcctccagctttggggacttccgctccctggatatgtccagtcatcctgccctgcagcacgcgg

SEQ ID NO: 109825 - DNA, 1649 bp, Homo sapiens
  Payload ID: 1562
  Gene Symbol: ATP6V0E2
  Gene Name: ATPase, H+ transporting V0 subunit e2
  Uniprot ID: Q8NHE4
  ENST ID: ENST00000425642
  CDS Start-End: 24-269
gcctgggcatcctgcgcccggccatgacggcgcactcattcgccctcccggtcatcatcttcaccacgttctggggcctcgtcggcatcgccgggccctggttcgtgccgaagggacccaaccgcggagtgatcatcaccatgctggtcgccaccgccgtctgctgttacctcttctggctcatcgccatcctggcgcagctgaaccccctgttcgggccccagctgaagaatgagaccatctggtacgtgcgcttcctgtgggagtgacccgccgcccccgacccaggtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcagtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcttttggctgcagtgggggtggatttcagagcctctcatggcagcatctaagtgaccagagctgggatgagagaggggaaggggcaatgtgagtggcgctatgggacgggccagccctgctcctgagccagccccgccctctgccccctggccctgggctctgtgctagggatggtgaagaatgggggcgtgccagcctggcaggagtgggaagcaacacgcaggggtcccggacctctccagccttgccctcacgcttacccgagctcccagtgtggttagcacagagctcacccaccttgcctggctcccagctggggcctgtcctcactggtgctccaggggaagaaacgacagcctcacttctgtatggactgctgatgtggcctgccatcctgttcagcgggcattgtctttggagcagcaggagaataggatgcctctcactcacatgccagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatgaaaaga

SEQ ID NO: 109826 - DNA, 2722 bp, Homo sapiens
  Payload ID: 1562
  Gene Symbol: ATP6V0E2
  Gene Name: ATPase, H+ transporting V0 subunit e2
  Uniprot ID: Q8NHE4
  ENST ID: ENST00000456496
  CDS Start-End: 952-1344
gttgctagagataccgcctggaggccactgatctgtaaaagggatctctacagaagatagggatttttgatcgccagagaagaagggatatgtgagatccaaacgccgaaggaggaaagcaggctccgtggtctcttccagccctgatggaagaaactaccgagccttattatactaggtgctttccacatgcctattcatttaatcctccagcaaccttgtaagaagggccatcccattttatatttaaacaaaccttaactactgacgcaaggagtcaaggatctaatcccaaagcctctgcctggttcgctgcagatggatgtccgcgaggacgccagccctccgcctcccgccgggtccctgaacgccggcccggccggtccaacctcattccgcttcccgccatcgaaacgcgaagcccccgccttcccccaaacgtctcagcgccgctggggcctttctggctgcgccgcctccgaccccaggccccggtccgcgcccgccgctcgctagtcctgggagtgaggagaacgcgtgctgaggacccggccagagggacagcggggaccgccctcccgctgcgtctctgaaagcgaggccgttcctcccgcgtccgacccccgcggggccgtcaggttcggggcggcccaggctgcgggtccgcagggcgcttcgggccgagccggcgcggcgcgtgaagggcaggggacgccccgaaagaccgctggggtgggaccccaagctccaggggtctttggaaataagaatgcggcgtgacgttggctgtgcgggcgcggggctgacgcggaccctataacccatcgccgaaaccgggcggccgcgcccctattcctcggcatttctctctgtccgcggccctgctcagccaatcagcgagtgggctcctaggcaggtcctgagtgacagcgcggcgggctggatcaggagatgcgcgtgcgcggcccggcccggctgatcgcttcgggtgctcgactcctgttgcgcatgctcagcgcgctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaagggacccaaccgcggagtgatcatcaccatgctggtcgccaccgccgtctgctgttacctcttctggctcatcgccatcctggcgcagctgaaccccctgttcgggccccagctgaagaatgagaccatctggtacgtgcgcttcctgtgggagtgacccgccgcccccgacccaggtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcagtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcttttggctgcagtgggggtggatttcagagcctctcatggcagcatctaagtgaccagagctgggatgagagaggggaaggggcaatgtgagtggcgctatgggacgggccagccctgctcctgagccagccccgccctctgccccctggccctgggctctgtgctagggatggtgaagaatgggggcgtgccagcctggcaggagtgggaagcaacacgcaggggtcccggacctctccagccttgccctcacgcttacccgagctcccagtgtggttagcacagagctcacccaccttgcctggctcccagctggggcctgtcctcactggtgctccaggggaagaaacgacagcctcacttctgtatggactgctgatgtggcctgccatcctgttcagcgggcattgtctttggagcagcaggagaataggatgcctctcactcacatgccagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatgaaaa

SEQ ID NO: 109827 - DNA, 2605 bp, Homo sapiens
  Payload ID: 1562
  Gene Symbol: ATP6V0E2
  Gene Name: ATPase, H+ transporting V0 subunit e2
  ENST ID: ENST00000421974
  CDS Start-End: 952-1593
gttgctagagataccgcctggaggccactgatctgtaaaagggatctctacagaagatagggatttttgatcgccagagaagaagggatatgtgagatccaaacgccgaaggaggaaagcaggctccgtggtctcttccagccctgatggaagaaactaccgagccttattatactaggtgctttccacatgcctattcatttaatcctccagcaaccttgtaagaagggccatcccattttatatttaaacaaaccttaactactgacgcaaggagtcaaggatctaatcccaaagcctctgcctggttcgctgcagatggatgtccgcgaggacgccagccctccgcctcccgccgggtccctgaacgccggcccggccggtccaacctcattccgcttcccgccatcgaaacgcgaagcccccgccttcccccaaacgtctcagcgccgctggggcctttctggctgcgccgcctccgaccccaggccccggtccgcgcccgccgctcgctagtcctgggagtgaggagaacgcgtgctgaggacccggccagagggacagcggggaccgccctcccgctgcgtctctgaaagcgaggccgttcctcccgcgtccgacccccgcggggccgtcaggttcggggcggcccaggctgcgggtccgcagggcgcttcgggccgagccggcgcggcgcgtgaagggcaggggacgccccgaaagaccgctggggtgggaccccaagctccaggggtctttggaaataagaatgcggcgtgacgttggctgtgcgggcgcggggctgacgcggaccctataacccatcgccgaaaccgggcggccgcgcccctattcctcggcatttctctctgtccgcggccctgctcagccaatcagcgagtgggctcctaggcaggtcctgagtgacagcgcggcgggctggatcaggagatgcgcgtgcgcggcccggcccggctgatcgcttcgggtgctcgactcctgttgcgcatgctcagcgcgctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaagggacccaaccgcggagtgatcatcaccatgctggtcgccaccgccgtctgctgttacctcttgtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcagtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcttttggctgcagtgggggtggatttcagagcctctcatggcagcatctaagtgaccagagctgggatgagagaggggaaggggcaatgtgagtggcgctatgggacgggccagccctgctcctgagccagccccgccctctgccccctggccctgggctctgtgctagggatggtgaagaatgggggcgtgccagcctggcaggagtgggaagcaacacgcaggggtcccggacctctccagccttgccctcacgcttacccgagctcccagtgtggttagcacagagctcacccaccttgcctggctcccagctggggcctgtcctcactggtgctccaggggaagaaacgacagcctcacttctgtatggactgctgatgtggcctgccatcctgttcagcgggcattgtctttggagcagcaggagaataggatgcctctcactcacatgccagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatg

SEQ ID NO: 109828 - DNA, 1666 bp, Homo sapiens
  Payload ID: 1562
  Gene Symbol: ATP6V0E2
  Gene Name: ATPase, H+ transporting V0 subunit e2
  Uniprot ID: Q8NHE4
  ENST ID: ENST00000479613
  CDS Start-End: 91-654
atgctcagcgcgctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaagggacccaaccgcggagtgatcatcaccatgctggtcgccaccgccgtctgctgttacctcttctggctcatcgccatcctggcgcagctgaaccccctgttcgggccccagctgaagaatgagaccatctggtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcagtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcttttggctgcagtgggggtggatttcagagcctctcatggcagcatctaagtgaccagagctgggatgagagaggggaaggggcaatgtgagtggcgctatgggacgggccagccctgctcctgagccagccccgccctctgccccctggccctgggctctgtgctagggatggtgaagaatgggggcgtgccagcctggcaggagtgggaagcaacacgcaggggtcccggacctctccagccttgccctcacgcttacccgagctcccagtgtggttagcacagagctcacccaccttgcctggctcccagctggggcctgtcctcactggtgctccaggggaagaaacgacagcctcacttctgtatggactgctgatgtggcctgccatcctgttcagcgggcattgtctttggagcagcaggagaataggatgcctctcactcacatgccagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatg

SEQ ID NO: 109829 - DNA, 495 bp, Homo sapiens
  Payload ID: 1562
  Gene Symbol: ATP6V0E2
  Gene Name: ATPase, H+ transporting V0 subunit e2
  ENST ID: ENST00000464683
  CDS Start-End: 91-330
atgctcagcgcgctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaagggacccaaccgcggagtgatcatcaccatgctggtcgccaccgccgtctgctgttacctcttttttcaggctgcaccctacacccatgaaattacaactctcgagatctgcacttgggaattcctgttgttcatgaatgcccccaggtgactggaatgcagccatcttagaaccactagctggctcatcgccatcctggcgcagctgaaccccctgttcgggccccagctgaagaatgagaccatctggtacgtgcgcttcctgtgggagtgacccgccgcccccgacccaggtgcccagctctcggaatgactg

SEQ ID NO: 109830 - DNA, 1766 bp, Homo sapiens
  Payload ID: 1562
  Gene Symbol: ATP6V0E2
  Gene Name: ATPase, H+ transporting V0 subunit e2
  Uniprot ID: Q8NHE4
  ENST ID: ENST00000471877
  CDS Start-End: 80-325
gctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaagggacccaaccgcggagtgatcatcaccatgctggtcgccaccgccgtctgctgttacctcttctggctcatcgccatcctggcgcagctgaaccccctgttcgggccccagctgaagaatgagaccatctggtacgtgcgcttcctgtgggagtgacccgccgcccccgacccagcgcttcaccccaaggcaagaccctaacctgggccctaacctggacggagggagggaaagggtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcagtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcttttggctgcagtgggggtggatttcagagcctctcatggcagcatctaagtgaccagagctgggatgagagaggggaaggggcaatgtgagtggcgctatgggacgggccagccctgctcctgagccagccccgccctctgccccctggccctgggctctgtgctagggatggtgaagaatgggggcgtgccagcctggcaggagtgggaagcaacacgcaggggtcccggacctctccagccttgccctcacgcttacccgagctcccagtgtggttagcacagagctcacccaccttgcctggctcccagctggggcctgtcctcactggtgctccaggggaagaaacgacagcctcacttctgtatggactgctgatgtggcctgccatcctgttcagcgggcattgtctttggagcagcaggagaataggatgcctctcactcacatgccagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatgaaaagat

SEQ ID NO: 109831 - DNA, 513 bp, Homo sapiens
  Payload ID: 1562
  Gene Symbol: ATP6V0E2
  Gene Name: ATPase, H+ transporting V0 subunit e2
  Uniprot ID: Q8NHE4
  ENST ID: ENST00000464662
  CDS Start-End: 74-319
cggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaagggacccaaccgcggagtgatcatcaccatgctggtcgccaccgccgtctgctgttacctcttctggctcatcgccatcctggcgcagctgaaccccctgttcgggccccagctgaagaatgagaccatctggtacgtgcgcttcctgtgggagtgacccgccgcccccgacccaggtactgtgtgggcgaggggtgtgggtggggaagaggggaaagacaaggctttcccacacccagggcaggcctcggtcatattattttggatgcggccaacccagcagatggcagggcctgtgttcccagggtgacgaagggcccagggagccatccacactccggcaggcacatg

SEQ ID NO: 109832 - DNA, 893 bp, Homo sapiens
  Payload ID: 1562
  Gene Symbol: ATP6V0E2
  Gene Name: ATPase, H+ transporting V0 subunit e2
  Uniprot ID: Q8NHE4
  ENST ID: ENST00000606024
  CDS Start-End: 80-574
gctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaagggacccaaccgcggagtgatcatcaccatgctggtcgccaccgccgtctgctgttacctcttgtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcagtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctcc

SEQ ID NO: 109833 - DNA, 2727 bp, Homo sapiens
  Payload ID: 1562
  Gene Symbol: ATP6V0E2
  Gene Name: ATPase, H+ transporting V0 subunit e2
  Uniprot ID: Q8NHE4
  ENST ID: ENST00000615196
  CDS Start-End: 952-1344
gttgctagagataccgcctggaggccactgatctgtaaaagggatctctacagaagatagggatttttgatcgccagagaagaagggatatgtgagatccaaacgccgaaggaggaaagcaggctccgtggtctcttccagccctgatggaagaaactaccgagccttattatactaggtgctttccacatgcctattcatttaatcctccagcaaccttgtaagaagggccatcccattttatatttaaacaaaccttaactactgacgcaaggagtcaaggatctaatcccaaagcctctgcctggttcgctgcagatggatgtccgcgaggacgccagccctccgcctcccgccgggtccctgaacgccggcccggccggtccaacctcattccgcttcccgccatcgaaacgcgaagcccccgccttcccccaaacgtctcagcgccgctggggcctttctggctgcgccgcctccgaccccaggccccggtccgcgcccgccgctcgctagtcctgggagtgaggagaacgcgtgctgaggacccggccagagggacagcggggaccgccctcccgctgcgtctctgaaagcgaggccgttcctcccgcgtccgacccccgcggggccgtcaggttcggggcggcccaggctgcgggtccgcagggcgcttcgggccgagccggcgcggcgcgtgaagggcaggggacgccccgaaagaccgctggggtgggaccccaagctccaggggtctttggaaataagaatgcggcgtgacgttggctgtgcgggcgcggggctgacgcggaccctataacccatcgccgaaaccgggcggccgcgcccctattcctcggcatttctctctgtccgcggccctgctcagccaatcagcgagtgggctcctaggcaggtcctgagtgacagcgcggcgggctggatcaggagatgcgcgtgcgcggcccggcccggctgatcgcttcgggtgctcgactcctgttgcgcatgctcagcgcgctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaagggacccaaccgcggagtgatcatcaccatgctggtcgccaccgccgtctgctgttacctcttctggctcatcgccatcctggcgcagctgaaccccctgttcgggccccagctgaagaatgagaccatctggtacgtgcgcttcctgtgggagtgacccgccgcccccgacccaggtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcagtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcttttggctgcagtgggggtggatttcagagcctctcatggcagcatctaagtgaccagagctgggatgagagaggggaaggggcaatgtgagtggcgctatgggacgggccagccctgctcctgagccagccccgccctctgccccctggccctgggctctgtgctagggatggtgaagaatgggggcgtgccagcctggcaggagtgggaagcaacacgcaggggtcccggacctctccagccttgccctcacgcttacccgagctcccagtgtggttagcacagagctcacccaccttgcctggctcccagctggggcctgtcctcactggtgctccaggggaagaaacgacagcctcacttctgtatggactgctgatgtggcctgccatcctgttcagcgggcattgtctttggagcagcaggagaataggatgcctctcactcacatgccagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatgaaaagatta

SEQ ID NO: 109834 - DNA, 2565 bp, Homo sapiens
  Payload ID: 1562
  Gene Symbol: ATP6V0E2
  Gene Name: ATPase, H+ transporting V0 subunit e2
  ENST ID: ENST00000611515
  CDS Start-End: 952-1593
gttgctagagataccgcctggaggccactgatctgtaaaagggatctctacagaagatagggatttttgatcgccagagaagaagggatatgtgagatccaaacgccgaaggaggaaagcaggctccgtggtctcttccagccctgatggaagaaactaccgagccttattatactaggtgctttccacatgcctattcatttaatcctccagcaaccttgtaagaagggccatcccattttatatttaaacaaaccttaactactgacgcaaggagtcaaggatctaatcccaaagcctctgcctggttcgctgcagatggatgtccgcgaggacgccagccctccgcctcccgccgggtccctgaacgccggcccggccggtccaacctcattccgcttcccgccatcgaaacgcgaagcccccgccttcccccaaacgtctcagcgccgctggggcctttctggctgcgccgcctccgaccccaggccccggtccgcgcccgccgctcgctagtcctgggagtgaggagaacgcgtgctgaggacccggccagagggacagcggggaccgccctcccgctgcgtctctgaaagcgaggccgttcctcccgcgtccgacccccgcggggccgtcaggttcggggcggcccaggctgcgggtccgcagggcgcttcgggccgagccggcgcggcgcgtgaagggcaggggacgccccgaaagaccgctggggtgggaccccaagctccaggggtctttggaaataagaatgcggcgtgacgttggctgtgcgggcgcggggctgacgcggaccctataacccatcgccgaaaccgggcggccgcgcccctattcctcggcatttctctctgtccgcggccctgctcagccaatcagcgagtgggctcctaggcaggtcctgagtgacagcgcggcgggctggatcaggagatgcgcgtgcgcggcccggcccggctgatcgcttcgggtgctcgactcctgttgcgcatgctcagcgcgctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaagggacccaaccgcggagtgatcatcaccatgctggtcgccaccgccgtctgctgttacctcttgtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcagtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcttttggctgcagtgggggtggatttcagagcctctcatggcagcatctaagtgaccagagctgggatgagagaggggaaggggcaatgtgagtggcgctatgggacgggccagccctgctcctgagccagccccgccctctgccccctggccctgggctctgtgctagggatggtgaagaatgggggcgtgccagcctggcaggagtgggaagcaacacgcaggggtcccggacctctccagccttgccctcacgcttacccgagctcccagtgtggttagcacagagctcacccaccttgcctggctcccagctggggcctgtcctcactggtgctccaggggaagaaacgacagcctcacttctgtatggactgctgatgtggcctgccatcctgttcagcgggcattgtctttggagcagcaggagaataggatgcctctcactcacatgccagttcctggctggccagctgctcagggctcaggctggggcctcccattgacatcctccccctacactccctctctgagcctccgtcgcccctcctgttgggtaagggtgttgagtgtgacttg

SEQ ID NO: 109835 - DNA, 1080 bp, Homo sapiens
  Payload ID: 1563
  Gene Symbol: ATP6V1G1
  Gene Name: ATPase, H+ transporting, lysosomal 13kDa, V1 subunit G1
  Uniprot ID: O75348
  ENST ID: ENST00000374050
  CDS Start-End: 94-450
gcaagcgcagattgtgggcggctgtgtcagctgacccaaggggccttcgaggtgccttaggccgcttgccttgctctcagaatcgctgccgccatggctagtcagtctcaggggattcagcagctgctgcaggccgagaagcgggcagccgagaaggtgtccgaggcccgcaaaagaaagaaccggaggctgaagcaggccaaagaagaagctcaggctgaaattgaacagtaccgcctgcagagggagaaagaattcaaggccaaggaagctgcggcattgggatcccgtggcagttgcagcactgaagtggagaaggagacccaggagaagatgaccatcctccagacatacttccggcagaacagggatgaagtcttggacaacctcttggcttttgtctgtgacattcggccagaaatccatgaaaactaccgcataaatggatagaagagagaagcacctgtgctgtggagtggcattttagatgccctcacgaatatgaagcttagcacagctctagttacattcttatgatatggcattaaattatttccatatattatataataggtccttccactttttggagagtagcaaatctagcttttttgtacagacttagaaattatctaaagatttcatctttttacctcatatttcttaggaatttaatggttatatgttgtctttttttcctatgtcttttggctcaagcaacatgtatatcagtgttgactttttctttcttagatctagtttaaaaaaaaaaaaaaccacataacaattctttgaagaaaggaagggattaaataatttttttccctaacactttcttgaaggtcaggggctttatctatgaaaaagtagtaaatagttctttgtaacctgtgtgaagcagcagccagccttaaagtagtccattcttgctaatggttagaacagtgaatactagtggaattgtttgggctgcttttagtttctcttaatcaaaattactagatgatagaattcaagaacttgttacatgtattacttggtgtatcgataatcatttaaaagtaaagactctgtcatgca

SEQ ID NO: 109836 - DNA, 1588 bp, Homo sapiens
  Payload ID: 1564
  Gene Symbol: ATP6V1G2
  Gene Name: ATPase, H+ transporting, lysosomal 13kDa, V1 subunit G2
  Uniprot ID: O95670
  ENST ID: ENST00000303892
  CDS Start-End: 286-642
cctgttgtaagcccgcagctttgggcctggtctctgctgctcccaggcggcccctttgggtactgcctgagcaagaagtgctggagaggaggaccagtcatcaataggaggatgagattgggagagacactcggtgcaggaggctgagtgagcaggggagcactaagacccaggggtagtggaggactgcagcaacgagctggaggaggagaagtaagcggtggggggtgggagccatctggtactttgacagcattcaaaacagcatcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcggccatgggctcccaggggaacctgtctgctgaggtggagcaggctacaaggcgccaggtgcagggcatgcagagctcccagcagagaaaccgagagcgtgtcctggcccagcttcttggcatggtctgcgacgtcaggccccaggtccaccccaactaccggatttctgcctagggccaccgtagggcctgactccttctgccagttccctccctcaaagaaatcctccaatcaaaatcacctcccaccataatccctgtcttctttccatcccctagaaatcctgggaggcaggatccaataattttcctgtgacacttataaatatcctgctcacatctgaatctccttgttgttctttaaccctcactgggactttgtaaacttccaagtcattctcacctaaaccctctgtgaaatttgtaatatggggaagtaggaatgtggaaaacatcctgacttcagtgtctggccgatgtgggtccctctcttgaccctgtcacttgctggctgtgaaaccaggacaagctacttaacttggtagcctcgatgtcctcctctgtgaaactgggatgataataatgcctaccttgtgagggttgcttcaatgattaggaatcattctgtaaagtctagcacagttccttgcatgttgtagcagtgattcagtaagtagcaaccctgtgatactattaccaccacctgctcactggtcaaaacctacacagctgtttcctcacgtccatcactggctctctaattccacttgttcattctgtgaccctagttattttctgaaaaattggttcttctcttttcccagagaccttctgatctccaaaaagaggagatgactacatttagcccctctcttataattccaggtagataactgcattttgtagcctctctttgtttttcttttgctgatctttgtctttattagattttcctcctttcctatttccccaaagacttatcagatgctcattgctttctaagatctaaaatgatactgtgttccctcatatgcatgcccttcctttctatatccttgacaccttactttcccattgtaacaataaaaaaagtatcaataaaataattattggcaaataaa

SEQ ID NO: 109837 - DNA, 1261 bp, Homo sapiens
  Payload ID: 1564
  Gene Symbol: ATP6V1G2
  Gene Name: ATPase, H+ transporting, lysosomal 13kDa, V1 subunit G2
  Uniprot ID: O95670
  ENST ID: ENST00000376151
  CDS Start-End: 79-315
ggagaagtaagcggtggggggtgggagccatctggtactttgacagcattcaaaacagcatcggccataacaacagaaatggccagtcagtcccaaggtatccagcagcttctgcaagctgagaagcgggcagctgagaaggtggcagatgccagaaagaggaaggcccggcgactgaagcaggctacaaggcgccaggtgcagggcatgcagagctcccagcagagaaaccgagagcgtgtcctggcccagcttcttggcatggtctgcgacgtcaggccccaggtccaccccaactaccggatttctgcctagggccaccgtagggcctgactccttctgccagttccctccctcaaagaaatcctccaatcaaaatcacctcccaccataatccctgtcttctttccatcccctagaaatcctgggaggcaggatccaataattttcctgtgacacttataaatatcctgctcacatctgaatctccttgttgttctttaaccctcactgggactttgtaaacttccaagtcattctcacctaaaccctctgtgaaatttgtaatatggggaagtaggaatgtggaaaacatcctgacttcagtgtctggccgatgtgggtccctctcttgaccctgtcacttgctggctgtgaaaccaggacaagctacttaacttggtagcctcgatgtcctcctctgtgaaactgggatgataataatgcctaccttgtgagggttgcttcaatgattaggaatcattctgtaaagtctagcacagttccttgcatgttgtagcagtgattcagtaagtagcaaccctgtgatactattaccaccacctgctcactggtcaaaacctacacagctgtttcctcacgtccatcactggctctctaattccacttgttcattctgtgaccctagttattttctgaaaaattggttcttctcttttcccagagaccttctgatctccaaaaagaggagatgactacatttagcccctctcttataattccaggtagataactgcattttgtagcctctctttgtttttcttttgctgatctttgtctttattagattttcctcctttcctatttccccaaagacttatcagatgctcattgctttctaagatctaaaatgatactgtgttccctcatatgcatgcccttcctttctatatccttgacaccttactttcccattgtaacaataaaaaaagtatcaataaaataattattggcaaataaa

SEQ ID NO: 109838 - DNA, 1351 bp, Homo sapiens
  Payload ID: 1564
  Gene Symbol: ATP6V1G2
  Gene Name: ATPase, H+ transporting, lysosomal 13kDa, V1 subunit G2
  Uniprot ID: O95670
  ENST ID: ENST00000383503
  CDS Start-End: 49-405
tctggtactttgacagcattcaaaacagcatcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcggccatgggctcccaggggaacctgtctgctgaggtggagcaggctacaaggcgccaggtgcagggcatgcagagctcccagcagagaaaccgagagcgtgtcctggcccagcttcttggcatggtctgcgacgtcaggccccaggtccaccccaactaccggatttctgcctagggccaccgtagggcctgactccttctgccagttccctccctcaaagaaatcctccaatcaaaatcacctcccaccataatccctgtcttctttccatcccctagaaatcctgggaggcaggatccaataattttcctgtgacacttataaatatcctgctcacatctgaatctccttgttgttctttaaccctcactgggactttgtaaacttccaagtcattctcacctaaaccctctgtgaaatttgtaatatggggaagtaggaatgtggaaaacatcctgacttcagtgtctggccgatgtgggtccctctcttgaccctgtcacttgctggctgtgaaaccaggacaagctacttaacttggtagcctcgatgtcctcctctgtgaaactgggatgataataatgcctaccttgtgagggttgcttcaatgattaggaatcattctgtaaagtctagcacagttccttgcatgttgtagcagtgattcagtaagtagcaaccctgtgatactattaccaccacctgctcactggtcaaaacctacacagctgtttcctcacgtccatcactggctctctaattccacttgttcattctgtgaccctagttattttctgaaaaattggttcttctcttttcccagagaccttctgatctccaaaaagaggagatgactacatttagcccctctcttataattccaggtagataactgcattttgtagcctctctttgtttttcttttgctgatctttgtctttattagattttcctcctttcctatttccccaaagacttatcagatgctcattgctttctaagatctaaaatgatactgtgttccctcatatgcatgcccttcctttctatatccttgacaccttactttcccattgtaacaataaaaaaagtatcaataaaataattattggcaaataaa

SEQ ID NO: 109839 - DNA, 609 bp, Homo sapiens
  Payload ID: 1564
  Gene Symbol: ATP6V1G2
  Gene Name: ATPase, H+ transporting, lysosomal 13kDa, V1 subunit G2
  ENST ID: ENST00000415099
  CDS Start-End: 1-477
ggcgggcagcagcatgcagtgccgtgtccccatggcggtcctggtgggcagggtcagccccgagccgaagcagcaggcacagggcaggggcatcgtggcgggcacaggcccggtgcagtggtgggggctgcccagcatctacatcgaggcctgggtgtcgctggaggagggcctgggcccggaccagccgtcctgcagacaaggaaggcccggcgactgaagcaggcaaaggaggaggcacagatggaggtggagcaataccgcagagagcgagagcacgaattccagagcaagcagcaggcggccatgggctcccaggggaacctgtctgctgaggtggagcaggctacaaggcgccaggtgcagggcatgcagagctcccagcagagaaaccgagagcgtgtcctggcccagcttcttggcatggtctgcgacgtcaggccccaggtccaccccaactaccggatttctgcctagggccaccgtagggcctgactccttctgccagttccctccctcaaagaaatcctccaatcaaaatcacctcccaccataatccctgtcttctttccatcccctagaaatcctgggaggcaggatccaataatt

SEQ ID NO: 109840 - DNA, 1351 bp, Homo sapiens
  Payload ID: 1564
  Gene Symbol: ATP6V1G2
  Gene Name: ATPase, H+ transporting, lysosomal 13kDa, V1 subunit G2
  Uniprot ID: O95670
  ENST ID: ENST00000441959
  CDS Start-End: 49-405
tctggtactttgacagcattcaaaacagcatcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcggccatgggctcccaggggaacctgtctgctgaggtggagcaggctacaaggcgccaggtgcagggcatgcagagctcccagcagagaaaccgagagcgtgtcctggcccagcttcttggcatggtctgcgacgtcaggccccaggtccaccccaactaccggatttctgcctagggccaccgtagggcctgactccttctgccagttccctccctcaaagaaatcctccaatcaaaatcacctcccaccataatccctgtcttctttccatcccctagaaatcctgggaggcaggatccaataattttcctgtgacacttataaatatcctgctcacatctgaatctccttgttgttctttaaccctcactgggactttgtaaacttccaagtcattctcacctaaaccctctgtgaaatttgtaatatggggaagtaggaatgtggaaaacatcctgacttcagtgtctggccgatgtgggtccctctcttgaccctgtcacttgctggctgtgaaaccaggacaagctacttaacttggtagcctcgatgtcctcctctgtgaaactgggatgataataatgcctaccttgtgagggttgcttcaatgattaggaatcattctgtaaagtctagcagagttccttgcatgttgtagcagtgattcagtaagtagcaaccctgtgatactattaccaccacctgctcactggtcaaaacctacacagctgtttcctcacgtccatcactggctctctaattccacttgttcattctgtgaccctagttattttctgaaaaattggttcttctcttttcccagagaccttctgatctccaaaaagaggagatgactacatttagcccctctcttataattccaggtagataactgcattttgtagcctctctttgtttttcttttgctgatctttgtctttattagattttcctcctttcctatttccccaaagacttatcagatgctcattgctttctaagatctaaaatgatactgtgttccctcatatgcatgcccttcctttctatatccttgacaccttactttcccattgtaacaataaaaaaagtatcaataaaataattattggcaaataaa

SEQ ID NO: 109841 - DNA, 1261 bp, Homo sapiens; identical to SEQ ID NO: 109837
  Payload ID: 1564
  Gene Symbol: ATP6V1G2
  Gene Name: ATPase, H+ transporting, lysosomal 13kDa, V1 subunit G2
  Uniprot ID: O95670
  ENST ID: ENST00000452453
  CDS Start-End: 79-315

SEQ ID NO: 109842 - DNA, 1261 bp, Homo sapiens; identical to SEQ ID NO: 109837
  Payload ID: 1564
  Gene Symbol: ATP6V1G2
  Gene Name: ATPase, H+ transporting, lysosomal 13kDa, V1 subunit G2
  Uniprot ID: O95670
  ENST ID: ENST00000447174
  CDS Start-End: 79-315

SEQ ID NO: 109843 - DNA, 1351 bp, Homo sapiens; identical to SEQ ID NO: 109838
  Payload ID: 1564
  Gene Symbol: ATP6V1G2
  Gene Name: ATPase, H+ transporting, lysosomal 13kDa, V1 subunit G2
  Uniprot ID: O95670
  ENST ID: ENST00000449748
  CDS Start-End: 49-405

SEQ ID NO: 109844 - DNA, 1351 bp, Homo sapiens; identical to SEQ ID NO: 109838
  Payload ID: 1564
  Gene Symbol: ATP6V1G2
  Gene Name: ATPase, H+ transporting, lysosomal 13kDa, V1 subunit G2
  Uniprot ID: O95670
  ENST ID: ENST00000444088
  CDS Start-End: 49-405

SEQ ID NO: 109845 - DNA, 1261 bp, Homo sapiens; identical to SEQ ID NO: 109837
  Payload ID: 1564
  Gene Symbol: ATP6V1G2
  Gene Name: ATPase, H+ transporting, lysosomal 13kDa, V1 subunit G2
  Uniprot ID: O95670
  ENST ID: ENST00000421596
  CDS Start-End: 79-315

SEQ ID NO: 109846 - DNA, 1261 bp, Homo sapiens; identical to SEQ ID NO: 109837
  Payload ID: 1564
  Gene Symbol: ATP6V1G2
  Gene Name: ATPase, H+ transporting, lysosomal 13kDa, V1 subunit G2
  Uniprot ID: O95670
  ENST ID: ENST00000434217
  CDS Start-End: 79-315

SEQ ID NO: 109847 - DNA, 1351 bp, Homo sapiens; identical to SEQ ID NO: 109838
  Payload ID: 1564
  Gene Symbol: ATP6V1G2
  Gene Name: ATPase, H+ transporting, lysosomal 13kDa, V1 subunit G2
  Uniprot ID: O95670
  ENST ID: ENST00000454889
  CDS Start-End: 49-405

SEQ ID NO: 109848 - DNA, 1261 bp, Homo sapiens; identical to SEQ ID NO: 109837
  Payload ID: 1564
  Gene Symbol: ATP6V1G2
  Gene Name: ATPase, H+ transporting, lysosomal 13kDa, V1 subunit G2
  Uniprot ID: O95670
  ENST ID: ENST00000448779
  CDS Start-End: 79-315

SEQ ID NO: 109849 - DNA, 1351 bp, Homo sapiens; identical to SEQ ID NO: 109838
  Payload ID: 1564
  Gene Symbol: ATP6V1G2
  Gene Name: ATPase, H+ transporting, lysosomal 13kDa, V1 subunit G2
  Uniprot ID: O95670
  ENST ID: ENST00000454370
  CDS Start-End: 49-405

SEQ ID NO: 109850 - DNA, 1261 bp, Homo sapiens
  Payload ID: 1564
  Gene Symbol: ATP6V1G2
  Gene Name: ATPase, H+ transporting, lysosomal 13kDa, V1 subunit G2
  Uniprot ID: O95670
  ENST ID: ENST00000443657
  CDS Start-End: 79-315
ggagaagtaagcggtggggggtgggagccatctggtactttgacagcattcaaaacagcatcggccataacaacagaaatggccagtcagtcccaaggtatccagcagcttctgcaagctgagaagcgggcagctgagaaggtggcagatgccagaaagaggaaggcccggcgactgaagcaggctacaaggcgccaggtgcagggcatgcagagctcccagcagagaaaccgagagcgtgtcctggcccagcttcttggcatggtctgcgacgtcaggccccaggtccaccccaactaccggatttctgcctagggccaccgtagggcctgactccttctgccagttccctccctcaaagaaatcctccaatcaaaatcacctcccaccataatccctgtcttctttccatcccctagaaatcctgggaggcaggatccaataattttcctgtgacacttataaatatcctgctcacatctgaatctccttgttgttctttaaccctcactgggactttgtaaacttccaagtcattctcacctaaaccctctgtgaaatttgtaatatggggaagtaggaatgtggaaaacatcctgacttcagtgtctggccgatgtgggtccctctcttgaccctgtcacttgctggctgtgaaaccaggacaagctacttaacttggtagcctcgatgtcctcctctgtgaaactgggatgataataatgcctaccttgtgagggttgcttcaatgattaggaatcattctgtaaagtctagcagagttccttgcatgttgtagcagtgattcagtaagtagcaaccctgtgatactattaccaccacctgctcactggtcaaaacctacacagctgtttcctcacgtccatcactggctctctaattccacttgttcattctgtgaccctagttattttctgaaaaattggttcttctcttttcccagagaccttctgatctccaaaaagaggagatgactacatttagcccctctcttataattccaggtagataactgcattttgtagcctctctttgtttttcttttgctgatctttgtctttattagattttcctcctttcctatttccccaaagacttatcagatgctcattgctttctaagatctaaaatgatactgtgttccctcatatgcatgcccttcctttctatatccttgacaccttactttcccattgtaacaataaaaaaagtatcaataaaataattattggcaaataaa

SEQ ID NO: 109851 - DNA, 662 bp, Homo sapiens
  Payload ID: 1564
  Gene Symbol: ATP6V1G2
  Gene Name: ATPase, H+ transporting, lysosomal 13kDa, V1 subunit G2
  Uniprot ID: O95670
  ENST ID: ENST00000483251
  CDS Start-End: 259-492
ctaacctgttgtaagcccgcagctttgggcctggtctctgctgctcccaggcggcccctttgggtactgcctgagcaagaagtgctggagaggaggaccagtcatcaataggaggatgagattgggagagacactcggtgcaggaggctgagtgagcaggggagcactaagacccaggggtagtggaggactgcagcaacgagctggaggaggagaaggaaggcccggcgactgaagcaggcaaaggaggaggcacagatggaggtggagcaataccgcagagagcgagagcacgaattccagagcaagcagcaggcggccatgggctcccaggggaacctgtctgctgaggtggagcaggctacaaggcgccaggtgcagggcatgcagagctcccagcagagaaaccgagagcgtgtcctggcccagcttcttggcatggtctgcgacgtcaggccccaggtccaccccaactaccggatttctgcctagggccaccgtagggcctgactccttctgccagttccctccctcaaagaaatcctccaatcaaaatcacctcccaccataatccctgtcttctttccatcccctagaaatcctgggaggcaggatccaataattttcctgtgacacttataaatatcctgctcacatctgaa

SEQ ID NO: 109852 - DNA, 630 bp, Homo sapiens
  Payload ID: 1565
  Gene Symbol: ATP6V1G3
  Gene Name: ATPase, H+ transporting, lysosomal 13kDa, V1 subunit G3
  Uniprot ID: Q96LB4
  ENST ID: ENST00000281087
  CDS Start-End: 107-463
tttataagtagatgcaacacctcatttatacctccttatctcatacagaagagctaagattggcagaaatgatttcacagaagccacttgcttggagcagactaccatgacaagccagtctcaggggatccaccagcttcttcaggcagaaaaacgggccaaggacaagctagaggaagccaagaagagaaaaggaaagcgattgaagcaagccaaggaggaagcaatggtagaaattgaccagtacagaatgcagagagataaagagtttcgactaaaacaatctaagataatgggctctcagaataatctctcagatgaaatagaagaacaaacactagggaagatacaagaacttaatggacactacaataagtatatggaaagtgtgatgaaccagctcttgagcatggtctgtgacatgaaaccagaaatccatgtgaactacagagccaccaactaaatgtacatcacagttttcaagaaaaaaaaaggtgtgtgagtgccacctggttgcttatggcttcgtatttttatgttgagaaatttgaaatgagaaccttaaatttacatttacaggaaatgtgacataactcatacatcggcactgaattaaacaaaacaaaatac

SEQ ID NO: 109853 - DNA, 678 bp, Homo sapiens
  Payload ID: 1565
  Gene Symbol: ATP6V1G3
  Gene Name: ATPase, H+ transporting, lysosomal 13kDa, V1 subunit G3
  Uniprot ID: Q96LB4
  ENST ID: ENST00000309309
  CDS Start-End: 107-286
tttataagtagatgcaacacctcatttatacctccttatctcatacagaagagctaagattggcagaaatgatttcacagaagccacttgcttggagcagactaccatgacaagccagtctcaggggatccaccagcttcttcaggcagaaaaacgggccaaggacaagctagaggaagccaagaagattctgcatctacttttcctaaaacgaagagactgggactgcttctggaaaaggaaagcgattgaagcaagccaaggaggaagcaatggtagaaattgaccagtacagaatgcagagagataaagagtttcgactaaaacaatctaagataatgggctctcagaataatctctcagatgaaatagaagaacaaacactagggaagatacaagaacttaatggacactacaataagtatatggaaagtgtgatgaaccagctcttgagcatggtctgtgacatgaaaccagaaatccatgtgaactacagagccaccaactaaatgtacatcacagttttcaagaaaaaaaaaggtgtgtgagtgccacctggttgcttatggcttcgtatttttatgttgagaaatttgaaatgagaaccttaaatttacatttacaggaaatgtgacataactcatacatcggcactgaattaaacaaaacaaaatacaa

SEQ ID NO: 109854 - DNA, 630 bp, Homo sapiens; identical to SEQ ID NO: 109852
  Payload ID: 1565
  Gene Symbol: ATP6V1G3
  Gene Name: ATPase, H+ transporting, lysosomal 13kDa, V1 subunit G3
  Uniprot ID: Q96LB4
  ENST ID: ENST00000367381
  CDS Start-End: 107-463

SEQ ID NO: 109855 - DNA, 611 bp, Homo sapiens
  Payload ID: 1565
  Gene Symbol: ATP6V1G3
  Gene Name: ATPase, H+ transporting, lysosomal 13kDa, V1 subunit G3
  Uniprot ID: Q96LB4
  ENST ID: ENST00000367382
  CDS Start-End: 86-442
tgagttatatgttaatttctaaaagaataaatgaacccattacttcccagatttcacagaagccacttgcttggagcagactaccatgacaagccagtctcaggggatccaccagcttcttcaggcagaaaaacgggccaaggacaagctagaggaagccaagaagagaaaaggaaagcgattgaagcaagccaaggaggaagcaatggtagaaattgaccagtacagaatgcagagagataaagagtttcgactaaaacaatctaagataatgggctctcagaataatctctcagatgaaatagaagaacaaacactagggaagatacaagaacttaatggacactacaataagtatatggaaagtgtgatgaaccagctcttgagcatggtctgtgacatgaaaccagaaatccatgtgaactacagagccaccaactaaatgtacatcacagttttcaagaaaaaaaaaggtgtgtgagtgccacctggttgcttatggcttcgtatttttatgttgagaaatttgaaatgagaaccttaaatttacatttacaggaaatgtgacataactcatacatcggcactgaattaaacaaaacaaaatacaa

SEQ ID NO: 109856 - DNA, 449 bp, Homo sapiens
  Payload ID: 1565
  Gene Symbol: ATP6V1G3
  Gene Name: ATPase, H+ transporting, lysosomal 13kDa, V1 subunit G3
  Uniprot ID: Q96LB4
  ENST ID: ENST00000489986
  CDS Start-End: 25-399
gccacttgcttggagcagactaccatgacaagccagtctcaggggatccaccagcttcttcaggcagaaaaacgggccaaggacaagctagaggaagccaagaagaagactgggactgcttctggaaaaggaaagcgattgaagcaagccaaggaggaagcaatggtagaaattgaccagtacagaatgcagagagataaagagtttcgactaaaacaatctaagataatgggctctcagaataatctctcagatgaaatagaagaacaaacactagggaagatacaagaacttaatggacactacaataagtatatggaaagtgtgatgaaccagctcttgagcatggtctgtgacatgaaaccagaaatccatgtgaactacagagccaccaactaaatgtacatcacagttttcaagaaaaaaaaaggtgtgtgagtgccacctgg

SEQ ID NO: 109857 - DNA, 449 bp, Homo sapiens; identical to SEQ ID NO: 109856
  Payload ID: 1565
  Gene Symbol: ATP6V1G3
  Gene Name: ATPase, H+ transporting, lysosomal 13kDa, V1 subunit G3
  Uniprot ID: Q96LB4
  ENST ID: ENST00000575971
  CDS Start-End: 25-399

SEQ ID NO: 109858 - DNA, 611 bp, Homo sapiens; identical to SEQ ID NO: 109855
  Payload ID: 1565
  Gene Symbol: ATP6V1G3
  Gene Name: ATPase, H+ transporting, lysosomal 13kDa, V1 subunit G3
  Uniprot ID: Q96LB4
  ENST ID: ENST00000573121
  CDS Start-End: 86-442

SEQ ID NO: 109859 - DNA, 678 bp, Homo sapiens; identical to SEQ ID NO: 109853
  Payload ID: 1565
  Gene Symbol: ATP6V1G3
  Gene Name: ATPase, H+ transporting, lysosomal 13kDa, V1 subunit G3
  Uniprot ID: Q96LB4
  ENST ID: ENST00000571439
  CDS Start-End: 107-286

SEQ ID NO: 109860 - DNA, 704 bp, Homo sapiens
  Payload ID: 1566
  Gene Symbol: ATP6V1F
  Gene Name: ATPase, H+ transporting, lysosomal 14kDa, V1 subunit F
  Uniprot ID: Q16864
  ENST ID: ENST00000249289
  CDS Start-End: 80-439
gccgacggggcgccgtacggcggaggcggggtttcagtggcttctggtgctctagggtgagctctgcccggctgcagggatggcggggaggggtaagctcatcgcagtgatcggagacgaggacacggtgactggtttcctgctgggcggcataggggagcttaacaagaaccgccatcccaatttcctggtggtggagaaggatacaaccatcaatgagatcgaagacactttccggcaatttctaaaccgggatgacattggcatcatcctcatcaaccagtacatcgcagagatggtgcggcatgccctggacgcccaccagcagtccatccccgctgtcctggagatcccctccaaggagcacccatatgacgccgccaaggactccatcctgcgcagggccaggggcatgttcactgccgaagacctgcgctaggggactcctcatagccctcagcccttccctcgtttccaggcctctccccaggcttgccatcagccttctttactttttgagcctctgatttccaattccctgctccttcccactccattaagaggctaggtgaggcgcttctaggttgctggggctctgctggttaaggaacaggaagcctgaccatctccctccactacctcttccctgtgctgttacacagtgtcattgttgatgttaaattaaagtcatattcttgcttctc

SEQ ID NO: 109861 - DNA, 711 bp, Homo sapiens
  Payload ID: 1566
  Gene Symbol: ATP6V1F
  Gene Name: ATPase, H+ transporting, lysosomal 14kDa, V1 subunit F
  Uniprot ID: Q16864
  ENST ID: ENST00000492758
  CDS Start-End: 2-445
gatggcggggaggggtaagctcatcgcagtgatcggagacgaggacacggtgactggtttcctgctgggcggcataggggagcttaacaagaaccgccatcccaatttcctggtggtggagaaggatacaaccatcaatgagatcgaagacactttccgttcacttggaagccttccgggcagtgttgtagaagccaaccctaatcagcgtgaccctccgctttgggatgaaattgattctaggcaatttctaaaccgggatgacattggcatcatcctcatcaaccagtacatcgcagagatggtgcggcatgccctggacgcccaccagcagtccatccccgctgtcctggagatcccctccaaggagcacccatatgacgccgccaaggactccatcctgcgcagggccaggggcatgttcactgccgaagacctgcgctaggggactcctcatagccctcagcccttccctcgtttccaggcctctccccaggcttgccatcagccttctttactttttgagcctctgatttccaattccctgctccttcccactccattaagaggctaggtgaggcgcttctaggttgctggggctctgctggttaaggaacaggaagcctgaccatctccctccactacctcttccctgtgctgttacacagtgtcattgttgatgttaaattaaagtcatattcttgcttctct

SEQ ID NO: 109862 - DNA, 1175 bp, Homo sapiens
  Payload ID: 1567
  Gene Symbol: ATP6V0C
  Gene Name: ATPase, H+ transporting, lysosomal 16kDa, V0 subunit c
  Uniprot ID: P27449
  ENST ID: ENST00000330398
  CDS Start-End: 235-702
acgcgtctcccccacggtgcgaagtggtacggctcgcaggggcggggcccaggtcatgtgacgcggccgcggccgccattttgttctgcggtgctggtatttagagcgcagcggctgacgggccggatcgccttcgccgccgcccgcccgcaaaccttcgtgcccggcccgtcctcgcccccgcctccgccaccgcctcggcccgcagagcttgccccctccccacccgcagacatgtccgagtccaagagcggccccgagtatgcttcgtttttcgccgtcatgggcgcctcggccgccatggtcttcagcgccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 109863 - DNA, 477 bp, Homo sapiens
  Payload ID: 1567
  Gene Symbol: ATP6V0C
  Gene Name: ATPase, H+ transporting, lysosomal 16kDa, V0 subunit c
  ENST ID: ENST00000568562
  CDS Start-End: 129-320
cgcagcggctgacgggccggatcgccttcgccgccgcccgcccgcaaaccttcgtgcccggcccgtcctcgcccccgcctccgccaccgcctcggcccgcagagcttgccccctccccacccgcagacatgtccgagtccaagagcggccccgaccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgatt

SEQ ID NO: 109864 - DNA, 1081 bp, Homo sapiens
  Payload ID: 1567
  Gene Symbol: ATP6V0C
  Gene Name: ATPase, H+ transporting, lysosomal 16kDa, V0 subunit c
  ENST ID: ENST00000564973
  CDS Start-End: 270-608
cacgtagaggaaggaggagtggctgtcctggcctccttttgcttgcccgtggctgttcctcctgggtcctcttgccctgggctggatgccttcttcggctccccctctgcatgtgataacttggggtggcccttggagctgtgccaaagctacacctcggggtcctagtctcaactggcctgcgtactgctgtgggctcaccccgccttcctcccacagccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 109865 - DNA, 668 bp, Homo sapiens
  Payload ID: 1567
  Gene Symbol: ATP6V0C
  Gene Name: ATPase, H+ transporting, lysosomal 16kDa, V0 subunit c
  ENST ID: ENST00000565223
  CDS Start-End: 155-493
ggggcgcccgggcctcgtgtgacagcgggcgggggtcggcgccccgagggctgcggggagccgccgggggtccggggcgcagggcgtgcgggcctggccggggtccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccg

SEQ ID NO: 109866 - DNA, 944 bp, Homo sapiens
  Payload ID: 1568
  Gene Symbol: ATP6V0B
  Gene Name: ATPase, H+ transporting, lysosomal 21kDa, V0 subunit b
  Uniprot ID: Q99437
  ENST ID: ENST00000236067
  CDS Start-End: 186-662
gggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtct

SEQ ID NO: 109867 - DNA, 419 bp, Homo sapiens
  Payload ID: 1568
  Gene Symbol: ATP6V0B
  Gene Name: ATPase, H+ transporting, lysosomal 21kDa, V0 subunit b
  ENST ID: ENST00000498208
  CDS Start-End: 1-265
ggccgtgggtgaggccgggtcctggcgggcgggagcagcatcgcggccgagctggccgggtcggaactcggcggggaagtggcctgcggggaatactggccccccgcgcgctctgcacccgaggctctggggacttgcgcctgcgagggcctctgactccgacaaaggagacccggatttccagctgcttgaggaggggtgcgggcgggagtctgctacaccatttttgatttgggcttccgctttgatgtggcatggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcag

SEQ ID NO: 109868 - DNA, 1298 bp, Homo sapiens
  Payload ID: 1568
  Gene Symbol: ATP6V0B
  Gene Name: ATPase, H+ transporting, lysosomal 21kDa, V0 subunit b
  Uniprot ID: Q99437
  ENST ID: ENST00000472174
  CDS Start-End: 394-1011
acaggctaggacgcacggctgccagagaggacgccttaggggcccgcgagcaggctcgggaataaaacagggctggcagggcgaggtggagagactcgagaaggaccggccagatgtcgaagttcctagagaggagggcgcccaagcctccgccgagacgcgtgactacaactaccacaatccccagcgcctgcggttccagcgtcgccttgctctagacgggcggcggcgctgcgcggggaaccggcgtggggtcacgtggtaccggcgcatcacgtgggcgagttaggtgacgctgcggggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggagtctgctacaccatttttgatttgggcttccgctttgatgtggcatggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctgggtc

SEQ ID NO: 109869 - DNA, 865 bp, Homo sapiens
  Payload ID: 1568
  Gene Symbol: ATP6V0B
  Gene Name: ATPase, H+ transporting, lysosomal 21kDa, V0 subunit b
  ENST ID: ENST00000471859
  CDS Start-End: 91-849
cgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggtgaggccgggtcctggcgggcgggagcagcatcgcggccgagctggccgggtcggaactcggcggggaagtggcctgcggggaatactggccccccgcgcgctctgcacccgaggctctggggacttgcgcctgcgagggcctctgactccgacaaaggagacccggatttccagctgcttgaggaggggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcagacctccagagtgaagatgggtgactagatgatatgtgtgggtg

SEQ ID NO: 109870 - DNA, 411 bp, Homo sapiens
  Payload ID: 1568
  Gene Symbol: ATP6V0B
  Gene Name: ATPase, H+ transporting, lysosomal 21kDa, V0 subunit b
  ENST ID: ENST00000472505
  CDS Start-End: 154-411
acgcgcttccctgccactgggttagggaaggcttgccggaaggacgatttcggaggacagcaggtgttagccaggcagcggagcgagcgccaacaggcgcactggggcggagagacgccgtgagcaaggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgca

SEQ ID NO: 109871 - DNA, 825 bp, Homo sapiens
  Payload ID: 1568
  Gene Symbol: ATP6V0B
  Gene Name: ATPase, H+ transporting, lysosomal 21kDa, V0 subunit b
  Uniprot ID: Q99437
  ENST ID: ENST00000498664
  CDS Start-End: 61-537
gagctgaactgctttcttctctgcttccacaacaggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtcccccacctccaccctcaacccatcttcctagtgtttgtgaaataaacttggtatttgtctgggtca

SEQ ID NO: 109872 - DNA, 1685 bp, Homo sapiens
  Payload ID: 1568
  Gene Symbol: ATP6V0B
  Gene Name: ATPase, H+ transporting, lysosomal 21kDa, V0 subunit b
  ENST ID: ENST00000532642
  CDS Start-End: 98-883
tgcggggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggagtctgctacaccatttttgatttgggcttccgctttgatgtggcatggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcatcatcatggcaattgtcattagcaacatggctgagcctttcagtgccacagaccccaaggccatcggccatcggaactaccatgcaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcaggtgatgaatccccttgggaagcctctgtgtccttgtccccaacctagccttaccctccttctggagaagctgaagtgctctccttctctacctataactatagattcccccaaacagcttccacctcctcatttccatcttctggttttctcctacaggggctctctatttttgtctctgatttggtgtcactgacaacagccctgttctttttcccccctttctaatgcgttgtatctgtatagcacttagtcctccctctttctgttctctcattttatctgccatgcttttcatgtctccagtctgtatttgtgatctagactagaatggaattttgtctgtctatatcagtctgtcatggtgtgtttgactgtctctcggagctatgtgtatctccctctcacatgcctgtcagtaggacaccattgtctaaattgtgtgtgtctagtctgtctgacagtgtgtgagtttgtgactaaggatcagcctgagggtctgagtgtgactgtgggtgcttgactgagttgattcttagtgactagctttatccatatgccacttctctccgtctgtcccacagcgtaactctgtggttgtctgtccctgtctgccttgtctgtcacagtgtgtccatcctggttagtcatatatctcttgtggtctgtccatccaaccatgtgctagatgtcatcttctatcatttgtcactgccttacctattcctctgtccctgcctgatttctcctgttctttttttgcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgca

SEQ ID NO: 109873 - DNA, 530 bp, Homo sapiens
  Payload ID: 1568
  Gene Symbol: ATP6V0B
  Gene Name: ATPase, H+ transporting, lysosomal 21kDa, V0 subunit b
  ENST ID: ENST00000461670
  CDS Start-End: 82-222
agactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtggctgtactgtcacctgggggcagcctgaggacgccccttcagggaggtggcccttcagctcggcagctactttaggttgaagaacttctctctaccgagcagcccgtaaccccctttttctccctcactgctgcaggagtctgctacaccatttttgatttgggcttccgctttgatgtggcatggttcctgacggagacttcgcccttcatgtggtccaacctgggcattggcctagctatctccctgtctgtggttggggcagcctggggcatctatattaccggctcctccatcattggtggaggagtgaaggcccccaggatcaagaccaagaacctggtcagcatcatcttctgtgaggctgtggccatctacggcat

SEQ ID NO: 109874 - DNA, 1402 bp, Homo sapiens
  Payload ID: 1569
  Gene Symbol: ATP6V1E1
  Gene Name: ATPase, H+ transporting, lysosomal 31kDa, V1 subunit E1
  Uniprot ID: P36543
  ENST ID: ENST00000253413
  CDS Start-End: 184-864
tcccattggctgagaagggtcatgaggatgaactgtgcagtcacctggcaggaaccggaacccgcggttataaagtaaaggaacccgagatctgcgcaggggttccctttgccgatttctctcacctcacctttcaaacctaaactcgagcctactgttcaccggcctagcattgctctcgccatggctctcagcgatgctgacgtgcaaaagcagataaagcatatgatggctttcattgaacaagaagccaatgagaaagcagaagaaatagatgcaaaggcagaagaagagttcaacatagagaaaggtcggcttgtgcaaacccaaagactaaagattatggaatattatgagaagaaagagaaacagattgagcagcagaagaaaattcagatgtccaatttgatgaatcaagcgagactcaaagtcctcagagcaagagatgaccttatcacagacctactaaatgaagcaaaacagagactcagcaaggtggtaaaagatacaaccaggtaccaagtgctgctggatggactggttctccagggtttgtaccagttgctggagccccgaatgattgttcgttgcaggaaacaagatttccctctggtaaaggctgcagtgcagaaggcaattcctatgtacaaaattgccaccaaaaacgatgttgatgtccaaattgaccaggagtcctacctgcctgaagacatagctggtggagttgagatctataatggagatcgtaaaataaaggtttccaacaccctggaaagccggctggatctcatagcccagcagatgatgccagaagtccggggagccttgtttggtgcaaatgccaacaggaagtttttggactaagccttcaggaggtggagctcgtcgtcagctctcctgctgtgatgtggaagcttctgatatttgaagaaacacgaatgtctctgtagcttcctcttcactgccccagtattgctctgtatttatcagcgatgcccctctgtcactcatgccttgcctaattgttcacaatggtggaaagcttcatgtaatatgatcaggacccacctccagttcttctgaaagtgtgacagtgtccagccggttctgcagcactaggggagggggcagatggtggttgcatgggcttcctgggtctccactctccgtctggcctaaaggtgatgtatttggtgtttggccctgcagtccccactcttgaggcttaaggcgcatgtggcacaccactccttccagcagtagtcgctttactgttacctgtttaggcctagaagttttccctcatctgtaaatgtgatttaaaatctaagccatgaatatgctttatttattaaaagagttatgcggatttaatgtgatttctagtgtaaggcactacaaa

SEQ ID NO: 109875 - DNA, 1208 bp, Homo sapiens
  Payload ID: 1569
  Gene Symbol: ATP6V1E1
  Gene Name: ATPase, H+ transporting, lysosomal 31kDa, V1 subunit E1
  Uniprot ID: P36543
  ENST ID: ENST00000399796
  CDS Start-End: 113-703
aaagtaaaggaacccgagatctgcgcaggggttccctttgccgatttctctcacctcacctttcaaacctaaactcgagcctactgttcaccggcctagcattgctctcgccatggctctcagcgatgctgacgtgcaaaagcagataaagcatatgatggctttcattgaacaagaagccaatgagaaagcagaagaaatagatgcaaaggcagaagaagagttcaacatagagaaaggtcggcttgtgcaaacccaaagactaaagattatggaatattatgagaagaaagagaaacagattgagcagcagaagaaaattcagatgtccaatttgatgaatcaagcgagactcaaagtcctcagagcaagagatgaccttatcacaggtttgtaccagttgctggagccccgaatgattgttcgttgcaggaaacaagatttccctctggtaaaggctgcagtgcagaaggcaattcctatgtacaaaattgccaccaaaaacgatgttgatgtccaaattgaccaggagtcctacctgcctgaagacatagctggtggagttgagatctataatggagatcgtaaaataaaggtttccaacaccctggaaagccggctggatctcatagcccagcagatgatgccagaagtccggggagccttgtttggtgcaaatgccaacaggaagtttttggactaagccttcaggaggtggagctcgtcgtcagctctcctgctgtgatgtggaagcttctgatatttgaagaaacacgaatgtctctgtagcttcctcttcactgccccagtattgctctgtatttatcagcgatgcccctctgtcactcatgccttgcctaattgttcacaatggtggaaagcttcatgtaatatgatcaggacccacctccagttcttctgaaagtgtgacagtgtccagccggttctgcagcactaggggagggggcagatggtggttgcatgggcttcctgggtctccactctccgtctggcctaaaggtgatgtatttggtgtttggccctgcagtccccactcttgaggcttaaggcgcatgtggcacaccactccttccagcagtagtcgctttactgttacctgtttaggcctagaagttttccctcatctgtaaatgtgatttaaaatctaagccatgaatatgctttatttattaaaagagttatgcgga

SEQ ID NO: 109876 - DNA, 994 bp, Homo sapiens
  Payload ID: 1569
  Gene Symbol: ATP6V1E1
  Gene Name: ATPase, H+ transporting, lysosomal 31kDa, V1 subunit E1
  Uniprot ID: P36543
  ENST ID: ENST00000399798
  CDS Start-End: 115-729
ataaagtaaaggaacccgagatctgcgcaggggttccctttgccgatttctctcacctcacctttcaaacctaaactcgagcctactgttcaccggcctagcattgctctcgccatggctctcagcgatgctgacgtgcaaaagcaggcagaagaagagttcaacatagagaaaggtcggcttgtgcaaacccaaagactaaagattatggaatattatgagaagaaagagaaacagattgagcagcagaagaaaattcagatgtccaatttgatgaatcaagcgagactcaaagtcctcagagcaagagatgaccttatcacagacctactaaatgaagcaaaacagagactcagcaaggtggtaaaagatacaaccaggtaccaagtgctgctggatggactggttctccagggtttgtaccagttgctggagccccgaatgattgttcgttgcaggaaacaagatttccctctggtaaaggctgcagtgcagaaggcaattcctatgtacaaaattgccaccaaaaacgatgttgatgtccaaattgaccaggagtcctacctgcctgaagacatagctggtggagttgagatctataatggagatcgtaaaataaaggtttccaacaccctggaaagccggctggatctcatagcccagcagatgatgccagaagtccggggagccttgtttggtgcaaatgccaacaggaagtttttggactaagccttcaggaggtggagctcgtcgtcagctctcctgctgtgatgtggaagcttctgatatttgaagaaacacgaatgtctctgtagcttcctcttcactgccccagtattgctctgtatttatcagcgatgcccctctgtcactcatgccttgcctaattgttcacaatggtggaaagcttcatgtaatatgatcaggacccacctccagttcttctgaaagtgtgacagtgtccagccggttctgcagcactaggggagggggc

SEQ ID NO: 109877 - DNA, 800 bp, Homo sapiens
  Payload ID: 1569
  Gene Symbol: ATP6V1E1
  Gene Name: ATPase, H+ transporting, lysosomal 31kDa, V1 subunit E1
  ENST ID: ENST00000413576
  CDS Start-End: 190-800
cgagatctgcgcaggggttccctttgccgatttctctcacctcacctttcaaacctaaactcgagcctactgttcaccggcctagcattgctctcgccatggctctcagcgatgctgacgtgcaaaagcagataaagcatatgatggctttcattgaacaagaagccaatgagaaagcagaagaaatagatgcaaagtagagacggggtttcaccgtgttggccaggatggtctcaatctcttgaccttgtgatccgcctacctcgtcctccccaagtgctgggattacaggcagaagaagagttcaacatagagaaaggtcggcttgtgcaaacccaaagactaaagattatggaatattatgagaagaaagagaaacagattgagcagcagaagaaaattcagatgtccaatttgatgaatcaagcgagactcaaagtcctcagagcaagagatgaccttatcacagacctactaaatgaagcaaaacagagactcagcaaggtggtaaaagatacaaccaggtaccaagtgctgctggatggactggttctccagggtttgtaccagttgctggagccccgaatgattgttcgttgcaggaaacaagatttccctctggtaaaggctgcagtgcagaaggcaattcctatgtacaaaattgccaccaaaaacgatgttgatgtccaaattgaccaggagtcctacctgcctgaagacatagctggtggagttgagatctataatggagatcgtaaaataaaggtttccaacaccctggaaagccggctggatctcat

SEQ ID NO: 109878 - DNA, 1979 bp, Homo sapiens
  Payload ID: 1570
  Gene Symbol: ATP6V1E2
  Gene Name: ATPase, H+ transporting, lysosomal 31kDa, V1 subunit E2
  Uniprot ID: Q96A05
  ENST ID: ENST00000306448
  CDS Start-End: 1115-1795
ggagaggagggtcaccaactccaggcagggctgctaagtttattacaaacaggcaagactagaatatgtttccactttagtgagtggaaacctaatcattcataggtatcctgtacacacagaacaactatgatgaagagtgaggcctaaatcagaggagacgaggacaataatagtagtagtggtcatgatgataataataactaccagacatgaagattaaccatgcctaacattgtgttaaacgtctcacttctttcatttaatccttacaataatccaatgatgtagctgctattatttttattatacagatgaagaaactgagggcttgaggggtatactgctttgccaaagtcgtacaaatggtaagtgcagaaccaggatctgaattccgtcagtctgactgcagagtccacgccgacaccgtggaagctggtgatgcccattaggccctgtctgggcatgaagaggatgccctccctcatgagctggaacacagcatcccctgttgtgggtgtggctctcttaaagaccatctggtgaattttgcttgtgctggtttcttattaaacaaccttcagatttggcttcacgtgcaactcacatagagggaaaggagaccatgatccgccaacatgacagctgtatttttcattagtaaattagcaaactggctgcctgggtcaccatgcatacctgttaaggtgagcccgccccagagctaaaggctaccatgtgccaacttaactgagattctgagtgtgcaaggataacccccgtcatggccccgggtgccaaggaaatcccttttagcctcctcttggcagacttggccagccttccccagtgacagcctggctctttggattcaagctgcctggtcagactgcaagggtcatctgtacaaagaaggaagcaacagtgccaggttccagcgtgcgttccaagttccacattctgtgtgcagactcccaacgccagagcaaaggcaggcccctggcaggggactgctgagaaagtggaactccagagacactcctgaaattgtcctaagtcaaaggagccaaacggtgtacgagctccctctctgccgtcccctctgagagcagccatggccctgagtgatgtcgatgtgaaaaagcagattaagcacatgatggctttcattgagcaggaagccaatgagaaagcagaggaaatcgatgccaaggctgaggaagagtttaacattgagaaaggacgcctcgtgcaaacccaacgactgaagattatggagtattatgagaaaaaggagaagcagatagagcagcagaagaaaatcctgatgtccaccatgaggaatcaggcgaggctgaaagtcctgagagcccgaaatgacctcatctcagatttgctcagtgaggcgaagctgagactcagcaggattgtggaggacccagaggtctaccaggggctgctggataaactggtgctccagggtctgctccgactgctggaacctgtgatgattgtacgctgccggccacaagacctcctcctggtggaggctgctgtacaaaaagccatccccgagtacatgacaatttcccagaaacatgtggaggtccagattgataaagaggcatacctggctgtgaatgcagctggaggtgtggaggtctacagtggcaatcagagaataaaggtttcaaataccttggaaagccgactggatctctcagccaagcaaaagatgccagaaatacgaatggccttgtttggtgctaacaccaacagaaagttctttatataagcctctgggaagtgaagctagtgttgaaccactaaaccataaaagtttaagttttttggggaaaggaaactagtagtgtttcctcctctttgatgctctgatactgttctgtttttcttcacgaaataccctttggatagctaaagtgttaactttgaaataaagcccaaattaatgctcagaa

SEQ ID NO: 109879 - DNA, 1559 bp, Homo sapiens
  Payload ID: 1570
  Gene Symbol: ATP6V1E2
  Gene Name: ATPase, H+ transporting, lysosomal 31kDa, V1 subunit E2
  Uniprot ID: Q96A05
  ENST ID: ENST00000522587
  CDS Start-End: 715-1395
cgcggccctgccggcgcacccgagccccactccctgcgagggccgcgcggaggggcgcgcaggaggaggaggagccgaggaccgcggaggggaggaggggagtcgcctggggagccgagggctcctcgcgcaagtgcccgcagcgcccggaagcgtccaaaggccccgatgctgggagaagacgtggaggcctctcggggaaccacgacgacctccacgatgacgcaatagtcatgccaaattatacatgcatatttcacctccacccggaaggccagagccatcctctcggcctctaagtgcacaacggaactagaaatcaaggaggagagaccaaaagggaggcctgaactctcaaactccgaatctgatttccactctcccaggaagtcttcggaaatcactgtggattgtcaatacaggagtccatactgactgaatccctaattttggcctgtattcttctccctctgtgaaccatcttcttagaagtcactgaaccaagagtgccagaaaaccatcccaagactcacacagagttgttcttccatagtggatgttttggccactggacatcagaaccacattttgggtttgaagaatcttctacatgctgagaaagtggaactccagagacactcctgaaattgtcctaagtcaaaggagccaaacggtgtacgagctccctctctgccgtcccctctgagagcagccatggccctgagtgatgtcgatgtgaaaaagcagattaagcacatgatggctttcattgagcaggaagccaatgagaaagcagaggaaatcgatgccaaggctgaggaagagtttaacattgagaaaggacgcctcgtgcaaacccaacgactgaagattatggagtattatgagaaaaaggagaagcagatagagcagcagaagaaaatcctgatgtccaccatgaggaatcaggcgaggctgaaagtcctgagagcccgaaatgacctcatctcagatttgctcagtgaggcgaagctgagactcagcaggattgtggaggacccagaggtctaccaggggctgctggataaactggtgctccagggtctgctccgactgctggaacctgtgatgattgtacgctgccggccacaagacctcctcctggtggaggctgctgtacaaaaagccatccccgagtacatgacaatttcccagaaacatgtggaggtccagattgataaagaggcatacctggctgtgaatgcagctggaggtgtggaggtctacagtggcaatcagagaataaaggtttcaaataccttggaaagccgactggatctctcagccaagcaaaagatgccagaaatacgaatggccttgtttggtgctaacaccaacagaaagttctttatataagcctctgggaagtgaagctagtgttgaaccactaaaccataaaagtttaagttttttggggaaaggaaactagtagtgtttcctcctctttgatgctctgatactgttctgtttttcttcacgaaataccctttggatagctaaagtgttaactttgaaataaa

SEQ ID NO: 109880 - DNA, 1845 bp, Homo sapiens
  Payload ID: 1571
  Gene Symbol: ATP6V1D
  Gene Name: ATPase, H+ transporting, lysosomal 34kDa, V1 subunit D
  Uniprot ID: Q9Y5K8
  ENST ID: ENST00000216442
  CDS Start-End: 552-1295
gagaacaaggacgaatgtagatcatggaaggacctgaaaagtactgtttctcgctatcttagctttagctaagtaaccttcaaggcgcgagaaagacataggactccgattccttgcctctgaagaatgaatcctctttcaaagtttcagctaaccatgagatggcgctgtgaccaaagacgaaaggtggagaaagacaaggcgtgcacgcttcgctcctagtctttggcctggcgcgtgccgcgtattgcgcagccgcagggaagctggatggggaggggttgggaggcgaaccggaattgaggggtggttccgcggtgcgcgcgcctcgacatccgggcaacgcctctgttctgtcctcccccttcgtcgcctgtgacaaccggaagcggaagtgaaaatgggtgtccctgctgcctcttagcaacaagaggggtcaagtgacacaaccagctgactcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagacttcttttgttactttggatgaagctattaagataaccaacaggcgtgtaaatgccattgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtgtaggtttgatttgtgtggctatttattttttggcctaagaatttcactggttgtaaaatttacctagatgtctatttatgggattacttttgcagaatcataatttagcaaccatttatcatggatgaaagagatctgtaaaacctgcccaggaacttacagaatttactttgcagaagcgttatcatactccatttacatctgtgttacacgtgatctgcttaccaagcatattaggaaatacctcttaggaagcattagcggtctcaggccaattactgtggagcagctttcattcctacccacttgcaaaccttggcgctgttgtctgagattgctgcagccattcttgttaccatggtacttctcaaactttgtgaaaacctgcacttttccttgcatgacaggttcctgtcttgtctgtcatgggagccattctgccaatttaaatgcgactgtggtataaacagtaaaatgatttaaaagtaa

SEQ ID NO: 109881 - DNA, 678 bp, Homo sapiens
  Payload ID: 1571
  Gene Symbol: ATP6V1D
  Gene Name: ATPase, H+ transporting, lysosomal 34kDa, V1 subunit D
  ENST ID: ENST00000553408
  CDS Start-End: 1-135
gtgatgagagaagctgccttttcactagctgaagccaagttcacagcaggtgacttcagcactacagttatccaaaatgtcaataaagcgcaagtgaagattcgagcgaagaaagataatgtagcagcctgctgaactgtaaattctaccatctccactttgcagatgaggaaattgagactttgacaagtcaaagagcacagctggaatgcaagtcaagtatgatttgatttaatttgatctttatattttaagaattacgtactgcctttctaggaggcaaaaattagtttgaagtagggatccagattagtggttttccacatgtaggtaaattcaatgtaaagcaacaagccaaaggaccctagatttctcctgtggcttcttaaatacctggaatgtattggccttgttaaaatacttacaaaagtgcagatgactttatagtttagcatttgttaaaaagaaatcaagaaaacaatggacacataatttgttgtgtggagtcagttatctgaaacataggagaagaatatagatcaggaataggaatggaaagctgaactgtggtgacaggtgtatatatgtaagaaactttttgtttgttggtgtatgatttatgacctttgggagatgtacagcagaaaaaaaggagaaatgaagactggagaaacaaaa

SEQ ID NO: 109882 - DNA, 1085 bp, Homo sapiens
  Payload ID: 1571
  Gene Symbol: ATP6V1D
  Gene Name: ATPase, H+ transporting, lysosomal 34kDa, V1 subunit D
  ENST ID: ENST00000555431
  CDS Start-End: 137-715
gtagaggaagacactgtggaggccagttctggagctattgcagcctcggttgcccggccggggacccgagccgaaaagttatcgtcagaatgtcgggcaaagaccgaattgaaatctttccctcgcgaatactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagacttcttttgttactttggatgaagctattaagataaccaacaggcgtgtaaatgccattgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtgtaggtttgatttgtgtggctatttattttttggcctaagaatttcactggttgtaaaatttacctagatgtctatttatgggattacttttgcagaatcataatttagcaaccatttatcatggatgaaagagatctgtaaaacctgcccaggaacttacagaatttactttgcagaagcgttatcatactccatttacatctgtgttacacgtgatctgcttaccaagcatattaggaaatacctcttaggaagcattagcggtctcaggccaattactgtggagcagctttcattcctacccacttg

SEQ ID NO: 109883 - DNA, 1102 bp, Homo sapiens
  Payload ID: 1571
  Gene Symbol: ATP6V1D
  Gene Name: ATPase, H+ transporting, lysosomal 34kDa, V1 subunit D
  ENST ID: ENST00000555474
  CDS Start-End: 106-552
caaccagctgactcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagacttcttttgttactttggatgaagctattaagataaccaacaggcgtgtaaatgccattgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtgtaggtttgatttgtgtggctatttattttttggcctaagaatttcactggttgtaaaatttacctagatgtctatttatgggattacttttgcagaatcataatttagcaaccatttatcatggatgaaagagatctgtaaaacctgcccaggaacttacagaatttactttgcagaagcgttatcatactccatttacatctgtgttacacgtgatctgcttaccaagcatattaggaaatacctcttaggaagcattagcggtctcaggccaattactgtggagcagctttcattcctacccacttgcaaaccttggcgctgttgtctgagattgctgcagccattcttgttaccatggtacttctcaaactttgtgaaaacctgcacttttccttgcatgacaggttcctgtcttgtctgtcatgggagccattctgccaatttaaatgcgactgtggtataaacagtaaaatgatttaaaagtaa

SEQ ID NO: 109884 - DNA, 582 bp, Homo sapiens
  Payload ID: 1571
  Gene Symbol: ATP6V1D
  Gene Name: ATPase, H+ transporting, lysosomal 34kDa, V1 subunit D
  ENST ID: ENST00000555012
  CDS Start-End: 365-582
agagtctgggtcctccgagaacaaggacgaatgtagatcatggaaggacctgaaaagtactgtttctcgctatcttagctttagctaagtaaccttcaaggcgcgagaaagacataggactccgattccttgcctctgaagaatgaatcctctttcaaagtttcagctaaccatgagatggcgctgtgaccaaagacgaaagcggaagtgaaaatgggtgtccctgctgcctcttagcaacaagaggggtcaagtgacacaaccagctgactcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaa

SEQ ID NO: 109885 - DNA, 1750 bp, Homo sapiens
  Payload ID: 1571
  Gene Symbol: ATP6V1D
  Gene Name: ATPase, H+ transporting, lysosomal 34kDa, V1 subunit D
  Uniprot ID: Q9Y5K8
  ENST ID: ENST00000554087
  CDS Start-End: 94-837
tcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagacttcttttgttactttggatgaagctattaagataaccaacaggcgtgtaaatgccattgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtcctgctgaactgtaaattctaccatctccactttgcagatgaggaaattgagactttgacaagtcaaagagcacagctggaatgcaagtcaaatatgtacaaggatatccacaacactgttcgcagctacaagctgaggtacaaggtgcctcaaaagcttgagagaagcagaaatagaatagaatcctgacctgtgaaaacaatgactctgcaataaggtgcagagttggctggatcactataatatcctagggccaggcgcagtggctcacgcctgtaatcccagcactttgggaggccgaggtgggtggatcacgaggtcaggagatcaagaccatcctggctaacacggtgaaaccccatctctactaaaagtacaaaaaattagctgggtatggtggcgggcacctgtagccccagctactccgaaggctgaggcaggagaatggcgtgaacccaggaggcagagcttgcagtgagctgagatcgtgccactgcactccagcctgggcaacagtgcaagactccatctcaaaaaaaaaaaagcactataatatctaagaaatttggtttgtgtttattagtaaatatgctagatcatcaaagatttaatctagaccttaaaatttgaggtttccgtaggctttattattatatgatacctaatgtttaactgatattttaagccatgtaaacaaagaatacttctgaatgtttcactaaatttcttgagtttttttttttaacttaacctcactaggcctcaatattcagaatgtgaaacaggggagttggattggtgattgctgatatttttttccagctgtaaaataaaggcaatgggtccatttaa

SEQ ID NO: 109886 - DNA, 551 bp, Homo sapiens
  Payload ID: 1571
  Gene Symbol: ATP6V1D
  Gene Name: ATPase, H+ transporting, lysosomal 34kDa, V1 subunit D
  ENST ID: ENST00000556058
  CDS Start-End: 97-357
gactcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagacttcttttgttactttggatgaagctattaagataaccaacaggcgtgtaaatgccattgaacatg

SEQ ID NO: 109887 - DNA, 784 bp, Homo sapiens
  Payload ID: 1571
  Gene Symbol: ATP6V1D
  Gene Name: ATPase, H+ transporting, lysosomal 34kDa, V1 subunit D
  ENST ID: ENST00000555625
  CDS Start-End: 1-462
cgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagacttcttttgttactttggatgaagctattaagataaccaacaggcgtgtaaatgccattgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtgttcctgtcttgtctgtcatgggagccattctgccaatttaaatgcgactgtggtataaacagtaaaatgatttaaaaagtctcactcattctgtagcccaggctagagtgcagtggcagcaacatcagttcactgcaacgtccgcctcctcaattcaagagattctcctgcttcagtctcccgagtagctgggattacagcctgctgaactgtaaattctaccatctccactttgcagatgaggaaattgagactttgaca

SEQ ID NO: 109888 - DNA, 520 bp, Homo sapiens
  Payload ID: 1571
  Gene Symbol: ATP6V1D
  Gene Name: ATPase, H+ transporting, lysosomal 34kDa, V1 subunit D
  ENST ID: ENST00000555723
  CDS Start-End: 1-360
aagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcaggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtgtaggt

SEQ ID NO: 109889 - DNA, 888 bp, Homo sapiens
  Payload ID: 1571
  Gene Symbol: ATP6V1D
  Gene Name: ATPase, H+ transporting, lysosomal 34kDa, V1 subunit D
  ENST ID: ENST00000554236
  CDS Start-End: 90-629
gtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtgtaggtttgatttgtgtggctatttattttttggcctaagaatttcactggttgtaaaattt

SEQ ID NO: 109890 - DNA, 627 bp, Homo sapiens
  Payload ID: 1571
  Gene Symbol: ATP6V1D
  Gene Name: ATPase, H+ transporting, lysosomal 34kDa, V1 subunit D
  ENST ID: ENST00000553687
  CDS Start-End: 450-627
ctcttagcaacaagaggggtcaagtgacacaaccagctgactcccgtagaggaagacactgtggaggccagttctggagctattgcagcctcggttgcccggccggggacccgagccgaaaagttatcgtcagaatgtcgggcaaagaccgaattgaaatctttccctcgcgaatggacagggtcaggtgcagtggttcatgcccataatcccagcactttgggaagctgaggctggaggatttcatgagaccaggagttagaggctgcagcaagctatgatcataccactgcaatccagcctgggtgacagagcaagaccccatctcaaaaaataaggagtcgggccgggcatggtggctcatccctgtaatcccagtactttgggaggctgaagcaggcagatcacttaaagtcaagagttcgagatgagcctgggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtg

SEQ ID NO: 109891 - DNA, 1716 bp, Homo sapiens
  Payload ID: 1572
  Gene Symbol: ATP6V0D1
  Gene Name: ATPase, H+ transporting, lysosomal 38kDa, V0 subunit d1
  Uniprot ID: P61421
  ENST ID: ENST00000290949
  CDS Start-End: 152-1207
agagccacgcccccttatggtcacgtgaggcgcttgcgcgtcacctgacgcacttgacagcccgctgaggacgcagcgtcagctgacctggggagtcgcgattcgtgccggccggtcctggttctccggtcccgccgctcccgcagcagccatgtcgttcttcccggagctttactttaacgtggacaatggctacttggagggactggtgcgcggcctgaaggccggggtgctcagccaggccgactacctcaacctggtgcagtgcgagacgctagaggacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttgcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggagtacaagctgctcttcgagggtgcaggtagcaaccctggagacaagacgctggaggaccgattctttgagcacgaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaattgcactctttgtgtgtgtgtgtgtgtgtgtgcgcgtgtgtgtgcgtgtgtgtgtatgtggtctgtgacaagcctgtggctcacctgcctgtccggggtgtagtacgctgtcctagcggctgcccagttctcctgaccctcttagagactgttcttaggcctgaaaaggggctgggcacccccccccaccaaggatggacgaagaccccctccagagcaaggaggccccctcagccctgtggttacagccgctgatgtatctaagaagcatgtcactttcatgttcctccctaactccctgacctgagaaccctggggcctgggggcagtttgagcctcctctcccttctgtgggtcgctcccagagccatggcccatgggaaggacagagtgtgtgtgtccttggggcctggggggatgttgctcctcagctccctccctcagccctgcccctctgagacaataaaactgccctctctaaggccaa

SEQ ID NO: 109892 - DNA, 1257 bp, Homo sapiens
  Payload ID: 1572
  Gene Symbol: ATP6V0D1
  Gene Name: ATPase, H+ transporting, lysosomal 38kDa, V0 subunit d1
  ENST ID: ENST00000426604
  CDS Start-End: 1-176
tttcctgcacttcaagggcttctctctccggcagcctgtggacttccctggagcacttgctggagcagagatcacaggaaggtcactctggccagcaagtagcactgttagaccagtcaagggctgaggaatggatggtgccacaagggatgccagagggacttgtccctgagtgatgacagtccagtgacagtgctgatggtccatgcctgtcagacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttgcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggagtacaagctgctcttcgagggtgcaggtagcaaccctggagacaagacgctggaggaccgattctttgagcacgaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaattgcactctttgtgtgtgtgtgtgtgtgtgtgcgcgtgtgtgtgcgtgtgtgtgtatgtggtctgtgacaagcctgtggctcacctgcctgtc

SEQ ID NO: 109893 - DNA, 1262 bp, Homo sapiens
  Payload ID: 1572
  Gene Symbol: ATP6V0D1
  Gene Name: ATPase, H+ transporting, lysosomal 38kDa, V0 subunit d1
  ENST ID: ENST00000540149
  CDS Start-End: 32-1210
gttctccggtcccgccgctcccgcagcagccatgtcgttcttcccggagctttactttaacgtggacaatggctacttggagggactggtgcgcggcctgaaggccggggtgctcagccaggccgactacctcaacctggtgcagtgcgagacgctagaggacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacgcaggagtcagaggctgggacacctgaagggccagggaacatgcccaagctaggaagcaggccctctcctggccacaggcctcctttcctgagagtctccttgctgccctggcctccatcaagttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttgcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggagtacaagctgctcttcgagggtgcaggtagcaaccctggagacaagacgctggaggaccgattctttgagcacgaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaattgcactctttgtgtgtgtgtgtgtgtgtg

SEQ ID NO: 109894 - DNA, 821 bp, Homo sapiens
  Payload ID: 1572
  Gene Symbol: ATP6V0D1
  Gene Name: ATPase, H+ transporting, lysosomal 38kDa, V0 subunit d1
  ENST ID: ENST00000566322
  CDS Start-End: 1-215
ccctggagcacttgctggagcagagatcacaggaaggtcactctggccagcaagtagcactgttagaccagtcaagggctgaggtaatgctagggctgagggcacggggcctcacaggctgtgggggagaggcagaactccagcttcagggctacatggactgctgggtgaaggtgacagcgaaccattcaatttggaggacttcattctggtgatgacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttgcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgg

SEQ ID NO: 109895 - DNA, 582 bp, Homo sapiens
  Payload ID: 1572
  Gene Symbol: ATP6V0D1
  Gene Name: ATPase, H+ transporting, lysosomal 38kDa, V0 subunit d1
  ENST ID: ENST00000564788
  CDS Start-End: 83-424
gacgcagcgtcagctgacctggggagtcgcgattcgtgccggccggtcctggttctccggtcccgccgctcccgcagcagccatgtcgttcttcccggagctttactttaacgtggacaatggctacttggagggactggtgcgcggcctgaaggccggggtgctcagccaggccgactacctcaacctggtgcagtgcgagacgctagaggacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattaccggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagtttgaagcagaccgccgcgccttcatcatcaccatcaatt

SEQ ID NO: 109896 - DNA, 680 bp, Homo sapiens
  Payload ID: 1572
  Gene Symbol: ATP6V0D1
  Gene Name: ATPase, H+ transporting, lysosomal 38kDa, V0 subunit d1
  ENST ID: ENST00000564615
  CDS Start-End: 1-680
acttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttgcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagagctgtccaaagaggaccgtgccaagctctttccacactgtgggcggctctaccctgagggcctggcgcagctggctcgggctgacgactatgaacaggtcaagaacgtggccgattactacccggagtacaagctgctcttcgagggtgcaggtagcaaccctggagaca

SEQ ID NO: 109897 - DNA, 853 bp, Homo sapiens
  Payload ID: 1572
  Gene Symbol: ATP6V0D1
  Gene Name: ATPase, H+ transporting, lysosomal 38kDa, V0 subunit d1
  ENST ID: ENST00000564191
  CDS Start-End: 1-348
atgtcgttcttcccggagctttactttaacgtggacaatggctacttggagggactggtgcgcggcctgaaggccggggtgctcagccaggccgactacctcaacctggtgcagtgcgagacgctagaggacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacgtgcctcaccttgaccttggaggaatttcccctaggcctcatttagctccctcataccctgagttcatctttggtgacagactggaggatagttgtggctactgcagcctaactgtggaatggggcttactgccttcactgcatccccacacagttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttgcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagtttgaagcagaccgccgcgccttcatcatcaccatcaattctttcggcacagagctgtcc

SEQ ID NO: 109898 - DNA, 552 bp, Homo sapiens
  Payload ID: 1572
  Gene Symbol: ATP6V0D1
  Gene Name: ATPase, H+ transporting, lysosomal 38kDa, V0 subunit d1
  ENST ID: ENST00000568101
  CDS Start-End: 1-121
gcacttcaagggcttctctctccggcagcctgtggacttccctggagcacttgctggagcagagatcacaggaaggtcactctggccagcaagtagcactgttagaccagtcaagggctgagacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttgcggcttttttccaggactgcatttcagagcaggaccttgacgagatgaacatcgagatcatccgcaacaccctctacaa

SEQ ID NO: 109899 - DNA, 1048 bp, Homo sapiens
  Payload ID: 1572
  Gene Symbol: ATP6V0D1
  Gene Name: ATPase, H+ transporting, lysosomal 38kDa, V0 subunit d1
  ENST ID: ENST00000563064
  CDS Start-End: 96-269
acagcccgctgaggacgcagcgtcagctgacctggggagtcgcgattcgtgccggccggtcctggttctccggtcccgccgctcccgcagcagccatgtcgttcttcccggagctttactttaacgtggacaatggctacttggagggactggtgcgcggcctgaaggccggggtgctcagccaggccgactacctcaacctggtgcagtgcgagacgctagagggaatggatggtgccacaagggatgccagagggacttgtccctgagtgatgacagtccagtgacagtgctgatggtccatgcctgtcagacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttgcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggagtacaagctgctcttcgagggtgcaggtagcaaccctggagacaaga

SEQ ID NO: 109900 - DNA, 768 bp, Homo sapiens
  Payload ID: 1572
  Gene Symbol: ATP6V0D1
  Gene Name: ATPase, H+ transporting, lysosomal 38kDa, V0 subunit d1
  ENST ID: ENST00000561852
  CDS Start-End: 63-206
ggggagtcgcgattcgtgccggccggtcctggttctccggtcccgccgctcccgcagcagccatgtcgttcttcccggagctttactttaacgtggacaatggctacttggagggactggtgcgcggcctgaaggccggggtgctcagccaggccgactacctcaacctggtgcagtgcgagacgctagaggttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttgcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggagtacaagctgctcttcgagggtgcaggtagcaaccctggagacaagacgctggaggaccg

SEQ ID NO: 109901 - DNA, 905 bp, Homo sapiens
  Payload ID: 1572
  Gene Symbol: ATP6V0D1
  Gene Name: ATPase, H+ transporting, lysosomal 38kDa, V0 subunit d1
  ENST ID: ENST00000565835
  CDS Start-End: 1-698
tcttcccggagctttactttaacgtggacaatggctacttggagggactggtgcgcggcctgaaggccggggtgctcagccaggccgactacctcaacctggtgcagtgcgagacgctagaggcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggagtacaagctgctcttcgagggtgcaggtagcaaccctggagacaagacgctggaggaccgattctttgagcacgaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaattgcactctttgtgtgtgtgtgtgtgtgtgtgcgcgtgtgtgtgcgtgtgtgtgtatgtggtctgtgacaagcctgtggctcacctgcctgtccggggtgtagtacgctgtcctagcggctgcccagttctcctgaccctcttagagactgttcttaggcctgaaaaggggctgggcaccccccc

SEQ ID NO: 109902 - DNA, 1554 bp, Homo sapiens
  Payload ID: 1572
  Gene Symbol: ATP6V0D1
  Gene Name: ATPase, H+ transporting, lysosomal 38kDa, V0 subunit d1
  ENST ID: ENST00000602876
  CDS Start-End: 256-1080
ggtcccgccgctcccgcagcagccatgtcgttcttcccggagctttactttaacgtggacaatggctacttggagggactggtgcgcggcctgaaggccggggtgctcagccaggccgactacctcaacctggtgcagtgcgagacgctagaggacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttgcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggagtacaagctgctcttcgagggtgcaggtagcaaccctggagacaagacgctggaggaccgattctttgagcacgaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaagtgtgtgtgcgtgtgtgtgtatgtggtctgtgacaagcctgtggctcacctgcctgtccggggtgtagtacgctgtcctagcggctgcccagttctcctgaccctcttagagactgttcttaggcctgaaaaggggctgggcacccccccccaccaaggatggacgaagaccccctccagagcaaggaggccccctcagccctgtggttacagccgctgatgtatctaagaagcatgtcactttcatgttcctccctaactccctgacctgagaaccctggggcctgggggcagtttgagcctcctctcccttctgtgggtcgctcccagagccatggcccatgggaaggacagagtgtgtgtgtccttggggcctggggggatgttgctcctcagctccctccctcagccctgcccctctgagacaataaaactgccctctctaaggccaa

SEQ ID NO: 109903 - DNA, 2446 bp, Homo sapiens
  Payload ID: 1573
  Gene Symbol: ATP6V0D2
  Gene Name: ATPase, H+ transporting, lysosomal 38kDa, V0 subunit d2
  Uniprot ID: Q8N8Y2
  ENST ID: ENST00000285393
  CDS Start-End: 143-1195
acaaaaaccctgactatcacctgatagattgcttgtgctgcctgataattactcgcacttttcccaggctagtgcaaatcttcaggggccgtccaggactacagagctgtttcaccctaccttggcttcaatctcttcccccatgctcgaaggtgcggagctgtacttcaacgtggaccatggctacctggagggcctggttcgaggatgcaaggccagcctcctgacccagcaagactatatcaacctggtccagtgtgagaccctagaagacctgaaaattcatctccagactactgattatggtaactttttggctaatcacacaaatcctcttactgtttccaaaattgacactgagatgaggaaaagactatgtggagaatttgagtatttccggaatcattccctggagcccctcagcacatttctcacctatatgacgtgcagttatatgatagacaatgtgattctgctgatgaatggtgcattgcagaaaaaatctgtgaaagaaattctggggaagtgccaccccttgggccgtttcacagaaatggaagctgtcaacattgcagagacaccttcagatctctttaatgccattctgatcgaaacgccattagctccattcttccaagactgcatgtctgaaaatgctctagatgaactgaatattgaattgctacgcaataaactatacaagtcttaccttgaggcattctataaattctgtaagaatcatggtgatgtcacagcagaagttatgtgtcccattcttgagtttgaggccgacagacgtgcttttatcatcactcttaactcctttggcactgaattgagcaaagaagaccgagagaccctctatccaaccttcggcaaactctatcctgaggggttgcggctgttggctcaagcagaagactttgaccagatgaagaacgtagcggatcattacggagtatacaaacctttatttgaagctgtaggtggcagtgggggaaagacattggaggacgtgttttacgagcgtgaggtacaaatgaatgtgctggcattcaacagacagttccactacggtgtgttttatgcatatgtaaagctgaaggaacaggaaattagaaatattgtgtggatagcagaatgtatttcacagaggcatcgaactaaaatcaacagttacattccaattttataacccaagtaaggttctcaaatgtagaaaattataaatgttaaaaggaagttattgaagaaaataaaagaaattatgttatattatctagactacacaaaagtaagccacactatatcttcatgagttgcaaatccatggaaacacagtaaaccagccctgaaacaaagcatttccttgttttcagtggtattagatcttgtttccacatgtctgtctcattcttcactgggccttacaggttagttttaattaactctatggtatttttcttattcttgtttgatcatgttaaaaattggacctaataaaagtattttattcttgcttttccatgcttctctacaggtccaaatactgaatgtctcctttactttttctcttttaaatttttttctagacagggtctcactctgtcacctaggctacagtgcagtggtgtgatcacagctcactgcagcctcgacttcccaggctcaagtgatcctcccagctctcagcctccaaagtagctggcactacaagtgtacacccccacacaaggctaagttttgtattttttgtagagacagggtttcaacatattatccaggctggtgtcgaattcctgggctccagggatccacagtcccccttggcctcccaaagtgttgggattacatgcatgagccactgtgctgggcttcatttacattttaactgtctgttccttgcctagattcacagaaatccaaagctgtatgtagtcaacatggttcacaagtgttggaaaatgtgttttttgttttgttttgttttgtttcgttttgttttgagacagagtttccctctgtcgcccaggctagagtgcaatggcgtgatctcggctcactgcaacctccacctcccagattcaagcaactctctgcctcagcctcccgagtagctgggattacaagcacccaccactacactcagctaattttttgtatttttagtagagccggggtttcaccatcttggccaggctgatcttgaactcctgagctcatgatccacccgcctcagcctcccaaagtgctgggattacaggccccttgttcagccactgcacctggccccttattttgtttttgttttctaatatactttgatgtaatcagcttgagaaagcaacacaatttcaaatcctatcttctagatgcaagcagtgttaaatttgttaataaatttgcttttcacacctttctttaaataaaaggtatatctctcttt

SEQ ID NO: 109904 - DNA, 504 bp, Homo sapiens
  Payload ID: 1573
  Gene Symbol: ATP6V0D2
  Gene Name: ATPase, H+ transporting, lysosomal 38kDa, V0 subunit d2
  ENST ID: ENST00000523635
  CDS Start-End: 375-504
taaaatcacagataaaataagttcctatggtgaggaatggaggcctccagctgacagagagcaaagaactgaggcctgcgacaactataggcgtgatcctgggaaccgattctcaacctcatctgagccttgagacgactgctgctctggccgacagcctgacggcaacctcctgagacagctctgagaggagattttccaggttcaagtcccgagacgaggtttcaccgtgctggccaagctggtctccacctcaggtgatctgccccgctaagcctccgcaagtgctgggattacaggctagtgcaaatcttcaggggccgtccaggactacagagctgtttcaccctaccttggcttcaatctcttcccccatgctcgaaggtgcggagctgtacttcaacgtggaccatggctacctggagggcctggttcgaggatgcaaggccagcctcctgacccagcaagactatatcaacctggtccagtgtgagaccctagaag

SEQ ID NO: 109905 - DNA, 448 bp, Homo sapiens
  Payload ID: 1573
  Gene Symbol: ATP6V0D2
  Gene Name: ATPase, H+ transporting, lysosomal 38kDa, V0 subunit d2
  ENST ID: ENST00000521564
  CDS Start-End: 341-448
aacctgggatgagatcctcgtttcagaaaatgatttgatcctcctgaaggcgctccctgctaaggatctaaactcaggagacgggatttcaccatgtttgccaggctggtcttgaactcctgacctgaagtgatctgcccacctcagcctcccaaagtgttgggattacagagcatctctcagggattcttaaaataaaataagtcactgtgaatacacaaaggaaatgaaaacatatacagagtgtgaaataacagccaaaaaggctagtgcaaatcttcaggggccgtccaggactacagagctgtttcaccctaccttggcttcaatctcttcccccatgctcgaaggtgcggagctgtacttcaacgtggaccatggctacctggagggcctggttcgaggatgcaaggccagcctcctgacccagcaagactatatcaacctg

SEQ ID NO: 109906 - DNA, 5612 bp, Homo sapiens
  Payload ID: 1574
  Gene Symbol: ATP6V1C1
  Gene Name: ATPase, H+ transporting, lysosomal 42kDa, V1 subunit C1
  Uniprot ID: P21283
  ENST ID: ENST00000395862
  CDS Start-End: 160-1308
gctgggctggcacgtgacttgttctgtgttcgcttgggtagaggaagccgtgaggccggagcttaggtcgggaagggatggatcgctgagccgatagcgtccgctaggctgtctgcctcgaatctctcttgatttttgaggaaatacctagtaacaaacatgactgagttctggcttatatctgctcctggggagaaaacctgtcagcaaacatgggagaaattgcatgcggcaacttcaaagaacaataatcttgctgtcacttccaagttcaatattcctgacttaaaggttggcacgttggatgtcttggttggcttgtcagatgaactggctaaactggatgcatttgtagaaggagtggttaagaaagtagctcaatacatggctgatgtattggaagatagcaaagacaaagttcaagagaatctgttggctaatggagtggacttggttacttatataacaaggttccagtgggacatggccaaatatccaatcaagcagtccctgaaaaatatttctgaaataattgccaagggagtaactcagattgataatgacctgaaatctcgagcatctgcatacaataacctgaaaggaaatcttcagaatttggaacgaaagaatgcaggaagtttgctaactagaagtctagcagaaattgtgaagaaggatgactttgttcttgattcagagtatctcgtcacattactggtagtagttcccaagttaaaccacaacgactggattaagcagtatgaaacactagccgaaatggtagttccaaggtctagcaatgttctttcagaggaccaagacagttacctgtgtaatgtcaccttgtttaggaaggcagttgatgacttcagacacaaagccagagaaaacaaattcattgttcgtgacttccagtataatgaagaggagatgaaagcagataaagaagaaatgaacaggctttctactgataagaaaaaacaatttggaccacttgtacggtggctgaaagtgaattttagtgaagcatttattgcatggattcacgtgaaagcattacgggttttcgttgagtctgttttaaggtatggcttgccagtgaacttccaagcaatgctacttcagcccaataagaaaactttgaagaaactgagagaagtattacatgaattgtataaacatctagacagcagtgcagcagctattattgatgctcctatggatattccaggtttaaacctgagtcaacaagaatactacccctatgtgtactacaagattgattgcaacttgctggaattcaagtgaaaatgggctcctcccccgacaatcctgtccttgtgtttgtgtgtgctaacagaaataagttgcagtatggtcgtacttttaactctagtatcctttgcttgcttcttacgccctttcctaggtgaattctcccacagtggtctgtatctcaacattttctttttaaaggaaaaaatatatatatatagtttctttttattgatcaggtctgtaaatgtgtactaaaaaaatcagagtttatttataaacaaaatagtttatttaaagagaaggtctcttccttattgatatcatggtatgcattaattccatttgttactattgtgcacaaaagccctgttcacaggggaatggtgtaaacatttatactgttttgttcactgtatttagtagacataactgttgaatagttactgaatcatgatgtaaagaatatgtgaccatcttcaggtatgggatttctgaacgtttcaaatttcaatcaatgagcactgtcaacacccacaggagagaataaaattacctgtgcaaaggtgtattgtggtgtgtgtaacttaagattacagttctgtttgagagttaaatgatgtcatagctcacttgctatgctgcttccaggattttgttatatgctgaggtgtaaccatttgtgttgtctgactttcgtatgatttaattgagccaaatttgggtcagaacacaaatttgaagatgacttttcagtatatgatgggtatttacatttgaacactagaattttaggtctctcaaataattaagaatagagccagttttgaataaagtctagcagaactatgcagctttagtcatttgttttgtctaagtctgtattttatgtgttgtcttcttaagatctataattttggcatttatgtcatttgtgacatagtctgaaaatagagacattgttggcctttaaaatctcagaaatgaatgacttaatttagtgtcctgaaagagcttttaaaagaggattttgtggcaatgtttctcttactacgtactcacaggtttgcaaatgggaaaaaagtttacatttcagtttaggggcatatctaagctatgctattccctttagaaaattagcctccaaaatcttttgtttcaaaatattatattatttcataaataatttcaagcaaatacagacatccacaatgtagaacatgagagaccccctccctcaatttccacctcccaagggaagtttatgtatttttctaggcccttttctatgtctttacatctctgtctcacacacacacacgtatacacacacacagtttatttttaataaaataggattataccacacacatcctgtcacttgcttttttgcttaagagtatatctaagagaatcctttgtgtcagtgaagctggagctacctcattcttttaactggctgcgtggcgttccattgagtgtctgtcatcatgtgtttagccgagtggatggatagtctgcttgtttttagtttttgctcttaacaaacactgctgcagtcagcatccttgcacagatttctttgtatacttgtattagtatttctgtaagatctgagaagtggaatttgtagggtcataggttatgtacacttaagtttttgacactcactgccaagtcatctgtcagaattctaaactaaagacatgtttggagtgtggatttatcttcagtttttctttggacaagaggaagctgtgaaagattttgctatcagaaaattttggttctttgtcttttgcacatgttctttgagtcttagtatctgtaacgtggcgctactctctctatcatgggggggcatgttttgacattaaattgacttttaagaaaaacatgtcactaacctgaagctcagccacacagtgacttttaaggttttatttagactttactgttgttctcatgagagtaggtacagactgcataaggtttagaatcccagcatatgtctgaaacgacgggactttcactgtgatttccaccagagaaattatagcagagtggctgagcatgtgctctgaggccaggccccagctctgctgctgacgagctgtgtggtcctgggcagagtggtctccgagttccagtccctcctctgtaaaatgggcatgattagagtgcccaccgcattagggatgttggggtgagtcagtgtgaccccacgtgcacagaaagtgctgcgagtggtgcatggtgagaggttgatgcaggtacttagcccttggggaacacaggtagttccttttcactgtgtttaatttgggaaaatccagatccacatcattgtagagtctgagggttagaaggaagtcattgtgtctaacataacaacagagcagtttgtgtcactgagctccagtctgtgctggattattgatattgttggtggcggtcaccattcctggaaagggactgtcccaagccacttaccttcccgaggagtctgctggttctccttgaggatagtgcttagataacagactcattaaacatttactgagtgtctgtcagggatcattcacatccacatcatcctcccggcccctccccgtgttgttcatggagggagtactggcggtccccattttcatgtatggagacttcaggtgaaagaagttaagtgaattctttgttgagtcacaaatcttgagccagtcagaatttgaacctaagatttttgactgctggttgtcacacttcccgccccacactcaactgttgtgtgaatgagccagacacattgcttaacctgagtccgagatggacaatggtataggaaagatattcggtatggagaatcagatgttaacttgtgttgctatttttgttttgttttgttttgttttgtttttgagacaaggtcttgctctgtcacccaggctagagtgcagtggcatgatcagggcttactgcagcctcaccctcgatttcctgggctcaagcaatcctcccacctcagcccccaagtagctgggcctacaggtgcgtgctaccacgcctggccaattttttaaattttagcacagatgaggtctcactatgttgcccgggctggtctcgaactcctgagctcaagggatcctcccgcctcagcctcccaaagtgctggtgttacaggcataagccaccacgcctggcctgtgttgctattatatttggcaggaacccagagtccagaacatttcatctatgatgggttagataatgtgtctagttgtttgcatgccaatttcagtagcctcagttattcaacctaggagatttttctacctctttactaccctgctgaagttgctcttcagcagaaaatctttgtggaacacattccacactttgaaatcttcgtggaacaaaagatatttgtggaaccaatctttgtggaacatattccagctttttgaatgagtgcatatccagtagtacctttaaagtaacactttgtacataacaaatactcagcaaatgtgaaactttatttgctcttacttcaaaattagtccaaaatgttggaaataaaatataagacattgatctagatatgaggtttttctccttcattctcagctgtcgaagaaatcaaagtagcatatgcacaaggttaaaaaccacatatacaaatactatagaacagcttataatgaaaaccttgcctgcctttataaaaaatgtgattatcttcttctgttaatgtcaataaaagatggtttgtcctagaaggtctataaatggtattatgttctggaggaaacctagcaaaaactttgctagtttagtacttgtctctaaattgatgttcacccatttcaatattgcacttattaatggtctttatttttctagcatagataacaattgattctttagattcatatatggaggtaattcttgctttctaaagaaaggaatatggcacattggaaccattttattcaccagtggatttacccttagagtatttttagatctgagctgatgacttgtgagagaaaaagggaacagagtaaagccatggaagccatgaacagtaagagactgccgcctggcatggtttcttcttctgcagaagatgaaactgaggagaaacaagacaacatccttcataccaggaatggtcaagataatgcaagaagaaaaaagctttcaaacaaatcagaaggcagtcaacaaacagaaagggggacattccttccctggcagttactcaaaactgaaattgcttattgtgtacaccggggcttgtacttggggaatttaataaaaatgctcattaccaa

SEQ ID NO: 109907 - DNA, 1501 bp, Homo sapiens
  Payload ID: 1574
  Gene Symbol: ATP6V1C1
  Gene Name: ATPase, H+ transporting, lysosomal 42kDa, V1 subunit C1
  ENST ID: ENST00000518857
  CDS Start-End: 146-1069
gctgggctggcacgtgacttgttctgtgttcgcttgggtagaggaagccgtgaggccggagcttaggtcgggaagggatggatcgctgagccgatagcgtccgctaggctgtctgcctcgagtggttaagaaagtagctcaatacatggctgatgtattggaagatagcaaagacaaagttcaagagaatctgttggctaatggagtggacttggttacttatataacaaggttccagtgggacatggccaaatatccaatcaagcagtccctgaaaaatatttctgaaataattgccaagggagtaactcagattgataatgacctgaaatctcgagcatctgcatacaataacctgaaaggaaatcttcagaatttggaacgaaagaatgcaggaagtttgctaactagaagtctagcagaaattgtgaagaaggatgactttgttcttgattcagagtatctcgtcacattactggtagtagttcccaagttaaaccacaacgactggattaagcagtatgaaacactagccgaaatggtagttccaaggtctagcaatgttctttcagaggaccaagacagttacctgtgtaatgtcaccttgtttaggaaggcagttgatgacttcagacacaaagccagagaaaacaaattcattgttcgtgacttccagtataatgaagaggagatgaaagcagataaagaagaaatgaacaggctttctactgataagaaaaaacaatttggaccacttgtacggtggctgaaagtgaattttagtgaagcatttattgcatggattcacgtgaaagcattacgggttttcgttgagtctgttttaaggtatggcttgccagtgaacttccaagcaatgctacttcagcccaataagaaaactttgaagaaactgagagaagtattacatgaattgtataaacatctagacagcagtgcagcagctattattgatgctcctatggatattccaggtttaaacctgagtcaacaagaatactacccctatgtgtactacaagattgattgcaacttgctggaattcaagtgaaaatgggctcctcccccgacaatcctgtccttgtgtttgtgtgtgctaacagaaataagttgcagtatggtcgtacttttaactctagtatcctttgcttgcttcttacgccctttcctaggtgaattctcccacagtggtctgtatctcaacattttctttttaaaggaaaaaatatatatatatagtttctttttattgatcaggtctgtaaatgtgtactaaaaaaatcagagtttatttataaacaaaatagtttatttaaagagaaggtctcttccttattgatatcatggtatgcattaattccatttgttactattgtgcacaaaagccctgttcacaggggaatggtgtaaacatttatactgttttgttcactgtatttagtagacataactgttgaatagttactgaatcatgatgtaaaga

SEQ ID NO: 109908 - DNA, 1484 bp, Homo sapiens
  Payload ID: 1574
  Gene Symbol: ATP6V1C1
  Gene Name: ATPase, H+ transporting, lysosomal 42kDa, V1 subunit C1
  ENST ID: ENST00000521514
  CDS Start-End: 232-1155
gtgttcgcttgggtagaggaagccgtgaggccggagcttaggtcgggaagggatggatcgctgagccgatagcgtccgctaggctgtctgcctcggtacctgttactgctgctacttcctcgtttgacaccttcctgggttggcacgttggatgtcttggttggcttgtcagatgaactggctaaactggatgcatttgtagaaggagtggttaagaaagtagctcaatacatggctgatgtattggaagatagcaaagacaaagttcaagagaatctgttggctaatggagtggacttggttacttatataacaaggttccagtgggacatggccaaatatccaatcaagcagtccctgaaaaatatttctgaaataattgccaagggagtaactcagattgataatgacctgaaatctcgagcatctgcatacaataacctgaaaggaaatcttcagaatttggaacgaaagaatgcaggaagtttgctaactagaagtctagcagaaattgtgaagaaggatgactttgttcttgattcagagtatctcgtcacattactggtagtagttcccaagttaaaccacaacgactggattaagcagtatgaaacactagccgaaatggtagttccaaggtctagcaatgttctttcagaggaccaagacagttacctgtgtaatgtcaccttgtttaggaaggcagttgatgacttcagacacaaagccagagaaaacaaattcattgttcgtgacttccagtataatgaagaggagatgaaagcagataaagaagaaatgaacaggctttctactgataagaaaaaacaatttggaccacttgtacggtggctgaaagtgaattttagtgaagcatttattgcatggattcacgtgaaagcattacgggttttcgttgagtctgttttaaggtatggcttgccagtgaacttccaagcaatgctacttcagcccaataagaaaactttgaagaaactgagagaagtattacatgaattgtataaacatctagacagcagtgcagcagctattattgatgctcctatggatattccaggtttaaacctgagtcaacaagaatactacccctatgtgtactacaagattgattgcaacttgctggaattcaagtgaaaatgggctcctcccccgacaatcctgtccttgtgtttgtgtgtgctaacagaaataagttgcagtatggtcgtacttttaactctagtatcctttgcttgcttcttacgccctttcctaggtgaattctcccacagtggtctgtatctcaacattttctttttaaaggaaaaaatatatatatatagtttctttttattgatcaggtctgtaaatgtgtactaaaaaaatcagagtttatttataaacaaaatagtttatttaaagagaaggtctcttccttattgatatcatggtatgcattaattccatttgttactattgtgcac

SEQ ID NO: 109909 - DNA, 2130 bp, Homo sapiens
  Payload ID: 1574
  Gene Symbol: ATP6V1C1
  Gene Name: ATPase, H+ transporting, lysosomal 42kDa, V1 subunit C1
  Uniprot ID: P21283
  ENST ID: ENST00000518738
  CDS Start-End: 164-1312
agaggaagccgtgaggccggagcttaggtcgggaagggatggatcgctgagccgatagcgtccgctaggctgtctgcctcggtacctgttactgctgctacttcctcgtttgacaccttcctggaatctctcttgatttttgaggaaatacctagtaacaaacatgactgagttctggcttatatctgctcctggggagaaaacctgtcagcaaacatgggagaaattgcatgcggcaacttcaaagaacaataatcttgctgtcacttccaagttcaatattcctgacttaaaggttggcacgttggatgtcttggttggcttgtcagatgaactggctaaactggatgcatttgtagaaggagtggttaagaaagtagctcaatacatggctgatgtattggaagatagcaaagacaaagttcaagagaatctgttggctaatggagtggacttggttacttatataacaaggttccagtgggacatggccaaatatccaatcaagcagtccctgaaaaatatttctgaaataattgccaagggagtaactcagattgataatgacctgaaatctcgagcatctgcatacaataacctgaaaggaaatcttcagaatttggaacgaaagaatgcaggaagtttgctaactagaagtctagcagaaattgtgaagaaggatgactttgttcttgattcagagtatctcgtcacattactggtagtagttcccaagttaaaccacaacgactggattaagcagtatgaaacactagccgaaatggtagttccaaggtctagcaatgttctttcagaggaccaagacagttacctgtgtaatgtcaccttgtttaggaaggcagttgatgacttcagacacaaagccagagaaaacaaattcattgttcgtgacttccagtataatgaagaggagatgaaagcagataaagaagaaatgaacaggctttctactgataagaaaaaacaatttggaccacttgtacggtggctgaaagtgaattttagtgaagcatttattgcatggattcacgtgaaagcattacgggttttcgttgagtctgttttaaggtatggcttgccagtgaacttccaagcaatgctacttcagcccaataagaaaactttgaagaaactgagagaagtattacatgaattgtataaacatctagacagcagtgcagcagctattattgatgctcctatggatattccaggtttaaacctgagtcaacaagaatactacccctatgtgtactacaagattgattgcaacttgctggaattcaagtgaaaatgggctcctcccccgacaatcctgtccttgtgtttgtgtgtgctaacagaaataagttgcagtatggtcgtacttttaactctagtatcctttgcttgcttcttacgccctttcctaggtgaattctcccacagtggtctgtatctcaacattttctttttaaaggaaaaaatatatatatatagtttctttttattgatcaggtctgtaaatgtgtactaaaaaaatcagagtttatttataaacaaaatagtttatttaaagagaaggtctcttccttattgatatcatggtatgcattaattccatttgttactattgtgcacaaaagccctgttcacaggggaatggtgtaaacatttatactgttttgttcactgtatttagtagacataactgttgaatagttactgaatcatgatgtaaagaatatgtgaccatcttcaggtatgggatttctgaacgtttcaaatttcaatcaatgagcactgtcaacacccacaggagagaataaaattacctgtgcaaaggtgtattgtggtgtgtgtaacttaagattacagttctgtttgagagttaaatgatgtcatagctcacttgctatgctgcttccaggattttgttatatgctgaggtgtaaccatttgtgttgtctgactttcgtatgatttaattgagccaaatttgggtcagaacacaaatttgaagatgacttttcagtatatgatgggtatttacatttgaacactagaattttaggtctctcaaataattaagaatagagccagttttgaataaagtctagcagaactatg

SEQ ID NO: 109910 - DNA, 1565 bp, Homo sapiens
  Payload ID: 1575
  Gene Symbol: ATP6V1C2
  Gene Name: ATPase, H+ transporting, lysosomal 42kDa, V1 subunit C2
  Uniprot ID: Q8NEY4
  ENST ID: ENST00000272238
  CDS Start-End: 110-1393
agccggcagagcgctccggccccgcacccgccgcccgtcgcccgcagccccctaccgcgcggcccgcgccccgccggctcccgtcactgggtaagagaagactggaagcatgtcggagttttggttaatttctgcccctggcgataaggaaaatttgcaagctctggagaggatgaatactgtaacctccaagtccaacctgtcttataataccaaattcgctattcctgacttcaaggtggggaccttggattccctggttggcctctctgatgagttggggaaactcgacacctttgctgaaagcctcataaggagaatggctcagagcgtggtggaagtcatggaggactcaaaggggaaggtccaggagcacctcctggcaaacggagttgacttaacatcctttgtgacccactttgaatgggacatggccaaatatcctgtcaagcagccgctcgtgagtgtggtggacacaatagccaagcaactggcgcagatcgagatggacctgaagtcccgaacggccgcctacaacactctgaagacaaacctggagaacctggaaaagaaatccatggggaacctcttcacccggacactgagtgatattgtgagcaaagaggacttcgtgctggattctgaatatctcgtcacacttctggtcatcgtccccaaaccaaactactcacaatggcaaaaaacctacgaatctctctcagacatggtggtccctcgatcaaccaaactcattactgaggacaaggaagggggccttttcactgtgactctgtttcgaaaagtgattgaagatttcaaaaccaaggccaaagaaaacaagttcactgttcgtgaattttactatgatgagaaggaaattgaaagggaaagggaggagatggccagattgctgtctgataagaagcaacagtatcaaacttcctgtgttgctcttaaaaagggatcatccaccttcccggaccacaaggttaaggtaaccccgctaggtaaccctgataggcctgctgcggggcagaccgacagagagagagagagtgagggcgagggtgagggccccctgctgcgctggctcaaggtgaacttcagtgaagccttcattgcctggatccacatcaaggccctgagagtgtttgtggagtccgtgctcaggtatggactaccagtgaacttccaggcagtgctcctgcagccgcataagaagtcatccaccaagcgtttaagagaggttctaaactctgtcttccgacatctggatgaagtagccgctacaagtatactggatgcatctgtggagatcccgggactgcaactcaataaccaagactattttccttatgtctacttccatattgaccttagtcttcttgactagaaaggccagctggcacctctgtctcatgttcgtgcagattattacagacacctctttcctttagccagagaatggttcaaatgtcttacagaactaagatctttttcagagaaattgctcacaaaagttagtgacagttgtatttatttttttaagttacaataaaatgctc

SEQ ID NO: 109911 - DNA, 3102 bp, Homo sapiens
  Payload ID: 1575
  Gene Symbol: ATP6V1C2
  Gene Name: ATPase, H+ transporting, lysosomal 42kDa, V1 subunit C2
  Uniprot ID: Q8NEY4
  ENST ID: ENST00000381661
  CDS Start-End: 110-1255
agccggcagagcgctccggccccgcacccgccgcccgtcgcccgcagccccctaccgcgcggcccgcgccccgccggctcccgtcactgggtaagagaagactggaagcatgtcggagttttggttaatttctgcccctggcgataaggaaaatttgcaagctctggagaggatgaatactgtaacctccaagtccaacctgtcttataataccaaattcgctattcctgacttcaaggtggggaccttggattccctggttggcctctctgatgagttggggaaactcgacacctttgctgaaagcctcataaggagaatggctcagagcgtggtggaagtcatggaggactcaaaggggaaggtccaggagcacctcctggcaaacggagttgacttaacatcctttgtgacccactttgaatgggacatggccaaatatcctgtcaagcagccgctcgtgagtgtggtggacacaatagccaagcaactggcgcagatcgagatggacctgaagtcccgaacggccgcctacaacactctgaagacaaacctggagaacctggaaaagaaatccatggggaacctcttcacccggacactgagtgatattgtgagcaaagaggacttcgtgctggattctgaatatctcgtcacacttctggtcatcgtccccaaaccaaactactcacaatggcaaaaaacctacgaatctctctcagacatggtggtccctcgatcaaccaaactcattactgaggacaaggaagggggccttttcactgtgactctgtttcgaaaagtgattgaagatttcaaaaccaaggccaaagaaaacaagttcactgttcgtgaattttactatgatgagaaggaaattgaaagggaaagggaggagatggccagattgctgtctgataagaagcaacagtatggccccctgctgcgctggctcaaggtgaacttcagtgaagccttcattgcctggatccacatcaaggccctgagagtgtttgtggagtccgtgctcaggtatggactaccagtgaacttccaggcagtgctcctgcagccgcataagaagtcatccaccaagcgtttaagagaggttctaaactctgtcttccgacatctggatgaagtagccgctacaagtatactggatgcatctgtggagatcccgggactgcaactcaataaccaagactattttccttatgtctacttccatattgaccttagtcttcttgactagaaaggccagctggcacctctgtctcatgttcgtgcagattattacagacacctctttcctttagccagagaatggttcaaatgtcttacagaactaagatctttttcagagaaattgctcacaaaagttagtgacagttgtatttatttttttaagttacaataaaatgctctcaagtcctttgaatgttccaacaaattcaaaacttcattttctgaatgttttacataaatgcgaactacctgttcgcattggtaacctgctgctgtatttcatgtcttaacggctattttgaggttcattaacaacatagaaagccttgaactgtataaccagctagattccttaataattagtcactagagacagcccaaagacaaatattgggcaggaaatcagttctcactgagcccggtttccatgtaaaatctctgttgtggtgggcataggtggcaccatctaaagaaaagaggtcttgttttttgtttaaaaaagtttgtggggaggaaagacatctgtgtatcacttcaaaatattgatttactgctaaacatcactctgaatttatgatgtggatactaacttcatacatttatcggcattgtccaaaatattttattctttaatggaaaaagccattaatattcaaatgaagggatcacattaaaaaaaacccatacataagaaacagcctccaagaacattcaagcagcagtcagagagaaaaatgtttcgacagccaagttttcttcaaaatattatgtgacagaatacgactcaattcaccggctacaacaattcatagaatttttcaatgttttcttgagatgcaaaagttcactgttgcagtgttttcaaatgaccaatcaagtactacttcttggttaaaaggccactggtagagtcatctgagtgtagagaatgtcccttcactgctggaaaaatccactggctcccaagaaaagaaaatggtctgaagcctctgttgtggctctcacaactcatctttccctaagtcatcaagctccacatcactgaggtcaatgtcatcctccacgggaagctgggagacgacagaaagccactgttagatctgcagaaggggacaccctggaaggtcaacatctcattttatggaagagcgactctctggagctactcctgctacaatccaggttctcctcagtctgactcctaccctgaccttcgtacctatgattatacggatggaaaagctcagaactcaggtgaaacatttcaacatcacatcactcaccattttaacactggaagccacttgaacgtgtccttttgaggagggtgggacacaacagtacagaaataagtgctaatttcaaagctatcattttctatttttctaagataaagtaaatgaattccaggttaaatgttcactttaaggtaataatcaggaaagcaaccttactactgaaatgtatcttggctgtcaagagtatcaaatgccatgcagcacttaaacttgtgataaggaagatgaagggtcttcagagaagaacctcttaaaaggcccacgggtgcaccagggctgaggtctgatgggaaggacttgactccaggtgcagagatgcacaggctcaagagagtaaaccaggactgctgcccgcacagcttccctcccgggcactcacctcgccatccctgccgtcccaaggctctctctcaacgatggtagggaaagccccgcctcctacaggtgccgtggagccacgcccaaaagagagctcccttagggaaaaatgaccaaaacacacacacacatttacaatggactgctggtgcagaagaataaacaactttaaaaataa

SEQ ID NO: 109912 - DNA, 1578 bp, Homo sapiens
  Payload ID: 1575
  Gene Symbol: ATP6V1C2
  Gene Name: ATPase, H+ transporting, lysosomal 42kDa, V1 subunit C2
  ENST ID: ENST00000635370
  CDS Start-End: 79-1392
cacatctctccttctgtttctgtttgtgtatgtttgtcctggttctgggcagtcactgggtaagagaagactggaagcatgtcggagttttggttaatttctgcccctggcgataaggaaaatttgcaagctctggagaggatgaatactgtaacctccaagtccaacctgtcttataataccaaattcgctattcctgacttcaaggtggggaccttggattccctggttggcctctctgatgagttggggaaactcgacacctttgctgaaagcctcataaggagaatggctcagagcgtggtggaagtcatggaggactcaaaggggaaggtccaggagcacctcctggcaaacggaggcttgaaaggaaaaatgaaatgtttaaagattgacttaacatcctttgtgacccactttgaatgggacatggccaaatatcctgtcaagcagccgctcgtgagtgtggtggacacaatagccaagcaactggcgcagatcgagatggacctgaagtcccgaacggccgcctacaacactctgaagacaaacctggagaacctggaaaagaaatccatggggaacctcttcacccggacactgagtgatattgtgagcaaagaggacttcgtgctggattctgaatatctcgtcacacttctggtcatcgtccccaaaccaaactactcacaatggcaaaaaacctacgaatctctctcagacatggtggtccctcgatcaaccaaactcattactgaggacaaggaagggggccttttcactgtgactctgtttcgaaaagtgattgaagatttcaaaaccaaggccaaagaaaacaagttcactgttcgtgaattttactatgatgagaaggaaattgaaagggaaagggaggagatggccagattgctgtctgataagaagcaacagtatcaaacttcctgtgttgctcttaaaaagggatcatccaccttcccggaccacaaggttaaggtaaccccgctaggtaaccctgataggcctgctgcggggcagaccgacagagagagagagagtgagggcgagggtgagggccccctgctgcgctggctcaaggtgaacttcagtgaagccttcattgcctggatccacatcaaggccctgagagtgtttgtggagtccgtgctcaggtatggactaccagtgaacttccaggcagtgctcctgcagccgcataagaagtcatccaccaagcgtttaagagaggttctaaactctgtcttccgacatctggatgaagtagccgctacaagtatactggatgcatctgtggagatcccgggactgcaactcaataaccaagactattttccttatgtctacttccatattgaccttagtcttcttgactagaaaggccagctggcacctctgtctcatgttcgtgcagattattacagacacctctttcctttagccagagaatggttcaaatgtcttacagaactaagatctttttcagagaaattgctcacaaaagttagtgacagttgtatttatttttttaagttacaataaaatgctctcaagtcctttgaa

SEQ ID NO: 109913 - DNA, 2365 bp, Homo sapiens
  Payload ID: 1576
  Gene Symbol: ATP6V1H
  Gene Name: ATPase, H+ transporting, lysosomal 50/57kDa, V1 subunit H
  Uniprot ID: Q9UI12
  ENST ID: ENST00000355221
  CDS Start-End: 561-1958
agctgcttccgggcggaggtcctcggcctcccctaggcgaggcactaggtctgggggcggcgggtcttagcgtgcccgccacgctcgccgcctcccacctgccctggctggctggggcccgacccttgcgtcgctccggggcccaagttacggactcgggaatccagttgtccgcaccgaacaagccccgccgcagcgcccgcccctcctcttgctgctttggagtctcccggcttccgccttccgcagcagtcacgtgcctccgatcacgtgaccggcgcctctgtcattctactgcggccgccctggcttccttctacctgtgcggccctcaacgtctccttggtgcgggacccgcttcactttcggctcccggagtctccctccactgctcagacctctggacctgacaggagacgcctacttggctctgacgcggcgccccagcccggctgtgtccccggcgccccggaccaccctccctgccggctttgggtgcgttgtggggtcccgaggattcgcgagatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgcaggaaaatcatcagcgtgttagcattttctttgactatgcaagatgtagcaagaacactgcgtggccctactttctgccaatgttgaatcgccaggatcccttcactgttcatatggcagcaagaattattgccaagttagcagcttggggaaaagaactgatggaaggcagtgacttaaattactatttcaattggataaaaactcagctgagttcacagagttcgcagtatgtgcagtgcgtggccgggtgtttgcagctgatgctccgggtcaatgagtaccgctttgcttgggtggaagcagatggggtaaattgcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtaactttttagaaaaatcaactgaaagagaaactcgccaagaatatgccctggctatgattcagtgcaaagttctgaaacagttggagaacttggaacagcagaagtacgatgatgaagatatcagcgaagatatcaaatttcttttggaaaaacttggagagagtgtccaggaccttagttcatttgatgaatacagttcagaacttaaatctggaaggttggaatggagtcctgtgcacaaatctgagaaattttggagagagaatgctgtgaggttaaatgagaagaattatgaactcttgaaaatcttgacaaaacttttggaagtgtcagatgatccccaagtcttagctgttgctgctcacgatgttggagaatatgtgcggcattatccacgaggcaaacgggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactccaaacatggcctctctctttacttggactttgaacaaaagtcaactgttgtctcttttcaaaccaaattgggagaattgttgcaaagtagtgaatggcaaataaatgttttaaaatc

SEQ ID NO: 109914 - DNA, 2007 bp, Homo sapiens
  Payload ID: 1576
  Gene Symbol: ATP6V1H
  Gene Name: ATPase, H+ transporting, lysosomal 50/57kDa, V1 subunit H
  Uniprot ID: Q9UI12
  ENST ID: ENST00000359530
  CDS Start-End: 265-1716
gcggccgccctggcttccttctacctgtgcggccctcaacgtctccttggtgcgggacccgcttcactttcggctcccggagtctccctccactgctcagacctctggacctgacaggagacgcctacttggctctgacgcggcgccccagcccggctgtgtccccggcgccccggaccaccctccctgccggctttgggtgcgttgtggggtcccgaggattcgcgagatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgcaggaaaatcatcagcgtgttagcattttctttgactatgcaagatgtagcaagaacactgcgtggccctactttctgccaatgttgaatcgccaggatcccttcactgttcatatggcagcaagaattattgccaagttagcagcttggggaaaagaactgatggaaggcagtgacttaaattactatttcaattggataaaaactcagctgagttcacagaaactgcgtggtagcggtgttgctgttgaaacaggaacagtctcttcaagtgatagttcgcagtatgtgcagtgcgtggccgggtgtttgcagctgatgctccgggtcaatgagtaccgctttgcttgggtggaagcagatggggtaaattgcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtaactttttagaaaaatcaactgaaagagaaactcgccaagaatatgccctggctatgattcagtgcaaagttctgaaacagttggagaacttggaacagcagaagtacgatgatgaagatatcagcgaagatatcaaatttcttttggaaaaacttggagagagtgtccaggaccttagttcatttgatgaatacagttcagaacttaaatctggaaggttggaatggagtcctgtgcacaaatctgagaaattttggagagagaatgctgtgaggttaaatgagaagaattatgaactcttgaaaatcttgacaaaacttttggaagtgtcagatgatccccaagtcttagctgttgctgctcacgatgttggagaatatgtgcggcattatccacgaggcaaacgggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactcc

SEQ ID NO: 109915 - DNA, 1892 bp, Homo sapiens
  Payload ID: 1576
  Gene Symbol: ATP6V1H
  Gene Name: ATPase, H+ transporting, lysosomal 50/57kDa, V1 subunit H
  Uniprot ID: Q9UI12
  ENST ID: ENST00000396774
  CDS Start-End: 208-1659
attcgcgaggtaaggccgccctcgcgttgtttggtctcaggctgcagaccaggtcaggcgactcttgcagtttctccagcttgcctggtgcgtgctggtgtctcgccgcttggtcctctcctgttcttcggcccccggttgccagattgcttttcttccaggcctcaaccagatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgcaggaaaatcatcagcgtgttagcattttctttgactatgcaagatgtagcaagaacactgcgtggccctactttctgccaatgttgaatcgccaggatcccttcactgttcatatggcagcaagaattattgccaagttagcagcttggggaaaagaactgatggaaggcagtgacttaaattactatttcaattggataaaaactcagctgagttcacagaaactgcgtggtagcggtgttgctgttgaaacaggaacagtctcttcaagtgatagttcgcagtatgtgcagtgcgtggccgggtgtttgcagctgatgctccgggtcaatgagtaccgctttgcttgggtggaagcagatggggtaaattgcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtaactttttagaaaaatcaactgaaagagaaactcgccaagaatatgccctggctatgattcagtgcaaagttctgaaacagttggagaacttggaacagcagaagtacgatgatgaagatatcagcgaagatatcaaatttcttttggaaaaacttggagagagtgtccaggaccttagttcatttgatgaatacagttcagaacttaaatctggaaggttggaatggagtcctgtgcacaaatctgagaaattttggagagagaatgctgtgaggttaaatgagaagaattatgaactcttgaaaatcttgacaaaacttttggaagtgtcagatgatccccaagtcttagctgttgctgctcacgatgttggagaatatgtgcggcattatccacgaggcaaacgggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgc

SEQ ID NO: 109916 - DNA, 735 bp, Homo sapiens
  Payload ID: 1576
  Gene Symbol: ATP6V1H
  Gene Name: ATPase, H+ transporting, lysosomal 50/57kDa, V1 subunit H
  ENST ID: ENST00000524234
  CDS Start-End: 432-735
agattgcttttcttccaggcctcaaccaggtttattaagcgaaattctggagcctttctcgcagggggaagaaacgtcaggggcgggcaggagagtggagggggaggggtaaaaagtataccttctccaggactgggccacggccctggatcgctgggggtgcgagtagttcagggacttaggtaattgtctagagacaccttgagctacgccaggacgggccgctgaggctgagcctccttggctgcagagttccagcctggcccagttgaagcctgttttttcctgggccctgtcgttcgcgctgcccagggttgtttatacagcaaatcttcagatacagagattaagttccaaattgattaagatcgttggaaacccggaatataattttggatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgc

SEQ ID NO: 109917 - DNA, 1734 bp, Homo sapiens
  Payload ID: 1576
  Gene Symbol: ATP6V1H
  Gene Name: ATPase, H+ transporting, lysosomal 50/57kDa, V1 subunit H
  ENST ID: ENST00000524164
  CDS Start-End: 296-442
atcacgtgaccggcgcctctgtcattctactgcggccgccctggcttccttctacctgtgcggccctcaacgtctccttggtgcgggacccgcttcactttcggctcccggagtctccctccactgctcagacctctggacctgacaggagacgcctacttggctctgacgcggcgccccagcccggctgtgtccccggcgccccggaccaccctccctgccggctttgggtgcgttgtggggtcccgaggattcgcgagatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagatttgtgctaaaacatttataaatctgatgactcatatctgcaaagaacagaccgttcagtatatactaactatggtggatgatatgctgcaggaaaatcatcagcgtgttagcattttctttgactatgcaagatgtagcaagaacactgcgtggccctactttctgccaatgttgaatcgccaggatcccttcactgttcatatggcagcaagaattattgccaagttagcagcttggggaaaagaactgatggaaggcagtgacttaaattactatttcaattggataaaaactcagctgagttcacagaaactgcgtggtagcggtgttgctgttgaaacaggaacagtctcttcaagtgatagttcgcagtatgtgcagtgcgtggccgggtgtttgcagctgatgctccgggtcaatgagtaccgctttgcttgggtggaagcagatggggtaaattgcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtaactttttagaaaaatcaactgaaagagaaactcgccaagaatatgccctggctatgattcagtgcaaagttctgaaacagttggagaacttggaacagcagaagtacgatgatgaagatatcagcgaagatatcaaatttcttttggaaaaacttggagagagtgtccaggaccttagttcatttgatgaatacagttcagaacttaaatctggaaggttggaatggagtcctgtgcacaaatctgagaaattttggagagagaatgctgtgaggttaaatgagaagaattatgaactcttgaaaatcttgacaaaacttttggaagtgtcagatgatccccaagtcttagctgttgctgctcacgatgttggagaatatgtgcggcattatccacgaggcaaacgggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagag

SEQ ID NO: 109918 - DNA, 551 bp, Homo sapiens
  Payload ID: 1576
  Gene Symbol: ATP6V1H
  Gene Name: ATPase, H+ transporting, lysosomal 50/57kDa, V1 subunit H
  ENST ID: ENST00000522849
  CDS Start-End: 1-261
tttgactatgcaagatgtagcaagaacactgcgtggccctactttctgccaatgttgaatcgccaggatcccttcactgttcatatggcagcaagaattattgccaagttagcagcttggggaaaagaactgatggaaggcagtgacttaaattactatttcaattggataaaaactcagctgagttcacagaaactgcgtggtagcggtgttgctgttgaaacaggaacagtctcttcaagtgatcacagtattcagtaaattacacgagctgttcaacacttgattataaaatgggctttgtattgatttttggaaggattgcctggagatatattctgaaatgcaaaagaaaattaactgagttcgcagtatgtgcagtgcgtggccgggtgtttgcagctgatgctccgggtcaatgagtaccgctttgcttgggtggaagcagatggggtaaattgcataatgggagtgttgagtaacaagtgtggctttcagctccagtatcaaatgattttttcaatatggctcctggcattcagtcctcaaat

SEQ ID NO: 109919 - DNA, 578 bp, Homo sapiens
  Payload ID: 1576
  Gene Symbol: ATP6V1H
  Gene Name: ATPase, H+ transporting, lysosomal 50/57kDa, V1 subunit H
  ENST ID: ENST00000519588
  CDS Start-End: 248-358
cttctacctgtgcggccctcaacgtctccttggtgcgggacccgcttcactttcggctcccggagtctccctccactgctcagacctctggacctgacaggagacgcctacttggctctgacgcggcgccccagcccggctgtgtccccggcgccccggaccaccctccctgccggctttgggtgcgttgtggggtcccgaggattcgcgagatttgttgaaagacattcaagattacgaagtttagatgaccaaaatggatatccgaggtgctgtggatgctgctgtccccaccaatattattgctgccaagagatgcttcaaactgaaggcagccagtgtgctaaaacatttataaatctgatgactcatatctgcaaagaacagaccgttcagtatatactaactatggtggatgatatgctgcaggaaaatcatcagcgtgttagcattttctttgactatgcaagatgtagcaagaacactgcgtggccctactttctgccaatgttgaatcgccaggatcccttcactgttcatatggcagcaagaattattgccaagttagcagcttgggg

SEQ ID NO: 109920 - DNA, 403 bp, Homo sapiens
  Payload ID: 1576
  Gene Symbol: ATP6V1H
  Gene Name: ATPase, H+ transporting, lysosomal 50/57kDa, V1 subunit H
  ENST ID: ENST00000521275
  CDS Start-End: 98-403
gttgtttggtctcaggctgcagaccaggtcaggcgactcttgcagtttctccagcttgcctgatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgcag

SEQ ID NO: 109921 - DNA, 1967 bp, Homo sapiens
  Payload ID: 1576
  Gene Symbol: ATP6V1H
  Gene Name: ATPase, H+ transporting, lysosomal 50/57kDa, V1 subunit H
  ENST ID: ENST00000520188
  CDS Start-End: 345-1676
aatgcagagagctgaggctagagaggcagccaggggccgatcgtgaagatgctgtgtgtgggtgtgtggttggaaggagtttggacttgatcctatcagtcagtgcttttcaagctgatttttaagctgtgaagcccatgattgatatgaagttagcatgtaaaacagatgaaaatgatagaatggaggtgggagtgtgtgtcccagagccctctttttgagaccattcaccattttccaaggagctgtaggtgttggaaaccaatgaatcttgtagccgggagttagaagaccatatctgcctcttgattgaattgttctactagcagcatgaagggggacagatgatttctgctgaagattgtgagtttattcagaggtttgaaatgaaacgaagccctgaagagaagcaagagatgcttcaaactgaaggcagccagtgtgctaaaacatttataaatctgatgactcatatctgcaaagaacagaccgttcagtatatactaactatggtggatgatatgctgcaggaaaatcatcagcgtgttagcattttctttgactatgcaagatgtagcaagaacactgcgtggccctactttctgccaatgttgaatcgccaggatcccttcactgttcatatggcagcaagaattattgccaagttagcagcttggggaaaagaactgatggaaggcagtgacttaaattactatttcaattggataaaaactcagctgagttcacagaaactgcgtggtagcggtgttgctgttgaaacaggaacagtctcttcaagtgatagttcgcagtatgtgcagtgcgtggccgggtgtttgcagctgatgctccgggtcaatgagtaccgctttgcttgggtggaagcagatggggtaaattgcataatgggagtgttgagtaacaagtgtggctttcagctccagtatcaaatgattttttcaatatggctcctggcattcagtcctcaaatgtgtgaacacctgcggcgctataatatcattccagttctgtctgatatccttcaggagtctgtcaaagagaaagtaacaagaatcattcttgcagcatttcgtaactttttagaaaaatcaactgaaagagaaactcgccaagaatatgccctggctatgattcagtgcaaagttctgaaacagttggagaacttggaacagcagaagtacgatgatgaagatatcagcgaagatatcaaatttcttttggaaaaacttggagagagtgtccaggaccttagttcatttgatgaatacagttcagaacttaaatctggaaggttggaatggagtcctgtgcacaaatctgagaaattttggagagagaatgctgtgaggttaaatgagaagaattatgaactcttgaaaatcttgacaaaacttttggaagtgtcagatgatccccaagtcttagctgttgctgctcacgatgttggagaatatgtgcggcattatccacgaggcaaacgggtcatcgagcagctcggtgggaagcagctggtcatgaaccacatgcatcatgaagaccagcaggtccgctataatgctctgctggccgtgcagaagctcatggtgcacaactgggaataccttggcaagcagctccagtccgagcagccccagaccgctgccgcccgaagctaagcctgcctctggccttcccctccgcctcaatgcagaaccagtagtgggagcactgtgtttagagttaagagtgaacactgtttgattttacttggaatttcctctgttatatagcttttcccaatgctaatttccaaacaacaacaacaaaataacatgtttgcctgttaagttgtataaaagtaggtgattctgtatttaaagaaaatattactgttacatatactgcttgcaatttctgtatttattgttctctggaaataaatatagttattaaaggattctcactcc

SEQ ID NO: 109922 - DNA, 144 bp, Homo sapiens
  Payload ID: 1576
  Gene Symbol: ATP6V1H
  Gene Name: ATPase, H+ transporting, lysosomal 50/57kDa, V1 subunit H
  ENST ID: ENST00000630578
  CDS Start-End: 1-144
atgaccaaaatggatatccgaggtgctgtggatgctgctgtccccaccaatattattgctgccaaggctgcagaagttcgtgcaaacaaagtcaactggcaatcctatcttcagggacagatgatttctgctgaagatttttgc

SEQ ID NO: 109923 - DNA, 1891 bp, Homo sapiens
  Payload ID: 1577
  Gene Symbol: ATP6V1B1
  Gene Name: ATPase, H+ transporting, lysosomal 56/58kDa, V1 subunit B1
  Uniprot ID: P15313
  ENST ID: ENST00000234396
  CDS Start-End: 74-1615
agctggacctgaagtctcagagctgccaccagcagcaggctcagacactgggctcccagctggggactgctccatggccatggagatagacagcaggcctggggggctccccggcagtagctgcaacctaggtgcagcccgagaacacatgcaggcggtcacccgaaactacatcacccacccccgtgtcacctacaggactgtgtgcagcgtgaacgggcccctggtggtgctggaccgggtcaagtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatgagattgccgctcagatctgccgccaggcggggctggtgaagaagtccaaggctgtgctggattaccatgacgacaacttcgccatcgtctttgcagccatgggggtgaacatggagacagccagattcttcaagtctgactttgagcagaatggaaccatggggaacgtctgcctcttcctgaacttggccaatgaccccacgatcgagcggatcatcaccccgcgcctggcgctgaccactgctgaattccttgcctaccagtgtgagaagcatgtgctggtcatactgacggacatgagttcctatgcagaggccttgcgggaggtctctgctgctagagaggaggtgcctgggcgccgagggtttcctggatatatgtacacagacctggccaccatctacgagcgggcgggccgcgtggagggtcggggaggatccatcacacagatccccatcctcaccatgcccaacgacgatatcacccaccctatcccagacttgacgggcttcatcacagagggacagatctacgtggacagacagcttcacaacagacagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccac

SEQ ID NO: 109924 - DNA, 546 bp, Homo sapiens
  Payload ID: 1577
  Gene Symbol: ATP6V1B1
  Gene Name: ATPase, H+ transporting, lysosomal 56/58kDa, V1 subunit B1
  ENST ID: ENST00000432098
  CDS Start-End: 323-546
agggaaggcagaggatgcctctgtgtgtgtgagcagggtgtttggggtgagacccctactcacccccgcccctcccccagcctacaggactgtgtgcagcgtgaacgggcccctggtggtgctggaccgggtcaagtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatga

SEQ ID NO: 109925 - DNA, 1805 bp, Homo sapiens
  Payload ID: 1577
  Gene Symbol: ATP6V1B1
  Gene Name: ATPase, H+ transporting, lysosomal 56/58kDa, V1 subunit B1
  ENST ID: ENST00000412314
  CDS Start-End: 35-1525
ctcagacactgggctcccagctggggactgctccatggccatggagatagacagcaggcctggggggctccccggcagtagctgcaacctaggtgcagcccgagaacacatgcaggcggtcacccgaaactacatcacccacccccgtgtcacctacaggactgtgtgcagcgtgaacgggcccctggtggtgctggaccgggtcaagtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatgagattgccgctcagatctgccgccaggcggggctggtgaagaagtccaaggctgtgctggattaccatgacgacaacttcgccatcgtctttgcagccatgggggtgaacatggagacagccagattcttcaagtctgactttgagcagaatggaaccatggggaacgtctgcctcttcctgaacttggccaatgaccccacgatcgagcggatcatcaccccgcgcctggcgctgaccactgctgaattccttgcctaccagtgtgagaagcatgtgctggtcatactgacggacatgagttcctatgcagaggccttgcgggaggtctctgctgctagagaggaggtgcctgggcgccgagggtttcctggatatatgtacacagacctggccaccatctacgagcgggcgggccgcgtggaggatatcacccaccctatcccagacttgacgggcttcatcacagagggacagatctacgtggacagacagcttcacaacagacagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccacaaaa

SEQ ID NO: 109926 - DNA, 1905 bp, Homo sapiens
  Payload ID: 1577
  Gene Symbol: ATP6V1B1
  Gene Name: ATPase, H+ transporting, lysosomal 56/58kDa, V1 subunit B1
  ENST ID: ENST00000432367
  CDS Start-End: 54-800
agctgccaccagcagcaggctcagacactgggctcccagctggggactgctccatggccatggagatagacagcaggcctggggggctccccggcagtagctgcaacctaggtgcagcccgagaacacatgcaggcggtcacccgaaactacatcacccacccccgtgtcacctacaggactgtgtgcagcgtgaacgggcccctggtggtgctggaccgggtcaagtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatgagattgccgctcagatctgccgccaggcggggctggtgaagaagtccaaggctgtgctggattaccatgacgacaacttcgccatcgtctttgcagccatgggggtgaggagacttagtagactggcaagtgaacatggagacagccagattcttcaagtctgactttgagcagaatggaaccatggggaacgtctgcctcttcctgaacttggccaatgaccccacgatcgagcggatcatcaccccgcgcctggcgctgaccactgctgaattccttgcctaccagtgtgagaagcatgtgctggtcatactgacggacatgagttcctatgcagaggccttgcgggaggtctctgctgctagagaggaggtgcctgggcgccgagggtttcctggatatatgtacacagacctggccaccatctacgagcgggcgggccgcgtggagggtcggggaggatccatcacacagatccccatcctcaccatgcccaacgacgatatcacccaccctatcccagacttgacgggcttcatcacagagggacagatctacgtggacagacagcttcacaacagacagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccacaaaataaaa

SEQ ID NO: 109927 - DNA, 472 bp, Homo sapiens
  Payload ID: 1577
  Gene Symbol: ATP6V1B1
  Gene Name: ATPase, H+ transporting, lysosomal 56/58kDa, V1 subunit B1
  ENST ID: ENST00000433895
  CDS Start-End: 118-472
atctacgtggacagacagcttcacaacagacaggttaaaggtgacctctatgacgtttttctctttgcttggcagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctct

SEQ ID NO: 109928 - DNA, 863 bp, Homo sapiens
  Payload ID: 1577
  Gene Symbol: ATP6V1B1
  Gene Name: ATPase, H+ transporting, lysosomal 56/58kDa, V1 subunit B1
  ENST ID: ENST00000454446
  CDS Start-End: 116-863
ggatgagaggcctctgtgtggtgggggcggactctgaggaggcctctgccctctgcctggccctcccccagcctcctgcaggtgtccgagcagcaggggccctgcgggcaggggcatgacccttacagcaatggtggctggccctgtcacagctaatgaccctgacggcccaggctgggaaggaggtggggtgtggagagaggaagggaaggcagaggatgcctctgtgtgtgtgagcagggtgtttggggtgagacccctactcacccccgcccctcccccagcctacaggactgtgtgcagcgtgaacgggcccctggtggtgctggaccgggtcaagtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatgagattgccgctcagatctgccgccaggcggggctggtgaagaagtccaaggctgtgctggattaccatgacgacaacttcgccatcgtctttgcagccatgggggtgaggagac

SEQ ID NO: 109929 - DNA, 2875 bp, Homo sapiens
  Payload ID: 1578
  Gene Symbol: ATP6V1B2
  Gene Name: ATPase, H+ transporting, lysosomal 56/58kDa, V1 subunit B2
  Uniprot ID: P21281
  ENST ID: ENST00000276390
  CDS Start-End: 41-1576
gcggcgtcgctgctgggccagtcgggacagaggagacaagatggcgctgcgggcgatgcgggggattgtcaacggggccgcacccgagctacccgtgcccaccggtgggccggcggtgggagctcgggagcaggcgctggcagtcagtcggaactacctctcccagcctcgcctcacatacaagacagtatctggagtcaatggtccactagtgatcttagatcatgttaagtttcccaggtatgctgaaattgtccatttgaccttaccggatggcacaaagagaagtgggcaagttctggaagttagtggttccaaggcagtagttcaggtatttgaagggacttcaggtatagatgctaagaaaacgtcctgtgagtttactggggatattctccgaacaccggtgtctgaggatatgcttggtcgggtattcaatggatcgggaaaacccattgacagaggtcctgttgtactggccgaagacttccttgatatcatgggtcagccaatcaaccctcaatgtcgaatctacccagaggaaatgattcagactggcatttcggccatcgatgggatgaacagtattgctagggggcagaaaattcctatcttctctgctgctgggctaccacacaatgagattgcagctcagatctgtcgccaggctggtttggtaaagaaatccaaagatgtagtagactacagtgaggaaaattttgcaattgtatttgctgctatgggtgtaaacatggaaactgcccggttcttcaaatctgactttgaagaaaatggctcaatggacaatgtctgcctctttttgaacttggctaatgacccaaccattgagcgaattatcactcctcgcctggctctaaccacagctgaatttctggcgtaccaatgtgagaaacatgtattggttattctaacagacatgagttcttatgctgaagcacttcgagaggtttcagcagccagggaagaggtacctggtcgacgaggttttccaggttacatgtatacagatttagccacgatatatgaacgcgctgggcgagtggaagggagaaacggctcgattactcaaatccctattctaaccatgcctaatgatgatatcactcaccccatcccagacttgactggctacattacagaggggcagatctatgtggacagacagctgcacaacagacagatttatccacctatcaatgtgctgccctcactatcacggttaatgaagtctgctattggagaagggatgaccaggaaggatcatgccgatgtatctaaccagctatatgcgtgctatgctattggaaaggatgtgcaagccatgaaagctgtcgttggagaagaagcccttacctcagatgatcttctctacttggaatttctgcagaagtttgagaggaacttcattgctcagggtccttacgaaaatcgcactgtctttgagactttggacattggctggcagctactccgaatcttccccaaagaaatgctgaagagaatccctcagagcaccctcagcgaattttaccctcgagactctgcaaagcattagctgctgcttctgcattgctccgcgctcttgtgaaatactggttctgttttctttattccttttgcactctcggttcccacctttgtgttggagtttaccatgttaccctgtaattaaaaacaaagaataggtaacatattgtgccagtgttgcaacgttttaaactgctaacagaccttaaaatatccccctacctgggtcctcagtgctatgtttaaagtgctgcagggatggagtggcgttttcttattgctgtatgtattgtacatagtggagtagttagttacctgataacagtcttgttatttgggtctcttagaccttacctctcaactccctcaagagtaccagtctctgaagttataatgctttggtctctacattaggggcaagatccagtctgagagaagtctcctttgagaagggccaagaggctctttcctgagtgtttgctttcggtttgttggtatgcctgtattgctgggctgtgctgctgctcgaagcagatggttttgactgtctttttgctctttcctatataatgaatagatgagtgaaaggagttttctttttctctttagtacttacgtattgggattcctgtgtcttacagctctccctctccaaataatacacagaatcctgcaactttttgcacagctggtatctgtctggtagcagtgagaccccttgtcttggtgatccttactgggtttccaagcagaggagtcacatgattacaattgccagtagagttgttgtttggggtacaagatgagaagaaagaaaaacctacagcctttctacattctgacatgctaacagtggtttaagtttctaaagtgtttaccagatgctgaaggcaaggggagggagcagaagcacttatgtttacggatattttaaactctgttagagagcagcctttgaaaatccccaatttggttctgctttttgacctctctctaccttttcagggtaatctttgtggcacaaacgatagcatttccaagctttagagttttctgaattcctgcgccttcctgacgtgagccctgagcgatcttctatgcagttctgccatgcgtcctgttggtctctctgtgttctttgttacttgggtgcaatagcaacttccctaccccgtgcattccatctttcatgttgtgtaaagttcttcacttttttctctgagggctgggggttgggggagtcagcatgattatattttaatgtagaaaatgtgacatctggatataaaatgaaaataaatgttaaattaaatggaccttaactaaa

SEQ ID NO: 109930 - DNA, 649 bp, Homo sapiens
  Payload ID: 1578
  Gene Symbol: ATP6V1B2
  Gene Name: ATPase, H+ transporting, lysosomal 56/58kDa, V1 subunit B2
  ENST ID: ENST00000520830
  CDS Start-End: 1-169
gcgggggattgtcaacggggccgcacccgagctacccgtgcccaccggtgggccggcggtgggagctcgggagcaggcgctggcagtcagtcggaactacctctcccagcctcgcctcagctatacaatttctccaatttcctttgtgacttttgtcacttctgcgtaacattaaggattccctttcctcatctacttagctaaatgctgcgtcctctataaagtttttacttttctccctgagcatacaagacagtatctggagtcaatggtccactagtgatcttagatcatgttaagtttcccaggtatgctgaaattgtccatttgaccttaccggatggcacaaagagaagtgggcaagttctggaagttagtggttccaaggcagtagttcaggtatttgaagggacttcaggtatagatgctaagaaaacgtcctgtgagtttactggggatattctccgaacaccggtgtctgaggatatgcttggtcgggtattcaatggatcgggaaaacccattgacagaggtcctgttgtactggccgaagacttccttgatatcatgggtcagccaatcaaccctcaatgtcgaatctacccagaggaaatgattcagactggcatttcggccatcgatgggatga

SEQ ID NO: 109931 - DNA, 572 bp, Homo sapiens
  Payload ID: 1578
  Gene Symbol: ATP6V1B2
  Gene Name: ATPase, H+ transporting, lysosomal 56/58kDa, V1 subunit B2
  ENST ID: ENST00000523478
  CDS Start-End: 4-204
aagatggcgctgcgggcgatgcgggggattgtcaacggggccgcacccgagctacccgtgcccaccggtgggccggcggtgggagctcgggagcaggcgctggcagtcagtcggaactacctctcccagcctcgcctcacatacaagacagtatctggagtcaatggtccactagtgatcttagatcatgttaaggtatgctgaaattgtccatttgaccttaccggatggcacaaagagaagtgggcaagttctggaagttagtggttccaaggcagtagttcaggtatttgaagggacttcaggtatagatgctaagaaaacgtcctgtgagtttactggggatattctccgaacaccggtgtctgaggatatgcttggtcgggtattcaatggatcgggaaaacccattgacagaggtcctgttgtactggccgaagacttccttgatatcatgggtcagccaatcaaccctcaatgtcgaatctacccagaggaaatgattcagactggcatttcggccatcgatgggatgaacagtattgctagggggcagaaaattcctatcttct

SEQ ID NO: 109932 - DNA, 670 bp, Homo sapiens
  Payload ID: 1578
  Gene Symbol: ATP6V1B2
  Gene Name: ATPase, H+ transporting, lysosomal 56/58kDa, V1 subunit B2
  ENST ID: ENST00000519667
  CDS Start-End: 1-598
cggggccgcacccgagctacccgtgcccaccggtgggccggcggtgggagctcgggagcaggcgctggcagtcagtcggaactacctctcccagcctcgcctcacatacaagacagtatctggagtcaatggtccactagtgatcttagatcatgttaagtttcccaggtatgctgaaattgtccatttgaccttaccggatggcacaaagagaagtgggcaagttctggaagttagtggttccaaggcagtagttcaggtatttgaagggacttcaggtatagatgctaagaaaacgtcctgtgagtttactggggatattctccgaacaccggtgtctgaggatatgcttggtcgggtattcaatggatcgggaaaacccattgacagaggtcctgttgtactggccgaagacttccttgatatcatgggtcagccaatcaaccctcaatgtcgaatctacccagaggaaatgattcagactggcatttcggccatcgatgggatgaacagtattgctagggggcagaaaattcctatcttctctgctgctgggctaccacacaatgaggtgaggactgggatcggtttgctatgaagtttagcagacaagaatttctataatgcatcactgttactgagaaaccgaataaagggttttcaaaataaa

SEQ ID NO: 109933 - DNA, 738 bp, Homo sapiens
  Payload ID: 1578
  Gene Symbol: ATP6V1B2
  Gene Name: ATPase, H+ transporting, lysosomal 56/58kDa, V1 subunit B2
  ENST ID: ENST00000521442
  CDS Start-End: 1-148
gcaagccatgaaagctgtcgttggagaagaagcccttacctcagatgatcttctctacttggaatttctgcagaagtttgagaggaacttcattgctcagggtgtctcactttgtcgcccaggctggagtacagtggtgcgatcttgactgactgcaacctgcaacctctgcctccggactcaagcgattctcttgccttagcctcctgagtagctgggattacaggagaccccaggaactgaagtggcaagggtgaatcctgtgagacgatgaggaatgagaccaggctgaagtgtgagatgcagtagccctcctccacctccaccagaaggcaggggtggaataagagctgaaagacggagtctcattctgtcgcccaggctggagtgagtggcgtgatctcagctcactgcaacctccatctcccaggttcaagtgattctcatgcctcagcctctcgagtagctggaatgataggcgcgcaccgccatgcctggcgaatttttgtgtttttagtagagacggggtttcaccatgttggccaggctggtcttgaattcctgacctcaagtgatccactcttctcgacctcccaaagtgttgggattataggcgtgagccaccgcgcccggcctgttctggatatttcttataaatggaatcatacagtgcttctttcagttagcataatgtttcccaggttcatccaggtcataacacataatcaggcttcattt

SEQ ID NO: 109934 - DNA, 4591 bp, Homo sapiens
  Payload ID: 1579
  Gene Symbol: ATP6V1A
  Gene Name: ATPase, H+ transporting, lysosomal 70kDa, V1 subunit A
  Uniprot ID: P38606
  ENST ID: ENST00000273398
  CDS Start-End: 109-1962
cccccccccaacctgtgcagctgaggacttcccctccgtggtgacagcctctgggtcctcggtcggtacagtctctgcacctcgcgccccagcaggtaaactaacattatggatttttccaagctacccaaaatactcgatgaagataaagaaagcacatttggttatgtgcatggggtctcaggacctgtggttacagcctgtgacatggcgggtgcagccatgtatgagctggtgagagtgggccacagcgaattggttggagagattattcgattggagggtgacatggctactattcaggtgtatgaagaaacttctggtgtgtctgttggagatcctgtacttcgcactggtaaacccctctctgtagagcttggtcctggcattatgggagccatttttgatggtattcaaagacctttgtcggatatcagcagtcagacccaaagcatctacatccccagaggagtaaacgtgtctgctcttagcagagatatcaaatgggactttacaccttgcaaaaacctacgggttggtagtcatatcactggcggagacatttatggaattgtcagtgagaactcgcttatcaaacacaaaatcatgttacccccacgaaacagaggaactgtaacttacattgctccacctgggaattatgatacctctgatgttgtcttggagcttgaatttgaaggtgtaaaggagaagttcaccatggtgcaagtatggcctgtacgtcaagttcgacctgtcactgagaagctgccagccaatcatcctctgttgactggccagagagtccttgatgccctttttccgtgtgtccagggaggaactactgctatccctggagcctttggctgtggaaagacagtgatatcacagtctctatccaagtattctaacagtgatgtaatcatctatgtaggatgtggtgaaagaggaaatgagatgtctgaagtcctccgggacttcccagagctcacaatggaggttgatggtaaggtagagtcaattatgaagaggacagctttggtagccaatacctccaatatgcctgttgctgctagagaagcctctatttatactggaatcacactgtcagagtacttccgtgacatgggctatcatgtcagtatgatggctgactctacctctagatgggctgaggcccttagagaaatctctggtcgtttagctgaaatgcctgcagatagtggatatccagcctatcttggtgcccgtctggcctcgttttatgaacgagcaggcagggtgaaatgtcttggaaatcctgaaagagaagggagtgtcagcattgtaggagcagtttctccacctggtggtgatttttctgatccagttacatctgccactcttggtatcgttcaggtgttctggggcttagataagaaactagctcaacgtaagcatttcccctctgtcaattggctcatcagctacagcaagtatatgcgtgccttggatgaatactatgacaaacacttcacagagttcgttcctctgaggacgaaagctaaggaaattctgcaggaagaagaagacctggcagaaattgtacagcttgtgggaaaggcttctttggcagaaacagataaaatcactctggaggtagcaaaacttatcaaagatgatttcctacaacaaaatggatatactccttatgacaggttctgcccattctacaagacagtagggatgctgtccaacatgattgcattttatgatatggctcgtagagctgttgaaaccactgcccagagtgacaataaaatcacatggtccattattcgtgagcacatgggagacatcctctataaactttcctccatgaaattcaaggatccactgaaagatggtgaggcaaagatcaaaagcgactatgcacaacttcttgaagacatgcagaatgcattccgtagccttgaagattagaagccttgaagattacaactgtgatttccttttcctcagcaagctcctatgtgtatattttcctgaatttctcatctcaaaccctttgcttctttattgtgcagctttgagactagtgcctatgtgtgttatttgtttccctgtttttttggtaggtcttatataaaacaaacattcctttgttctagtgttgtgaagggcctccctcttcctttatctgaagtggtgaatatagtaaatatacattctggttacactactgtaaacttgtatgtagggtgatgaccctctttgtcctaggtgtaccctttcctcatctctattaaattgtaaacaggactactgcatgtactctctttgcagtgaatttggaatggaaggccaggtttctataacttttgaacaggtactttgtgaaatgactcaatttctattgtggtaagctcattggcagcttagcattttgcaaaggaattgctttgcaggaaatatttaattttcaaaaacataatgattaatgttccaattatgcatcacttcccccagtataaatcaggaatgtttgtgagaaaccattgggaactatactctttttatttttattttttattttttttattattttttttttggggacggagtgtccctcttgttgcccaggctggagtgcaatggcgtgatcttggctcactgcagccttcgcctcccgggttcaagtgattctcctgcctcagcctcccgagtagctgggattacaggcatgctccaccatgcccagctaattttgtatttttagtagaaacggggtttcaccatattggtcaggctggtctcgaactccagacctcaggtgatccgcccacctcggcctcccaaactgctgggattacaggcgtgagccaccgcgcctggccagggactatactctttttaaaatagacatttgtggggctcacacaatatatgaaatagtaccctctaaaaaagagaaaaaaaaaatcaggcggtcaaacttagagcaacattgtcttattaaagcatagtttatttcactagaaaaaatttaatatcaaggactattacatacttcattactaggaagttctttttaaaatgacacttaaaacaatcactgaaaacttgatccacatcacaccctgtttattttccttaaacatcttggaagcctaagcttctgagaatcatgtggcaagtgtgatgggcagtaaaataccagagaagatgtttagtagcaattaaaggctgtttgcacctttaaggaccagctgggctgtagtgattcctggggccagagtggcattatgtttttacaaaataatgacatatgtcacatgtttgcatgtttgtttgcttgttgaatttttgaacagccagttgaccaatcatagaaagtattactttctttcatatggtttttggttcactggcttaagaggtttctcagaatatctatggccacagcagcataccagtttccatcctaataggaatgaaattaattttgtatctactgataacagaatctgggtcacatgaaaaaaaatcattttatccgtcttttaagtatatgtttaaaataataatttatgtgtctgcatattgcagaacagctctgagagcaacagtttcccattaactctttctgaccaatagtgctggcaccgttgcttcctctttgggaagaggaaagggtgtgtgaacatggctaacaatcttcaaatacccaaattgtgatagcataaataaagtatttattttatgcctcagtatattattatttaattttttaggtaatgcctatctcttggtctattaaggaaagaagcaatcagtagagaattcaggatagttttgtttaaattcttgcagattacatgtttttacagtggcctgctattgaggaaaggtattcttctatacaacttgttttaacctttgagaacattgacagaaattatgcaatggtttgttgagatacggacttgatggtgctgtttaatcagtttgcttccaaagtggcctactcaagaggccctaagactggtagaaattaaaaggatttcaaaaactttctattcctttcttaaacctaccagcaaactaggattgtgatagcaatgaatggtatgatgaagaaagtttgaccaaatttgtttttttgttgttgttgttgttttgaatttgaaatcattcttattccctttaagaatgtttatgtatgagtgtgaagatgctagcgaacctatgctcagatattcatcgtaagtctcccttcacctgttacagagtttcagatcggtcactgatagtatgtatttctttagtaagaatgtgttaaaattacaatgatcttttaaaaagatgatgcagttctgtatttattgtgctgtgtctggtcctaagtggagccaattaaacaagtttcatatgtatttttccagtgttgaatctcacacactgtactttgaaaatttccttccatcctgaataacgaatagaagaggccatatatattgcctccttatccttgagatttcactacctttatgttaaaagttgtgtataattgttaaaatctgtgaaagaataaaaagtggatttaaattaa

SEQ ID NO: 109935 - DNA, 710 bp, Homo sapiens
  Payload ID: 1579
  Gene Symbol: ATP6V1A
  Gene Name: ATPase, H+ transporting, lysosomal 70kDa, V1 subunit A
  ENST ID: ENST00000496747
  CDS Start-End: 157-710
aggacttcccctccgtggtgacagcctctgggtcctcggtcggtacagtctctgcacctcgcgccccagcagctacccaaaatactcgatgaagataaagaaagcacatttggttatgtgcatggggtctcaggacctgtggttacagcctgtgacatggcgggtgcagccatgtatgagctggtgagagtgggccacagcgaattggttggagagattattcgattggagggtgacatggctactattcaggtgtatgaagaaacttctggtgtgtctgttggagatcctgtacttcgcactggtaaacccctctctgtagagcttggtcctggcattatgggagccatttttgatggtattcaaagacctttgtcggatatcagcagtcagacccaaagcatctacatccccagaggagtaaacgtgtctgctcttagcagagatatcaaatgggactttacaccttgcaaaaacctacgggttggtagtcatatcactggcggagacatttatggaattgtcagtgagaactcgcttatcaaacacaaaatcatgttacccccacgaaacagaggaactgtaacttacattgctccacctgggaattatgatacctctgatgttgtcttggagcttgaatttgaaggtgtaaaggagaagttcaccatggtgcaagtatggcctgtacgtcaagttcgacctgtcac

SEQ ID NO: 109936 - DNA, 754 bp, Homo sapiens
  Payload ID: 1579
  Gene Symbol: ATP6V1A
  Gene Name: ATPase, H+ transporting, lysosomal 70kDa, V1 subunit A
  ENST ID: ENST00000475322
  CDS Start-End: 92-754
ccctccgtggtgacagcctctgggtcctcggtcggtacagtctctgcacctcgcgccccagcaggtgagcggcgaccggtaaactaacattatggatttttccaagctacccaaaatactcgatgaagataaagaaagcacatttggttatgtgcatggggtctcaggacctgtggttacagcctgtgacatggcgggtgcagccatgtatgagctggtgagagtgggccacagcgaattggttggagagattattcgattggagggtgacatggctactattcaggtgtatgaagaaacttctggtgtgtctgttggagatcctgtacttcgcactggtaaacccctctctgtagagcttggtcctggcattatgggagccatttttgatggtattcaaagacctttgtcggatatcagcagtcagacccaaagcatctacatccccagaggagtaaacgtgtctgctcttagcagagatatcaaatgggactttacaccttgcaaaaacctacgggttggtagtcatatcactggcggagacatttatggaattgtcagtgagaactcgcttatcaaacacaaaatcatgttacccccacgaaacagaggaactgtaacttacattgctccacctgggaattatgatacctctgatgttgtcttggagcttgaatttgaaggtgtaaaggagaagttcaccatggtgcaagtatggcctgtacgtcaagttcgacctgtcactgagaagctg

SEQ ID NO: 109937 - DNA, 2266 bp, Homo sapiens
  Payload ID: 1579
  Gene Symbol: ATP6V1A
  Gene Name: ATPase, H+ transporting, lysosomal 70kDa, V1 subunit A
  ENST ID: ENST00000470455
  CDS Start-End: 91-240
agctgaggacttcccctccgtggtgacagcctctgggtcctcggtcggtacagtctctgcacctcgcgccccagcaggtaaactaacattatggatttttccaagctacccaaaatactcgatgaagataaagaaagcacatttggttatgtgcatggggtctcaggacctgccttcactccatgtatcatagcaactctcagaacatacctgaatcctaccagtggttacagcctgtgacatggcgggtgcagccatgtatgagctggtgagagtgggccacagcgaattggttggagagattattcgattggagggtgacatggctactattcaggtgtatgaagaaacttctggtgtgtctgttggagatcctgtacttcgcactggtaaacccctctctgtagagcttggtcctggcattatgggagccatttttgatggtattcaaagacctttgtcggatatcagcagtcagacccaaagcatctacatccccagaggagtaaacgtgtctgctcttagcagagatatcaaatgggactttacaccttgcaaaaacctacgggttggtagtcatatcactggcggagacatttatggaattgtcagtgagaactcgcttatcaaacacaaaatcatgttacccccacgaaacagaggaactgtaacttacattgctccacctgggaattatgatacctctgatgttgtcttggagcttgaatttgaaggtgtaaaggagaagttcaccatggtgcaagtatggcctgtacgtcaagttcgacctgtcactgagaagctgccagccaatcatcctctgttgactggccagagagtccttgatgccctttttccgtgtgtccagggaggaactactgctatccctggagcctttggctgtggaaagacagtgatatcacagtctctatccaagtattctaacagtgatgtaatcatctatgtaggatgtggtgaaagaggaaatgagatgtctgaagtcctccgggacttcccagagctcacaatggaggttgatggtaaggtagagtcaattatgaagaggacagctttggtagccaatacctccaatatgcctgttgctgctagagaagcctctatttatactggaatcacactgtcagagtacttccgtgacatgggctatcatgtcagtatgatggctgactctacctctagatgggctgaggcccttagagaaatctctggtcgtttagctgaaatgcctgcagatagtggatatccagcctatcttggtgcccgtctggcctcgttttatgaacgagcaggcagggtgaaatgtcttggaaatcctgaaagagaagggagtgtcagcattgtaggagcagtttctccacctggtggtgatttttctgatccagttacatctgccactcttggtatcgttcaggtgttctggggcttagataagaaactagctcaacgtaagcatttcccctctgtcaattggctcatcagctacagcaagtatatgcgtgccttggatgaatactatgacaaacacttcacagagttcgttcctctgaggacgaaagctaaggaaattctgcaggaagaagaagacctggcagaaattgtacagcttgtgggaaaggcttctttggcagaaacagataaaatcactctggaggtagcaaaacttatcaaagatgatttcctacaacaaaatggatatactccttatgacaggttctgcccattctacaagacagtagggatgctgtccaacatgattgcattttatgatatggctcgtagagctgttgaaaccactgcccagagtgacaataaaatcacatggtccattattcgtgagcacatgggagacatcctctataaactttcctccatgaaattcaaggatccactgaaagatggtgaggcaaagatcaaaagcgactatgcacaacttcttgaagacatgcagaatgcattccgtagccttgaagattagaagccttgaagattacaactgtgatttccttttcctcagcaagctcctatgtgtatattttcctgaatttctcatctcaaaccctttgcttctttattgtgcagctttgagactagtgcctatgtgtgttatttgtttccctgtttttttggtaggtcttatataaaacaaacattcctttgttctagtgttgtgaagggcctccctcttcctttatctgaagtggtgaatatagtaaatatacattctggttacactactgtaaacttg

SEQ ID NO: 109938 - DNA, 773 bp, Homo sapiens
  Payload ID: 1580
  Gene Symbol: ATP6V0E1
  Gene Name: ATPase, H+ transporting, lysosomal 9kDa, V0 subunit e1
  ENST ID: ENST00000265093
  CDS Start-End: 46-243
tccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaagacaaacaagactccagtggggtggtcagtaggagagcacgttcagagggaagagccatctcaacagaatcgcaccaaactatactttcaggatgaatttcttctttctgccatcttttggaataaatattttcctcctttctatggaaa

SEQ ID NO: 109939 - DNA, 502 bp, Homo sapiens
  Payload ID: 1580
  Gene Symbol: ATP6V0E1
  Gene Name: ATPase, H+ transporting, lysosomal 9kDa, V0 subunit e1
  Uniprot ID: O15342
  ENST ID: ENST00000517669
  CDS Start-End: 31-276
ggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtgactatgcttgtgacctttcttatcagtatggtcaggcagtcagagtttgccttgactttttctcacattttatggccattttaacacgtggcaagggcaagctgctgaatgcaaacacgatctgaagagcagaaataaaattggaacttaagccttagcttacctaaatctcattaagattcttttt

SEQ ID NO: 109940 - DNA, 1433 bp, Homo sapiens
  Payload ID: 1580
  Gene Symbol: ATP6V0E1
  Gene Name: ATPase, H+ transporting, lysosomal 9kDa, V0 subunit e1
  Uniprot ID: O15342
  ENST ID: ENST00000519374
  CDS Start-End: 105-350
gggaggcggggcttgcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaagacaaacaagactccagtggggtggtcagtaggagagcacgttcagagggaagagccatctcaacagaatcgcaccaaactatactttcaggatgaatttcttctttctgccatcttttggaataaatattttcctcctttctatggaaatctgggctcggtgtttgtaaagttcatttttataagcttttctatcgctacataatgcctttttaaaaaatgattttgtagtctaaacttaggttgagtatataaaccctgccatgtagcttgagatgcctgaaaagactggtaagtgcgtttcttaatcgttcagtaactatttgagtgcctactgcagccaaggcactggagggatcaaagatgtgtaaatttggagtccctgcaagttcacaagctatttggagagataaggttagtatacatagaactgtaatataaggttgtgttggagcattgtccttaaagatggtaccatggtgagcagttcaaggttacctgccagctgcagaacaaggcagcaaatgctcctgagatggaaccatcacagcctcagacataggactaaagaagtcaagagtgattaaaaagccaggggcaggagacagtaattttgtatttcagtagcaggcatctcgatacactaatttgagagctttattacttttaagaaattaaaaattaaaatgaacctaaattttca

SEQ ID NO: 109941 - DNA, 718 bp, Homo sapiens
  Payload ID: 1580
  Gene Symbol: ATP6V0E1
  Gene Name: ATPase, H+ transporting, lysosomal 9kDa, V0 subunit e1
  ENST ID: ENST00000519911
  CDS Start-End: 81-257
gtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttgtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaagacaaacaagactccagtggggtggtcagtaggagagcacgttcagagggaagagccatctcaacagaatcgcaccaaactatactttcaggatgaatttcttctttctgccatcttttggaataaatattttcctcctttc

SEQ ID NO: 109942 - DNA, 2099 bp, Homo sapiens
  Payload ID: 1581
  Gene Symbol: ATP6AP1
  Gene Name: ATPase, H+ transporting, lysosomal accessory protein 1
  Uniprot ID: Q15904
  ENST ID: ENST00000369762
  CDS Start-End: 62-1474
gggggcaacggtcacctgatctgcggctgtcgaggccgctgaggcagtggaggctgaggctatgatggcggccatggcgacggctcgagtgcggatggggccgcggtgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccagctctggtctgatggcacccagggaagtcctcacaggcaacgatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgc

SEQ ID NO: 109943 - DNA, 720 bp, Homo sapiens
  Payload ID: 1581
  Gene Symbol: ATP6AP1
  Gene Name: ATPase, H+ transporting, lysosomal accessory protein 1
  ENST ID: ENST00000449556
  CDS Start-End: 31-720
gaggccgctgaggcagtggaggctgaggctatgatggcggccatggcgacggctcgagtgcggatggggccgcggtgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccagctctggtctgatggcacccagggaagtcctcacagatgaggtcatcgggcaggtcctgagcacactcaagtccgaagatgtcccatacacagcggccctcacagcggtccgcccttccagggtggcccgtgat

SEQ ID NO: 109944 - DNA, 4515 bp, Homo sapiens
  Payload ID: 1581
  Gene Symbol: ATP6AP1
  Gene Name: ATPase, H+ transporting, lysosomal accessory protein 1
  ENST ID: ENST00000455205
  CDS Start-End: 1-400
ggcggccatggcgacggctcgagtgcggatggggccgcggtgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaaggtgcgcccgccccagcccactctcccccggtcatcgggaggcagccaggccccctccccccatgacactgacgcccattccccaagggaagcttcagtgaccttgtcccaactgtagggaggtgtgggtcgtctcatgggaaggcctgtagtaaacgcttcagtgggcatggcgacagcctcggaaatggcaccaacttgattggaggaagcgacggaccagaggccaggtacctactgagtaccaagcactttggatatctgacttagtccaatatggtgggtggggattatcgtccctgtttgtttatagatgagaagactgaggctggaggttaagtgacttgtccaagctcatacagctaatgggtggcagagttgtaattctagctgtgatgatcataataatgataattggaaaatgctcacctgtttagtgctttgtaggcacttgctacactgatgtcattatcttggtttcactgccaaggaaagtaaggtttgtcgagatacaatgtttcactacagttgatagataccactttggttccagcctgagtctgccaatcctccctcccaattggagctcataacccgcatgctgttttccttcccatccaggatctttgccccaaaagcaggcgtggagaccatgagatgactctaagatagcaagtctctgctaggccctcccttgttggtggcctgtatggctcattgcccttgtagtctcccttggttgctgtgtgggcagatggtggtggcctgaagtcttttcaggaggtggtaaataatatagtcaaataggaactgagtcctagttctaccatgtaaccagccattggaggcatgaaataatctttgtgaatgacagtttctacatctgtaaaatgaagacaccacctatatcagagggctgtgagtgggaaatcttttttttttttttttttgagacggagtctcgctctgttgcccaggctggaatgcagtggtgcaatgtcagctcagctcactgcaccctccgcctcccgggttcaagcagttctctgcctcagcctcccgagtagctaggattacagggcgcccgccactacacccagctaatttttgtatttttttgtatttttagtagagatggggtttcaccatgttggccaggctggtcttgaactcctgacctcgtgatccacccacctcagcctcccaaactgctgggattacaggcgtgagccaccgcgcccggcctgtgagggggaattcttataatccacataaaacatctagccaggatcccccagtcttagggcattcacccattcattcatttgcccaatatggaaagcctactatgtgccaggtattgtgaagtgttggggatatggcagtgagcagaagaacccaagcccccaccctcaggaagctgacattcttgtgagggtggccagtaaatactaagtcggtataggatatgatgtcagtgttacggcctttagggaaggaagcaggctaaggggacagagtgactgggatgctattttagataagggtggtcaggccaggcctcattgaggaggtgatatatgagcagcgatcttaatggagggagggagccgtttggggaaggacattcctggaacagcaaatgcgagggtcctgggcgaggtgtgctcttggccagctcaaggaagagctggtgtggctggagcacagtgagtgagagaaaggggtaggagatgtaggagatggtttgcaggtggctaggcgatgaagtaggaccttgtaggccatgagggggaaggtcagttgcagttcgaaatgtgtgagaaagccttgggtaacgtggagcagggagtggtgtgatttctcaattaaagaaagcccacaggacccaccagcagttcctgggctttccgactgagaaccccggtggccaaacagcagcaaggtcctgcccacaagggaggggaggctgggcgagtgtgtataccaaacaggttagggaagctgattaaaatctcctcagggcctaactgggaagggccagaggaagctggggatgggagtggagggtaggagcaaaaggacaaaggacatctgtaggttgtggagaaaaagggatggggtcggggccactgtggtcctaagagctcaaaagacttcaatgctcgatgcttcctccagcatgttctgagatcctcacctctccccttccgccaaaagcaggtggggggagggtcccgtccagactggacatagccgactctccttttctctggctgggaggcctgccacaaatgctcttggctgccccaccccctccccgcagcttccctgttccctccccagttcctcttgtctgtagggtgggcaaggcggctgactcctactcctgagttaccacaagtcagctgcctgcagatctccccaccccatgactgccttccatgtcttctcaccctgccctgagagtgctggagggaagagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccagctctggtctgatggcacccagggaagtcctcacaggcaacgatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatg

SEQ ID NO: 109945 - DNA, 867 bp, Homo sapiens
  Payload ID: 1581
  Gene Symbol: ATP6AP1
  Gene Name: ATPase, H+ transporting, lysosomal accessory protein 1
  ENST ID: ENST00000422890
  CDS Start-End: 49-867
acctgatctgcggctgtcgaggccgctgaggcagtggaggctgaggctatgatggcggccatggcgacggctcgagtgcggatggggccgcggtgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagccccttgcatgtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggttcattctggccaaccgcctctacccagtgtctgcccggcactggtttaccatggagcgcctcgaagtccacagcaatggctccgtcgcctacttcaatgcttcc

SEQ ID NO: 109946 - DNA, 604 bp, Homo sapiens
  Payload ID: 1581
  Gene Symbol: ATP6AP1
  Gene Name: ATPase, H+ transporting, lysosomal accessory protein 1
  ENST ID: ENST00000439372
  CDS Start-End: 7-411
gaggctatgatggcggccatggcgacggctcgagtgcggatggggccgcggtgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaaggtgcgcccgccccagcccactctcccccggtcatcgggaggcagccaggccccctccccccatgacactgacgcccattccccaagggaagcttcagtgaccttgtcccaactgtagggaggtgtgggtcgtctcatgggaaggcctgtagtaaacgcttcagtgggcatggcgacagcctcggaaatggcaccaacttgattggaggaagcgacggaccagaggccagttcctcttgtctgtagggtgggcaaggcggctgactcctactcctgagttaccacaagtcagctgcctgcagatctcccca

SEQ ID NO: 109947 - DNA, 769 bp, Homo sapiens
  Payload ID: 1581
  Gene Symbol: ATP6AP1
  Gene Name: ATPase, H+ transporting, lysosomal accessory protein 1
  ENST ID: ENST00000429585
  CDS Start-End: 1-387
gcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcc

SEQ ID NO: 109948 - DNA, 571 bp, Homo sapiens
  Payload ID: 1581
  Gene Symbol: ATP6AP1
  Gene Name: ATPase, H+ transporting, lysosomal accessory protein 1
  ENST ID: ENST00000446552
  CDS Start-End: 5-409
ggctatgatggcggccatggcgacggctcgagtgcggatggggccgcggtgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaaggtgcgcccgccccagcccactctcccccggtcatcgggaggcagccaggccccctccccccatgacactgacgcccattccccaagggaagcttcagtgaccttgtcccaactgtagggaggtgtgggtcgtctcatgggaaggcctgtagtaaacgcttcagtgggcatggcgacagcctcggaaatggcaccaacttgattggaggaagcgacggaccagaggccagctgagcattgaggatttcacagcatatggcggtgtgtttggaaacaagca

SEQ ID NO: 109949 - DNA, 2823 bp, Homo sapiens
  Payload ID: 1581
  Gene Symbol: ATP6AP1
  Gene Name: ATPase, H+ transporting, lysosomal accessory protein 1
  ENST ID: ENST00000619046
  CDS Start-End: 1354-2199
cctcaggaagctgacattcttgtgagggtggccagtaaatactaagtcggtataggatatgatgtcagtgttacggcctttagggaaggaagcaggctaaggggacagagtgactgggatgctattttagataagggtggtcaggccaggcctcattgaggaggtgatatatgagcagcgatcttaatggagggagggagccgtttggggaaggacattcctggaacagcaaatgcgagggtcctgggcgaggtgtgctcttggccagctcaaggaagagctggtgtggctggagcacagtgagtgagagaaaggggtaggagatgtaggagatggtttgcaggtggctaggcgatgaagtaggaccttgtaggccatgagggggaaggtcagttgcagttcgaaatgtgtgagaaagccttgggtaacgtggagcagggagtggtgtgatttctcaattaaagaaagcccacaggacccaccagcagttcctgggctttccgactgagaaccccggtggccaaacagcagcaaggtcctgcccacaagggaggggaggctgggcgagtgtgtataccaaacaggttagggaagctgattaaaatctcctcagggcctaactgggaagggccagaggaagctggggatgggagtggagggtaggagcaaaaggacaaaggacatctgtaggttgtggagaaaaagggatggggtcggggccactgtggtcctaagagctcaaaagacttcaatgctcgatgcttcctccagcatgttctgagatcctcacctctccccttccgccaaaagcaggtggggggagggtcccgtccagactggacatagccgactctccttttctctggctgggaggcctgccacaaatgctcttggctgccccaccccctccccgcagcttccctgttccctccccagttcctcttgtctgtagggtgggcaaggcggctgactcctactcctgagttaccacaagtcagctgcctgcagatctccccaccccatgactgccttccatgtcttctcaccctgccctgagagtgctggagggaagagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccagctctggtctgatggcacccagggaagtcctcacaggcaacgatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggctctcactgacctatgaacgactctttggtaccacagtgacattcaagttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatg

SEQ ID NO: 109950 - DNA, 2503 bp, Homo sapiens
  Payload ID: 1582
  Gene Symbol: ATP6AP1L
  Gene Name: ATPase, H+ transporting, lysosomal accessory protein 1-like
  Uniprot ID: Q52LC2
  ENST ID: ENST00000380167
  CDS Start-End: 1326-2000
taaattaaataattaaatagatgatttttacatactgtagagctatagagaaaatatagctggatgggtgatagtgacttggggatgggggtggctactctggatagggtagtttaaggtgacatctctgtgcagatgtagaatgggctagtgctttctaagaactgaaagatcagtgaagaaggggagcatagtgactgaggagtagtgtggcattagatggggtctgagagttacacaggaacatgtggagcctgtaggccatggtaaagcctttttctactcttctggtgatttaaagccattgtaaagttttgagcttgggagtaggtagcaaaataagatttatatttttatggggttactctggctgttgagaggagaaaaagacatgaatctgggaggccacttgggaagcaaggccatcagtgaagagaaagagtgggagaaaaaggtttgaggagagaaggtataggactttcactaaccttggaccatatatttgccaggaagaatgtaagttctccaacatcttcaaataaagaagtggttatgaggaatgatcagaataatggagatatgaaaccattccagaatttcacaacaataccaatcacacaggctctcaactacaatctgagcaaagaagggcatttagaaaaagaaccttggaatgcattcagccatcatggcccagttaatgtctccatcaatggaattccttgcattctcttctgggccaaaagaataatgattaaatttaagaatcaaacctggctggaccttacagacgagccatttggtcagaaggtaactgtggaccctgacaactcaaattgcagtgaagaaagtgctagaaaaaaaaagtaggctcctttgtataggaccctgacacacatctttgaggaagtatttactgtctaaaataaaggaacaagtcagaagttaacttcaaaaattgttggctgggcatggtggctcacgcctgtaatcccagcacttcgggaggccaagggagtggatcacctgaggtcaggagttggagacaagcctggccaacatggtgaaacctcgtctctactaaaatacaaaaattagccgggcgtggtggcaggtgcctgtaatcccagctactcaggaggctgagacaggagaattgcttgaacctgggaggtggaggttgtggtgagctgagatcgcgccattgctctccagcttgggtgacagagtgagtgagactccatctcaaaaaaaaaaaattgttatattttcccggcagttttcttctgaacctttttgctaattgtcggaataacttgtagaaaatgagactttggaaagcaagggttctcaaactcgttttgaaaacagcaaaggattccaggcttggtctcaactccaaatggttgtctttgaagcttggtgatgctggaaaccccagaagtcttgctataagattcatccttaccaattacaacaagttgtccatccagagttggtttagtttgcgccgagtcgagatcatttccaacaattcaatccaagcagtctttaacccaactggcgtatatgctccctctggttactcctaccgctgccaacgcgtgggcagcctgcagcaggaccaggccctcttgctgcccagcgacacggatgatgggtcgagcctgtgggaggtcacttttattgatttccagatccaaggttttgccatcaaggggggacgatttaccaaagcccaagactgcgcctcctccttctcgccagcttttctgatcggcctggcaatgtccctgatcctgctgctggtgttggcctatgccctgcacatgctcatctacctgcggtatctggaccaacaatatgatctcatcgcctctcctgcccacttctcgcagctgaaagctcgagacacagccgaagagaaggagctgctgaggagccagggggctgaatgctataaactgagaagccaacagatcagcaaaatctatgtttagcagcacaggctggcccccaccatgtccacagtgggctccgaaagttgtctctgttctgtgctatttgacttgtgaattacagattttcaccaaatggcttgattacaaaaaaaaagaaaaaacacaaaaaggaaatagataatgaattctttttgaaccatccactggcctacttaggtagacttggggcaatcaaaaaaggcatctcagggatcccacagagacaaatatgactgttagttgcctcaaagtaccctgaaagcaaaggggtatttcaagtacggaaaaagagagagagagaagaagaaggaggaggaggaggaggaggagaaggagaaggaggagcaggaggaagaggaggaggaggaggaaagggagggagggagggagagggagagagagagaaagattggcaacacagagaagggaaaacacacttggtcctccttgcctgtgccagtttggatgtgacaattatagaaataataaaccaagattatctg

SEQ ID NO: 109951 - DNA, 758 bp, Homo sapiens
  Payload ID: 1582
  Gene Symbol: ATP6AP1L
  Gene Name: ATPase, H+ transporting, lysosomal accessory protein 1-like
  Uniprot ID: Q52LC2
  ENST ID: ENST00000439350
  CDS Start-End: 56-730
tcccggcagttttcttctgaacctttttgctaattgtcggaataacttgtagaaaatgagactttggaaagcaagggttctcaaactcgttttgaaaacagcaaaggattccaggcttggtctcaactccaaatggttgtctttgaagcttggtgatgctggaaaccccagaagtcttgctataagattcatccttaccaattacaacaagttgtccatccagagttggtttagtttgcgccgagtcgagatcatttccaacaattcaatccaagcagtctttaacccaactggcgtatatgctccctctggttactcctaccgctgccaacgcgtgggcagcctgcagcaggaccaggccctcttgctgcccagcgacacggatgatgggtcgagcctgtgggaggtcacttttattgatttccagatccaaggttttgccatcaaggggggacgatttaccaaagcccaagactgcgcctcctccttctcgccagcttttctgatcggcctggcaatgtccctgatcctgctgctggtgttggcctatgccctgcacatgctcatctacctgcggtatctggaccaacaatatgatctcatcgcctctcctgcccacttctcgcagctgaaagctcgagacacagccgaagagaaggagctgctgaggagccagggggctgaatgctataaactgagaagccaacagatcagcaaaatctatgtttagcagcacaggctggcccccaccatgtcca

SEQ ID NO: 109952 - DNA, 2093 bp, Homo sapiens
  Payload ID: 1583
  Gene Symbol: ATP6AP2
  Gene Name: ATPase, H+ transporting, lysosomal accessory protein 2
  Uniprot ID: O75787
  ENST ID: ENST00000378438
  CDS Start-End: 159-1211
gtggagaaagcggcagctgtcccagcggaagcgacgaagggacgggacccgggagcctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtctgttgttttccgaaatggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagtgaacaaactggctctacccccaggcagtgtcatttcgtaccctttggagaatgcagttccttttagtcttgacagtgttgcaaattccattcactccttattttctgaggaaactcctgttgttttgcagttggctcccagtgaggaaagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctttattttgtgtgtgcctgtgatgtttttctagagtgaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacagctgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaaacatttttatttcagtaacttttccccctgtgtaagttactatggtttgtggtacaacttcattctatagaatattaagtggaagtgggtgaattctactttttatgttggagtggaccaatgtctatcaagagtgacaaataaagttaatgatgattccaaa

SEQ ID NO: 109953 - DNA, 609 bp, Homo sapiens
  Payload ID: 1583
  Gene Symbol: ATP6AP2
  Gene Name: ATPase, H+ transporting, lysosomal accessory protein 2
  ENST ID: ENST00000436783
  CDS Start-End: 1-609
gagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtctgttgttttccgaaatggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagtgaacaaactggctctacccccaggcagtgtcatttcgtaccctttggagaatagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagttgacctgctctttctttctgaactgcaagtgctacatgatatttcaagcttgctgtctcgtcataagcatcta

SEQ ID NO: 109954 - DNA, 728 bp, Homo sapiens
  Payload ID: 1583
  Gene Symbol: ATP6AP2
  Gene Name: ATPase, H+ transporting, lysosomal accessory protein 2
  ENST ID: ENST00000423649
  CDS Start-End: 1-728
gtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtctgttgttttccgaaatggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagtgaacaaactggctctacccccaggcagtgtcatttcgtaccctttggagaatgttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaat

SEQ ID NO: 109955 - DNA, 777 bp, Homo sapiens
  Payload ID: 1583
  Gene Symbol: ATP6AP2
  Gene Name: ATPase, H+ transporting, lysosomal accessory protein 2
  ENST ID: ENST00000447485
  CDS Start-End: 1-777
gtgtcccgccggcccgttccgtgtcgccccgcagtgctgcggccgccgcggcaccatggctgtgtttgtcgtgctcctggcgttggtggcgggacctttcttggccaggactcgcagtgggtaacctgtttcatcgtcctcgggctaccgtcatggtgatggtgaagggagtgaacaaactggctctacccccaggcagtgtcatttcgtaccctttggagaatgcagttccttttagtcttgacagtgttgcaaattccattcactccttattttctgaggaaactcctgttgttttgcagttggctcccagtgaggaaagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaac

SEQ ID NO: 109956 - DNA, 4110 bp, Homo sapiens
  Payload ID: 1584
  Gene Symbol: ATP6V0A1
  Gene Name: ATPase, H+ transporting, lysosomal V0 subunit a1
  Uniprot ID: Q93050
  ENST ID: ENST00000264649
  CDS Start-End: 132-2648
gtcgaagcgctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagaggccaattttgagaagattgaaaatgaactgaaggaaatcaacacaaaccaggaagctctgaagagaaacttcctggaactgaccgaattaaaatttatacttcgcaaaactcagcaattttttgatgaggctgaattgcatcatcagcagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactggcgactacgtgcacaagtctgtgtttatcattttcttccaaggcgatcagctgaaaaacagagtcaagaaaatctgtgaagggttccgagcctcactctatccctgtcctgagacaccacaggagaggaaggaaatggcttctggagtgaataccaggattgatgatctccaaatggttctgaatcaaacggaggatcaccgccagagggttctgcaggcagctgctaagaacatccgtgtctggttcatcaaagtgcggaagatgaaggccatctatcacaccctgaacctgtgcaacatagatgtgactcagaaatgcttgattgcagaggtctggtgccctgtcaccgaccttgactccatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagtttgactttggggacaccatggtccaccaggccatccacaccatcgagtactgcctgggctgcatctccaacactgcctcctacttgcggctctgggccctcagcctcgctcatgcgcagctgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactgggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcacatctagactttgagttccctgcatctgccaccgtagtttctagcaggagtagtggggggagtaatacagattcttccctagaaggggacactggtaacatgtcccactcttggattagcaggggtgggtccaggaagatgatatttgcgtcttttgcccacccccctggcattcagctggacccaactaggccatcatgagtggcttctccctgtcatccccaggggtcataggatatctacaccgcctttctgaccccaccctgcactcccatcctttcctctctccccgttcatgccctgcactacatagcacagccgggatgcttggaacagaggccttggctgctccgcagtgcacagggcttccctctctcggggttggcttcttcccaggccttgcatgggccctgcccacaagcacaccctcaggccgagggtgcagactgatgctcttccctgatggagaccctgagatcttccccacccccaatcatgatgtcttcagtgtgggactggggtcctcttggttctgcctgcagcctgcctggctccgcccctagtgccccctcctcaccacactggccccaggtctcaggaggggtgtcctgggcagggaaggtcagtgtcactgatggtttgctgtttggaagccattggcagggctgccgtgcatgtggctgtgagggctgcacagtcctgccaaggggcttcctccttgtcaccccgaaccttgtaatcgtgtgctggcgtggcagccctggctaagttaatccccaccgctttcagtggtagaaagaattccctgagtgggccaggctggtgccctcctcctaccctggcttttctgagtgagctgcctggagccctcatcccctctcccaggctgggctggccctgggcggggccactgtgtgctggcccactgtgacctgacccgaccttgtgcagcccccctgccctggtgtcctgggttttcgtgatgatctttgctctgtttccagtggggtttgaagcagagttcagggaaccctgcccaaggtcctcctgttcagacattcctatgttgaataaagtatgtttgacttccccggagaa

SEQ ID NO: 109957 - DNA, 4128 bp, Homo sapiens
  Payload ID: 1584
  Gene Symbol: ATP6V0A1
  Gene Name: ATPase, H+ transporting, lysosomal V0 subunit a1
  Uniprot ID: Q93050
  ENST ID: ENST00000343619
  CDS Start-End: 124-2637
gctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagaggccaattttgagaagattgaaaatgaactgaaggaaatcaacacaaaccaggaagctctgaagagaaacttcctggaactgaccgaattaaaatttatacttcgcaaaactcagcaattttttgatgagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactggcgactacgtgcacaagtctgtgtttatcattttcttccaaggcgatcagctgaaaaacagagtcaagaaaatctgtgaagggttccgagcctcactctatccctgtcctgagacaccacaggagaggaaggaaatggcttctggagtgaataccaggattgatgatctccaaatggttctgaatcaaacggaggatcaccgccagagggttctgcaggcagctgctaagaacatccgtgtctggttcatcaaagtgcggaagatgaaggccatctatcacaccctgaacctgtgcaacatagatgtgactcagaaatgcttgattgcagaggtctggtgccctgtcaccgaccttgactccatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagccttccgaggacgaagtgtttgactttggggacaccatggtccaccaggccatccacaccatcgagtactgcctgggctgcatctccaacactgcctcctacttgcggctctgggccctcagcctcgctcatgcgcagctgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactgggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcacatctagactttgagttccctgcatctgccaccgtagtttctagcaggagtagtggggggagtaatacagattcttccctagaaggggacactggtaacatgtcccactcttggattagcaggggtgggtccaggaagatgatatttgcgtcttttgcccacccccctggcattcagctggacccaactaggccatcatgagtggcttctccctgtcatccccaggggtcataggatatctacaccgcctttctgaccccaccctgcactcccatcctttcctctctccccgttcatgccctgcactacatagcacagccgggatgcttggaacagaggccttggctgctccgcagtgcacagggcttccctctctcggggttggcttcttcccaggccttgcatgggccctgcccacaagcacaccctcaggccgagggtgcagactgatgctcttccctgatggagaccctgagatcttccccacccccaatcatgatgtcttcagtgtgggactggggtcctcttggttctgcctgcagcctgcctggctccgcccctagtgccccctcctcaccacactggccccaggtctcaggaggggtgtcctgggcagggaaggtcagtgtcactgatggtttgctgtttggaagccattggcagggctgccgtgcatgtggctgtgagggctgcacagtcctgccaaggggcttcctccttgtcaccccgaaccttgtaatcgtgtgctggcgtggcagccctggctaagttaatccccaccgctttcagtggtagaaagaattccctgagtgggccaggctggtgccctcctcctaccctggcttttctgagtgagctgcctggagccctcatcccctctcccaggctgggctggccctgggcggggccactgtgtgctggcccactgtgacctgacccgaccttgtgcagcccccctgccctggtgtcctgggttttcgtgatgatctttgctctgtttccagtggggtttgaagcagagttcagggaaccctgcccaaggtcctcctgttcagacattcctatgttgaataaagtatgtttgacttccccggagaagctgcctgtcactgtgcccacagcccctg

SEQ ID NO: 109958 - DNA, 3028 bp, Homo sapiens
  Payload ID: 1584
  Gene Symbol: ATP6V0A1
  Gene Name: ATPase, H+ transporting, lysosomal V0 subunit a1
  Uniprot ID: Q93050
  ENST ID: ENST00000393829
  CDS Start-End: 168-2663
ggcggcgcaggggcggggctttacggacgcaagcacgtcgaagcgctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagaggccaattttgagaagattgaaaatgaactgaaggaaatcaacacaaaccaggaagctctgaagagaaacttcctggaactgaccgaattaaaatttatacttcgcaaaactcagcaattttttgatgagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactggcgactacgtgcacaagtctgtgtttatcattttcttccaaggcgatcagctgaaaaacagagtcaagaaaatctgtgaagggttccgagcctcactctatccctgtcctgagacaccacaggagaggaaggaaatggcttctggagtgaataccaggattgatgatctccaaatggttctgaatcaaacggaggatcaccgccagagggttctgcaggcagctgctaagaacatccgtgtctggttcatcaaagtgcggaagatgaaggccatctatcacaccctgaacctgtgcaacatagatgtgactcagaaatgcttgattgcagaggtctggtgccctgtcaccgaccttgactccatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagtttgactttggggacaccatggtccaccaggccatccacaccatcgagtactgcctgggctgcatctccaacactgcctcctacttgcggctctgggccctcagcctcgctcatgcgcagctgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactgggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcac

SEQ ID NO: 109959 - DNA, 2774 bp, Homo sapiens
  Payload ID: 1584
  Gene Symbol: ATP6V0A1
  Gene Name: ATPase, H+ transporting, lysosomal V0 subunit a1
  ENST ID: ENST00000537728
  CDS Start-End: 134-2500
acgtcgaagcgctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactggcgactacgtgcacaagtctgtgtttatcattttcttccaaggcgatcagctgaaaaacagagtcaagaaaatctgtgaagggttccgagcctcactctatccctgtcctgagacaccacaggagaggaaggaaatggcttctggagtgaataccaggattgatgatctccaaatggttctgaatcaaacggaggatcaccgccagagggttctgcaggcagctgctaagaacatccgtgtctggttcatcaaagtgcggaagatgaaggccatctatcacaccctgaacctgtgcaacatagatgtgactcagaaatgcttgattgcagaggtctggtgccctgtcaccgaccttgactccatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagtttgactttggggacaccatggtccaccaggccatccacaccatcgagtactgcctgggctgcatctccaacactgcctcctacttgcggctctgggccctcagcctcgctcatgcgcagctgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactgggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcct

SEQ ID NO: 109960 - DNA, 3047 bp, Homo sapiens
  Payload ID: 1584
  Gene Symbol: ATP6V0A1
  Gene Name: ATPase, H+ transporting, lysosomal V0 subunit a1
  ENST ID: ENST00000544137
  CDS Start-End: 138-1589
cggagggtgcgggtttggctgcggtggtttctgtggcggttgctgtggcggagtttggaggttggagagaaatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagccttccgaggacgaagtgtttgactttggggacaccatggtccaccaggccatccacaccatcgagtactgcctgggctgcatctccaacactgcctcctacttgcggctctgggccctcagcctcgctcatgcgcagctgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactgggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcacatctagactttgagttccctgcatctgccaccgtagtttctagcaggagtagtggggggagtaatacagattcttccctagaaggggacactggtaacatgtcccactcttggattagcaggggtgggtccaggaagatgatatttgcgtcttttgcccacccccctggcattcagctggacccaactaggccatcatgagtggcttctccctgtcatccccaggggtcataggatatctacaccgcctttctgaccccaccctgcactcccatcctttcctctctccccgttcatgccctgcactacatagcacagccgggatgcttggaacagaggccttggctgctccgcagtgcacagggcttccctctctcggggttggcttcttcccaggccttgcatgggccctgcccacaagcacaccctcaggccgagggtgcagactgatgctcttccctgatggagaccctgagatcttccccacccccaatcatgatgtcttcagtgtgggactggggtcctcttggttctgcctgcagcctgcctggctccgcccctagtgccccctcctcaccacactggccccaggtctcaggaggggtgtcctgggcagggaaggtcagtgtcactgatggtttgctgtttggaagccattggcagggctgccgtgcatgtggctgtgagggctgcacagtcctgccaaggggcttcctccttgtcaccccgaaccttgtaatcgtgtgctggcgtggcagccctggctaagttaatccccaccgctttcagtggtagaaagaattccctgagtgggccaggctggtgccctcctcctaccctggcttttctgagtgagctgcctggagccctcatcccctctcccaggctgggctggccctgggcggggccactgtgtgctggcccactgtgacctgacccgaccttgtgcagcccccctgccctggtgtcctgggttttcgtgatgatctttgctctgtttccagtggggtttgaagcagagttcagggaaccctgcccaaggtcctcctgttcagacattcctatgttgaataaagtatgtttgacttccccgg

SEQ ID NO: 109961 - DNA, 580 bp, Homo sapiens
  Payload ID: 1584
  Gene Symbol: ATP6V0A1
  Gene Name: ATPase, H+ transporting, lysosomal V0 subunit a1
  ENST ID: ENST00000589213
  CDS Start-End: 301-580
gtcattatcagtgtgttcctgtcatgcttgatttgaaattgagcttaatatgcaaactggttgctttttccagatgacggttatttgtttgaattcctaagtggggaaatattgttttctgaggaatctggaagattaaaccctttagtgtagccatagctttaggatagtgccagaactttgggcttttagaaatgcgcattgtcagtagaagggagaaggatagttacaaggcagacatctttatgagagggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggaca

SEQ ID NO: 109962 - DNA, 554 bp, Homo sapiens
  Payload ID: 1584
  Gene Symbol: ATP6V0A1
  Gene Name: ATPase, H+ transporting, lysosomal V0 subunit a1
  ENST ID: ENST00000587824
  CDS Start-End: 163-554
acgtcttcgagataaaatgggggttcgccccctccttgggcacccctcctctgccctgaggaaccggaggctcactgccctttggaagccccgcatctcttccctgctttaaggggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagaggccaattttgagaagattgaaaatgaactgaaggaaatcaacacaaaccaggaagctctgaagagaaacttcctggaactgaccgaattaaaatttat

SEQ ID NO: 109963 - DNA, 585 bp, Homo sapiens
  Payload ID: 1584
  Gene Symbol: ATP6V0A1
  Gene Name: ATPase, H+ transporting, lysosomal V0 subunit a1
  ENST ID: ENST00000592324
  CDS Start-End: 1-585
gctaacattccgattatggacaccggtgaaaacccagaggttcccttcccccgggacatgattgacttagaggccaattttgagaagattgaaaatgaactgaaggaaatcaacacaaaccaggaagctctgaagagaaacttcctggaactgaccgaattaaaatttatacttcgcaaaactcagcaattttttgatgagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactgtggagtctcactctgttgtccaggctagagtgcagtggcgcgatctcggctcaccacaacctccgcttcctgggttcaagcgattctcctgcctcagcctcccgagtagctggggattacagggcgactacgtgcacaagtctgtgtttatcattttcttccaaggcgatcag

SEQ ID NO: 109964 - DNA, 573 bp, Homo sapiens
  Payload ID: 1584
  Gene Symbol: ATP6V0A1
  Gene Name: ATPase, H+ transporting, lysosomal V0 subunit a1
  ENST ID: ENST00000588138
  CDS Start-End: 1-573
ccttggatgctgctgtttaaaccattggtccttcgccgtcagtatttgaggagaaagcatttggaagggcaacctgtggaggccccagtcagcccaaacccgagccaacagggactagaggcagcagcggctgcaacaggaactctcaactttggtgggatcagggtgggcaacggaccgacagaggaggatgctgagattattcagcatgaccagctctccacccactcagaggacgcagacgagccttccgaggacgaagtgtttgactttggggacaccatggtccaccaggccatccacaccatcgagtactgcctgggctgcatctccaacactgcctcctacttgcggctctgggccctcagcctcgctcatgcgcagctgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactgggttgagttccagaataaa

SEQ ID NO: 109965 - DNA, 2679 bp, Homo sapiens
  Payload ID: 1584
  Gene Symbol: ATP6V0A1
  Gene Name: ATPase, H+ transporting, lysosomal V0 subunit a1
  ENST ID: ENST00000585525
  CDS Start-End: 124-2508
gctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactggcgactacgtgcacaagtctgtgtttatcattttcttccaaggcgatcagctgaaaaacagagtcaagaaaatctgtgaagggttccgagcctcactctatccctgtcctgagacaccacaggagaggaaggaaatggcttctggagtgaataccaggattgatgatctccaaatggttctgaatcaaacggaggatcaccgccagagggttctgcaggcagctgctaagaacatccgtgtctggttcatcaaagtgcggaagatgaaggccatctatcacaccctgaacctgtgcaacatagatgtgactcagaaatgcttgattgcagaggtctggtgccctgtcaccgaccttgactccatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagccttccgaggacgaagtgtttgactttggggacaccatggtccaccaggccatccacaccatcgagtactgcctgggctgcatctccaacactgcctcctacttgcggctctgggccctcagcctcgctcatgcgcagctgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactgggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctag

SEQ ID NO: 109966 - DNA, 664 bp, Homo sapiens
  Payload ID: 1584
  Gene Symbol: ATP6V0A1
  Gene Name: ATPase, H+ transporting, lysosomal V0 subunit a1
  ENST ID: ENST00000589727
  CDS Start-End: 71-664
ggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacgccaattttgagaagattgaaaatgaactgaaggaaatcaacacaaaccaggaagctctgaagagaaacttcctggaactgaccgaattaaaatttatacttcgcaaaactcagcaattttttgatgagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactggcgactacgtgcacaagtctgtgtttatcattttcttccaaggcgatcagctgaaaaacagagtcaagaaaatctgtgaagggttccgagcctcactctatccctgtcctgagacaccacaggagaggaaggaaatg

SEQ ID NO: 109967 - DNA, 589 bp, Homo sapiens
  Payload ID: 1584
  Gene Symbol: ATP6V0A1
  Gene Name: ATPase, H+ transporting, lysosomal V0 subunit a1
  ENST ID: ENST00000588901
  CDS Start-End: 134-340
acgtcgaagcgctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgccaattttgagaagattgaaaatgaactgaaggaaatcaacacaaaccaggaagctctgaagagaaacttcctggaactgaccgaattaaaatttatacttcgcaaaactcagcaattttttgatgagatggcggatccagacttgttggaagagtcctcatccctcttggagccaagtgagatgggaagaggcactcctttaagacttggcttcgtggctggtgtcattaaccgggagcgcatccctacttttgagcg

SEQ ID NO: 109968 - DNA, 564 bp, Homo sapiens
  Payload ID: 1584
  Gene Symbol: ATP6V0A1
  Gene Name: ATPase, H+ transporting, lysosomal V0 subunit a1
  ENST ID: ENST00000587510
  CDS Start-End: 1-388
tttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgaggcccttgctccagcccagtggaagcattagtacctcttcctagcgggaactcagtccagctacacaccagagccaggccagtggttgtctgggaaatcttcaaaggccgtgaccactcagcaaggtttgactttggggacaccatggtccaccaggccatccacaccatcgagtactgcctgggctgcatctccaacactgcctcc

SEQ ID NO: 109969 - DNA, 881 bp, Homo sapiens
  Payload ID: 1584
  Gene Symbol: ATP6V0A1
  Gene Name: ATPase, H+ transporting, lysosomal V0 subunit a1
  ENST ID: ENST00000586201
  CDS Start-End: 1-567
gcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagccttccgaggacgaagtgtttgactttggggacaccatggtccaccaggccatccacaccatcgagtactgcctgggctgcatctccaacactgcctcctacttgcggctctgggccctcagcctcgctcatgcgcggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatctt

SEQ ID NO: 109970 - DNA, 6542 bp, Homo sapiens
  Payload ID: 1585
  Gene Symbol: ATP6V0A2
  Gene Name: ATPase, H+ transporting, lysosomal V0 subunit a2
  Uniprot ID: Q9Y487
  ENST ID: ENST00000330342
  CDS Start-End: 249-2819
gggggcggaaccggaaccggcagtggcttgggggcgggacctcgcggactgctgtggcggcagctggagcggcggccgcggtggcagaaccgggggcggccgctgcagtctggagccccatagtgcggggccgcggccaggccacaggaagagctcgaggcccgggccgcaccggctgagtgtgcgggcccgcgcggctcggagccgccgccgcccatcgagcccctccgggcgcgggtcggcccgccatggggtccctgttccggagcgagaccatgtgcctggcgcagctcttcctgcagtcgggcacggcctacgagtgcctcagcgccctgggcgagaaaggcctggtccagttccgagacctcaaccagaacgtaagttctttccaaagaaaatttgttggtgaggtgaagaggtgtgaagagctagagcgaatattggtgtatttggtacaggaaattaatagagctgatattccccttcctgaaggagaggccagccctcctgcgccacccctgaaacaggttctagaaatgcaggagcagttgcagaagctcgaggttgaactgagagaagtcactaagaacaaggagaaactgaggaaaaacttgctggaactgatagagtacactcacatgctgagagtgacaaagacctttgtgaaacgcaatgttgagtttgaacccacttatgaagaattcccttccttagagagtgattctttgttggattacagctgtatgcagaggctgggagcaaaactgggatttgtgtctggcctaattaaccaaggaaaagtggaagcatttgaaaaaatgttgtggagagtctgcaaagggtacaccatcgtgtcctatgcagaactggatgaatcccttgaagaccctgaaacaggggaagtcataaaatggtatgtctttttaatatccttttggggagagcagattggccacaaggttaagaagatatgtgattgctaccactgccacgtgtacccctatccaaacacagccgaggagcggagggagatccaggaggggctgaacacccgcatccaggatctctacactgtactgcacaaaaccgaggactatttgaggcaagtgctatgtaaagccgccgagtctgtctacagccgtgtgatccaggtgaagaaaatgaaggccatctatcacatgctgaacatgtgcagctttgacgtgaccaacaagtgcctcattgctgaggtctggtgtcccgaggcggatctgcaggacctgcgccgggcactggaggagggctcgagagagagtggtgctacaatcccctcattcatgaatataatccccacaaaagaaacaccccccactcggatccgcaccaacaaattcaccgagggatttcagaacatcgtggatgcttatggagtcggaagctacagagaagtcaatccagctctctttaccatcatcaccttcccgtttttatttgctgtgatgtttggagacttcggacatggctttgtgatgtttttatttgccctcttgttggtgttaaatgaaaatcatcccagactaaatcagtcacaagagatcatgaggatgttttttaatggccggtacatcctcctgctgatggggctgttctcagtgtacactggcctcatctacaacgactgcttttcaaagtcagtcaacctgttcggctctgggtggaacgtgtcggccatgtacagctccagccacccacccgcagagcataagaagatggtgctttggaatgacagcgtcgttagacacaacagcattttgcagctggatccaagcattcctggagtgttccgaggcccttatccccttggcattgatcctatttggaacttggccacaaatcgcctcacttttctaaactctttcaaaatgaaaatgtccgtgattttaggaatcattcatatgacttttggagtcattctgggaatatttaaccacttgcacttcaggaagaagttcaacatttacctggtttccatcccggaacttctcttcatgctctgtatctttggataccttatatttatgattttctacaagtggctggttttttcagcagaaacctccagagttgctcccagcattctgattgaatttattaacatgtttttattcccagccagtaaaacaagtggcctttacacagggcaggagtatgtccagagagtgctgctggttgtcacagcattgtctgtccctgtcctcttcttgggaaagccactgtttttgttgtggcttcacaatgggcgtagttgcttcggggtgaaccggagtggctacacacttataaggaaagatagtgaggaagaagtttcattgctgggaagccaagatatagaagagggaaatcaccaggtggaagatggatgtagagaaatggcgtgtgaagagtttaattttggagaaatattaatgacccaagtaatccattccatcgagtactgtctgggatgcatctccaacaccgcctcctacctgaggctctgggcgcttagcctggctcacgcacagttgtctgatgtcctgtgggccatgctgatgcgcgtgggcctccgcgttgacaccacctatggcgtcttgctactgctcccggttatcgcgctctttgcagttttgaccattttcatccttctgatcatggaagggctttctgcgtttcttcacgccatacgcctccactgggtagaatttcagaacaaattctacgttggtgcaggcaccaaatttgttcctttctcattcagtctactttcatcaaagttcaataacgacgacagtgtggcatgatcatattgctgtaaccaacaagctttcagatttatggagaatgaccatgttatagactttcacttatgtcagatttatgataggaaaaattccatcttcattactgccttatgacatagccaaataattctgtaagatatacctcttcctcatatgttaaatattttgtaaagtttaccaatttgagatataaaaatttcttttggttttttatgatgagcaaatataagttaatgccaaacgttatgttaaagttattttttcaaatacaggatttggggagagaagccaattttgcatggctagttgaaaatggtattagatacttatttcctttaaactttatttaaaacaaacaacagagttaatctgtcacctgaagttgccagataatattttccaacagctgaagtagggatagttttttaaaaaatttaatgatgggtaatcaaaacattcacatttattctgctggatttaaaaatatgtactttttttttttttttgagatgaagtcttgctgtgtcacgtaggctggagtgcaatggcacgatcgtgtctcattgcaacttccgcctcctggattcaggtgattctcctgtctcagcctcccgagtaactgggattacaggcatgcgccaccgtgaccagctaatttttttgtatttttgtagagatggggtttcaccatgttggccaggctggtctcgaacttctgacctcaagtgatccacctgcctcggcctccctaagtgctgggattacaggcgtgagccaccatgcctggccaaaatatgcaaatattttttatcctgtgctacctagaattacaagtagaggattgtttttacaattttgtcttgttttagtaattggggacaatgggataaaatgacatacaacaaatggttatcccacttgtatatttttttaaagactcttatcctgttacccttacataaaaccagttatgataattgtatgtttggaagataaattgtatgctgagccttaaaacccagtgtgactgtagaagatataatgcggacatgatttgaatttagtgacagcttggctgatgtcactgaaccagaagggtttatactgagtgaaggaaaggtaaaaagtagtattttgtatatttttgtaacaaaatataaatgaagatattttaccatgaagagattgcacttatccttgagaacagtctaaatataaatgaagatattttaccatgaagagattgcacttatccttgagaacagtctaatgatactttttttactttcagactgtttctagctaaagttctgataaaagtattgagttaatttaaactttcaaacactgtttagatcagttgaaaactaattcttaatagccattgttttataatctttagtttaaattcatctgtttgacatttggttttttgtgaacttgagtcagtcctattgaacattttgacctatattcttgcaaattatgttaatttttcatattttagtttgattttagacaattattttcaaaaagaaacctgactttttttcaccttcttgacattgtgagtgatacacgttaaaaggctatttgcccgcatcctcctctatcctgtttcgaggtagagagcttggcacttctgttacaagctgagagtctggaggtgctgagtttaacgtggctgtgcagctgatttcaaggcatgagctgaacagcgttgacacagccgtgacttacaattaaaccctttcaattacagtacagattctgtgtgctacttgatgagatgttacccaaggccagtttggacttactgctttttgtccctcatattaaattatcaaatgatgccgatgaaatgcttgaaaatgattctgctctcaaagttatgcttccctagaaaggtgtcatgtcgggcacttgtgttgggtgactatgacatcccagcagtgctggtcaggtctcagagttgctttcacctagagctgatgcttccacaaggggacatttgtgttactttgctccaggggtctgtcataaaaacaatggtaactacttcatccctaggaagcccaagacttcagggcactgttagctgattggtaaataagggacacgatattcacgggaattgtttactgctccccactagtaattctcatggggccacttttttaactctttctaattaacacctcttctcagcatagagcagaggatgcagtcatttctctgttgaaatctatgtagtatttatgtagaatgtcattatatgaaaagcgaattcagaatcctaactctgggaaagcgctctctggaaatgtagtttgataatagtgtcttataggggccacgggaatttgtttctctataaagcgatgggctccagtgtcatgttaccagagttatcgctcagttttgtttgttaaggcttttgctagaacctattatgtatccagtttttaaaacatacttcattcccttgatagcagagatccagagcacagatggcaagttgtgtggatgatactgaatatgtttattttcctaaagataaatgtcacgacacgacatttctcagtttttatttagatgtttattaccatgtgttaacagaatcttaaaacccaagggatttcttcagtaaactagactttgattcaacctgctgggctggagactgtaattgccgtggtcagttaaggagtgcaaagggtgttctgtctgataggatctgggtgagccctgcggactttccagcagcgaaaggacttggaactcctctttcgctgaatgctgctctgtttctggaatggatattttataacaacattctggtgtcagcatcccctcagcagttgtttatttaaaaatttttttattttttttgagacagtgtctcactctgtcacctaggctgaagtgcagtggtgcagtctcggctcactgcaacctctgcctcctgggtttaagcaattctcctgccctagcctcccgagtagctgggattacaggcgcctgccacagtgcccggctaatttttgtatttttagtagagacagggtttcaccatgttggccaggctggtctcaaactcctgacctcaggtgatctacccaccttggcctcccaaagtgctgggattacaggcgtgagccaccgcgcctggccctctgcagttgtttaataaggcacagaatacctgtagcataggtcagccttacgatgtccatgaattacatattcagacgttttagagcctgatacattttggaaaagaaaaacaacttctacacctattctacagtccgcatttaaaacaataaattcctctattaaaaacgtaaagccgggtttgcttgcgtgccacagggaatatatccaggaaggttattatgaagctgtcaaatcaagatgatgggaataaggcagtttgaacgaacagtcttcccacagtcaggccatttttgctgatttggtttagaattttcagaaatacttagtacactccacctgttctttgatgggaatatctaagaaggctaggtaggttcttagggttagcctgagtcatctaggggctcaactccttgtgaggggaaatgacagtgaacaagttagtactttgctccacaaatgcatgaaaggacaaatttgcatcttctatcagtatttaacttccttttgctaatgacaaataaatatatctatatttttaaa

SEQ ID NO: 109971 - DNA, 1013 bp, Homo sapiens
  Payload ID: 1585
  Gene Symbol: ATP6V0A2
  Gene Name: ATPase, H+ transporting, lysosomal V0 subunit a2
  ENST ID: ENST00000544833
  CDS Start-End: 409-825
gctctacttagaatgctcacatctagtgaatcgcagtctactcttagggttggtgaatacctattttatcagtagatgtttcataattactgagacctgccccagaatcccattagtatagcagctgtggccacggcagttcctctggtctaccttcttggtttacacaggggagtctgaggcgtgcggtgggagtggggctgatgaaggtggggatttggggtggtaaagtctggtcatggagctgggtagtggcagagtggtgaacagagtgcgtctggggtttctgttcctcacactctagcgtgttcttaccagcatccagccggcagctctttcattgtaatccttgaagtggaacccacttggcatgtagaagtacacatgtaacatcatgactcttaacatatgttgtgtgatctctctcagtttaattttggagaaatattaatgacccaagtaatccattccatcgagtactgtctgggatgcatctccaacaccgcctcctacctgaggctctgggcgcttagcctggctcacgcacagttgtctgatgtcctgtgggccatgctgatgcgcgtgggcctccgcgttgacaccacctatggcgtcttgctactgctcccggttatcgcgctctttgcagttttgaccattttcatccttctgatcatggaagggctttctgcgtttcttcacgccatacgcctccactgggtagaatttcagaacaaattctacgttggtgcaggcaccaaatttgttcctttctcattcagtctactttcatcaaagttcaataacgacgacagtgtggcatgatcatattgctgtaaccaacaagctttcagatttatggagaatgaccatgttatagactttcacttatgtcagatttatgataggaaaaattccatcttcattactgccttatgacatagccaaataattctgtaagatatacctcttcctcatatgttaaatattttgtaaagtttaccaatttgaga

SEQ ID NO: 109972 - DNA, 2525 bp, Homo sapiens
  Payload ID: 1585
  Gene Symbol: ATP6V0A2
  Gene Name: ATPase, H+ transporting, lysosomal V0 subunit a2
  ENST ID: ENST00000504192
  CDS Start-End: 1541-2525
taacagcagtcatctggattggcctgttcgatgggtcgcttgtgatgtaattacaaacatagtgatgactgtgtacagtgcttgtaaggcaaagcagaagtaatgaatatagtatattaagtgatttgtttgaatacaagttttcattgactcaatgatttgccttacggatttttgcttctgttattttaatacttaagtatttttaaggatgtttagtatgtaactaattattaaagattctcatgaatttttttttttttttgagacagagtcttgctctgtcgcccaggctagagtgcatgtagtggtgcgatctcggctcactgcagcctgtgcctcccgggttcaagcaattctcctgcctcagcctcccaagtagctgggattataggcacgtgccaccatgcctggctaatttttgtatttttagtagagatggggttttaccatcttggccaggctggtctcgaactcctgacctcgtgatccacccaccttggcttcccaaagtgctgggattacaggcgtgagccaccacgcctggccaattgtcatgaatttttatcctcaattaattgtgtaaatgtgagtgcatagtaactcatatgctagagactaggaaaataagttagaaaagattatctaaatatattctgtgttgcaaaaaaaggaaatgtagacttaaagaggaagagtctttgatgtgtgatatgaataagcagacaaaggaaatccgagaaatgacagcacctgtggttagagacgagggccagtcttgggggtctcacgctcatcacagccttcggaatgttttagctaatatgtggtgtgaacttcacagaaattacctgaattaatatgaaacaataaatgagcctatttatttatttactttgagaaggagtcttgctctgtcacccaagctggagtgcagtgacacgatcttggctcactgcaacctccatctcctgggttcacgtgattcttctgcctcagcctcctgagtagctgggattacaggcacatgccaccatgcccagctaatttttttgtattcttagtagagacagggaggccgaggcgggtggattacctgaggtcaagagttcaagaccagcctggccaacatggtgaaacctcgtctctactaacaatacaaaaaaaaattagctgggcgtggtgatgcgcacctgtagtcccagctactcggggaggctgaggcaagagaatcgcttgaacccaggaggtggaggttgcagtgagccgagatcatgccactgcactccagcctgggcgacagagggagactccatctcaaaaaaaaaaaaaagaaaaaaacaaaacaaaaaaacccactgtttttggtatactgcatgaagattattggaattacacttggaactaattactaccctcttaagtaaccattgttttgttttaggagcagttgcagaagctcgaggttgaactgagagaagtcactaagaacaaggagaaactgaggaaaaacttgctggaactgatagagtacactcacatgctgagagtgacaaagacctttgtgaaacgcaatgttgagtttgaacccacttatgaagaattcccttccttagagagtgattctttgttggattacagctgtatgcagaggctgggagcaaaactgggatttgtgtctggcctaattaaccaaggaaaagtggaagcatttgaaaaaatgttgtggagagtctgcaaagggtacaccatcgtgtcctatgcagaactggatgaatcccttgaagaccctgaaacaggggaagtcataaaatggtatgtctttttaatatccttttggggagagcagattggccacaaggttaagaagatatgtgattgctaccactgccacgtgtacccctatccaaacacagccgaggagcggagggagatccaggaggggctgaacacccgcatccaggatctctacactgtactgcacaaaaccgaggactatttgaggcaagtgctatgtaaagccgccgagtctgtctacagccgtgtgatccaggtgaagaaaatgaaggccatctatcacatgctgaacatgtgcagctttgacgtgaccaacaagtgcctcattgctgaggtctggtgtcccgaggcggatctgcaggacctgcgccgggcactggaggagggctcgagagagagtggtgctacaatcccctcattcatgaatataatccccacaaaagaaacaccccccactcggatccgcaccaacaaattcaccgagggatttcagaacatcgtggatgcttatggagtcggaagctacagagaagtcaatccagctctctttaccatcatcaccttcccgtttttatttgctgtgatgtttggagacttcggacatggctttgtgatgtttttatttgccctcttgttggtgttaaatgaaaatcatcccagactaaatcagtcacaagagatcatgaggatgttttttaatggccggtacatcctcctgctgatggggc

SEQ ID NO: 109973 - DNA, 1733 bp, Homo sapiens
  Payload ID: 1585
  Gene Symbol: ATP6V0A2
  Gene Name: ATPase, H+ transporting, lysosomal V0 subunit a2
  ENST ID: ENST00000534943
  CDS Start-End: 1340-1733
gtttctgtttttttttggtttctcttgtttatgatttttaagaattgtattttatcattattttattgaagctttgtacaatggcatagataccacagataaatgcaggggcgttcagtgggcacaggtgctatggacagaaagatcaaggaagggcagctacctttctttactacctgccgcatacctgagagtgtgctttccttacttagtgtttcttaattctcacaacagccccaggaggtaggtgtgtcatcccctgttactggtgataactggtggctcagggcagtcctggtcactcagcggtctgtagggccaggctgttaacctaggtcagcctggctccagcccaggacttctgatgtggctctgcctgtggccgccacctttctcggcatttcaagaggttcatcctgttgatggtgtgtagataatacagctttgtgcctgagtagcacacagagctctaggaacctgtttttggtgaggggcgaccatacagagtgataagcttggacagcacagtgtcccgtccaaaccctgggaagccatgcagactgccgtggctgtgtaagcctgagtggattttgcttttgatttagctttaagtaactataaatcttcgtttttctaaggaagtgtttttggttttgttctgaattctcttccacgattttctgtgtgtggaggtaaatccacttgctgattcacactcatagtcctcagacggtctttataatcatcaaagaacaggaaaacagaaccaagaatatacaaaatattctgcttgtgcttatactttctcatttacagtgtttacagaaaatgattagttggagtttgactctctttagaatttttgtaaagtttccttgctggtctaaaacaaaataatactttaccacagggtcattaatgttattcatcagttctagaattcagctatgagtttaggaaaagaaaacccgctggcaagtgtagctggctggcatttattgaatgttcctcgcgtggagacattgttcgatctttcctgatttcatcgtgtgctgctgaccctgcaggcaggccttcacgttttaatcgggtttctcaccttctgcactaacaggagtatgtccagagagtgctgctggttgtcacagcattgtctgtccctgtcctcttcttgggaaagccactgtttttgttgtggcttcacaatgggcgtagttgcttcggggtgaaccggagtggctacacacttataaggaaagatagtgaggaagaagtttcattgctgggaagccaagatatagaagagggaaatcaccaggtggaagatggatgtagagaaatggcgtgtgaagagtttaattttggagaaatattaatgacccaagtaatccattccatcgagtactgtctgggatgcatctccaacaccgcctcctacctgaggctctgggcgcttagcctggctcacgcacagttgtctgatgtcctgtgggccatgctgatgcgcgtgggcctccgcgttgacaccacctatggcgtcttgctactgctcccggttatcgcgctctttgcagttttgaccattttcatccttctgatcatggaagggctttctgcgtttcttcacgccatacgcctccactgggtagaatttcagaacaaattctacgttggtgcaggcaccaaatttgttcctttctcattcagtctactttcatcaaagttcaataacg

SEQ ID NO: 109974 - DNA, 1620 bp, Homo sapiens
  Payload ID: 1585
  Gene Symbol: ATP6V0A2
  Gene Name: ATPase, H+ transporting, lysosomal V0 subunit a2
  ENST ID: ENST00000613625
  CDS Start-End: 211-1329
acctcgcggactgctgtggcggcagctggagcggcggccgcggtggcagaaccgggggcggccgctgcagtctggagccccatagtgcggggccgcggccaggccacaggaagagctcgaggcccgggccgcaccggctgagtgtgcgggcccgcgcggctcggagccgccgccgcccatcgagcccctccgggcgcgggtcggcccgccatggggtccctgttccggagcgagaccatgtgcctggcgcagctcttcctgcagtcgggcacggcctacgagtgcctcagcgccctgggcgagaaaggcctggtccagttccgagacctcaaccagaacgtaagttctttccaaagaaaatttgttggtgaggtgaagaggtgtgaagagctagagcgaatattggtgtatttggtacaggaaattaatagagctgatattccccttcctgaaggagaggccagccctcctgcgccacccctgaaacaggttctagaaatgcaggagcagttgcagaagctcgaggttgaactgagagaagtcactaagaacaaggagaaactgaggaaaaacttgctggaactgatagagtacactcacatgctgagagtgacaaagacctttgtgaaacgcaatgttgagtttgaacccacttatgaagaattcccttccttagagagtgattctttgttggattacagctgtatgcagaggctgggagcaaaactgggatttgtgtctggcctaattaaccaaggaaaagtggaagcatttgaaaaaatgttgtggagagtctgcaaagggtacaccatcgtgtcctatgcagaactggatgaatcccttgaagaccctgaaacaggggaagtcataaaatggtatgtctttttaatatccttttggggagagcagattggccacaaggttaagaagatatgtgattgctaccactgccacgtgtacccctatccaaacacagccgaggagcggagggagatccaggaggggctgaacacccgcatccaggatctctacactgtactgcacaaaaccgaggactatttgaggcaagtgctatgtaaagccgccgagtctgtctacagccgtgtgatccaggtgaagaaaatgaaggccatctatcacatgctgaacatgtgcagctttgacgtgaccaacaagtgcctcattgctgaggtctggtgtcccgaggcggatctgcaggacctgcgccgggcactggaggagggctcggtaaggctgccttcctctcctctgccaggaacagaagagagactgatggaactgataaattcagagaaaaaaaggaagtgagaatttcatagagtaatgagaatgcagtgtgttgactcttcttttgtttttttaaaatattaattaacaaaattaaaatagagatggggttttgctgtgttgcccaggctggtctcaaactcctggccccgagcgatcctcctgcctcagccttggctctgtttttgaactgaaattatggtgagctggtcattcaaagctgtatgtgagtacatgtgtttttaaattgctcttttgagtaattcattcacatggtgtaaaagtgaaaagaaataaaagagtatgaaagac

SEQ ID NO: 109975 - DNA, 2709 bp, Homo sapiens
  Payload ID: 1586
  Gene Symbol: ATP6V0A4
  Gene Name: ATPase, H+ transporting, lysosomal V0 subunit a4
  Uniprot ID: Q9HBG4
  ENST ID: ENST00000353492
  CDS Start-End: 89-2611
gctggaggctgtgctgagtgcccggtgcaggtgagccggtcctgcggagttgtgccgagtgcctgctgcagaccgaggctgggccaagatggtgtctgtgtttcgaagcgaggagatgtgtttgtcacaactgtttctccaggtggaagctgcatattgctgtgtggctgagctcggagagctcggattggttcagttcaaagatttaaatatgaatgtgaacagctttcaaaggaaatttgtgaatgaagtcagaaggtgtgaatcactggagagaatcctccgttttctggaagacgagatgcaaaatgagattgtagttcagttgctcgagaaaagcccactgaccccgctcccacgggaaatgattaccctggagactgttctagaaaaactggaaggagagttacaggaagccaaccagaaccagcaggccttgaaacaaagcttcctagaactgacagaactgaaatacctcctgaagaaaacccaagacttctttgagacggaaaccaatttagctgatgatttctttactgaggacacttctggcctcctggagttgaaagcagtgcctgcatatatgaccggaaagttggggttcatagccggtgtgatcaacagggagaggatggcttcctttgagcggttactgtggcgaatctgccgaggaaacgtgtacttgaagttcagtgagatggacgcccctctggaggatcctgtgacgaaagaagaaattcagaagaacatattcatcatattttaccaaggagagcagctcaggcagaaaatcaagaagatctgtgatgggtttcgagccactgtctacccttgcccagagcctgcggtggagcgcagagagatgttggagagcgtcaatgtgaggctggaagatttaatcaccgtcataacacaaacagagtctcaccgccagcgcctgctgcaggaagccgctgccaactggcactcctggctcatcaaggtgcagaagatgaaagctgtctaccacatcctgaacatgtgcaacatcgacgtcacccagcagtgtgtcatcgccgagatctggttcccggtggcagatgccacacgtatcaagagggcactggagcaaggcatggaactaagtggctcctccatggcccccatcatgaccacagtgcaatctaaaacagcccctcccacatttaacaggaccaataaattcacagctggcttccagaatattgttgatgcctatggtgtcggcagctaccgggagataaacccagccccctacaccatcatcactttccccttcctgttcgctgtgatgtttggagactgtggtcatggaaccgtgatgctcctggctgcactttggatgattctgaatgagagacgcttgctctcccagaagacagacaatgagatttggaacaccttcttccacgggcgctatctgatcctacttatgggcatcttctccatctacacgggtttgatctacaatgactgcttctccaagtccttgaacatctttggctcttcttggagtgtccaacccatgttcagaaacggcacatggaatactcatgtaatggaggaaagtctatatctgcagctggacccagccataccaggagtgtattttggaaatccatacccgtttgggattgatccgatttggaacttggcttcaaacaaactcacatttctgaactcgtataaaatgaagatgtcggtgatcctgggaattgtccagatggttttcggtgtcatcctcagccttttcaatcacatatacttcagaagaactctcaacatcattctgcaatttatccctgagatgatttttatcctgtgtctgtttggatacctggttttcatgatcattttcaaatggtgctgctttgacgtccatgtatctcagcacgcccccagcatcctcatccacttcatcaacatgtttctgtttaactacagtgactcttccaacgcacccctctacaaacatcagcaagaagtccaaagtttctttgtggttatggctttgatttctgtgccgtggatgcttctgattaagccgtttattcttagagccagtcatcggaaatcccagctgcaggcatccaggatccaagaagatgccactgagaacattgaaggtgatagctccagcccttctagccgttctggccagaggacttctgcagatacccacggggctctggacgaccatggagaagagttcaactttggagacgtctttgtccaccaagccatccacaccatcgagtactgcctgggctgcatttcaaacacagcctcctacctgcggctctgggccctcagcctggctcatgcacaactgtctgaagtgctctggactatggtgatgaacagcggccttcagacgcgaggctggggaggaatcgtcggggtttttattatttttgccgtatttgctgtcctgacagtagccatccttctgatcatggagggcctctctgctttcctgcacgccctgcgactgcactgggttgagttccagaacaagttctatgtcggggatggttacaagttttctccattctcctttaaacacatcctggatggcacagccgaggagtaggctgagggctgcacctcccacggtggtcaccatgccaatgaaggaagttcagtcttgtctttgatatcagcccctgcaaggcgctcaatgggaaggtt

SEQ ID NO: 109976 - DNA, 3135 bp, Homo sapiens
  Payload ID: 1586
  Gene Symbol: ATP6V0A4
  Gene Name: ATPase, H+ transporting, lysosomal V0 subunit a4
  Uniprot ID: Q9HBG4
  ENST ID: ENST00000310018
  CDS Start-End: 284-2806
ataacgctacctgccgagcaagccgagtggagggaggcaaaggccaggctgaggatcagggtggcccgggtggcagcggggaggcgctgcatgctggaggctgtgctgagtgcccggtgcaggtgagccggtcctgcggagttgtgccgagtgcctgctgcagtctcatttccagttcctccatgacgtggcaagtgaagacaggaatgaaaggaatgtaaagcagcttttctctgaagagaagaagagagagagacacagccaagaccgaggctgggccaagatggtgtctgtgtttcgaagcgaggagatgtgtttgtcacaactgtttctccaggtggaagctgcatattgctgtgtggctgagctcggagagctcggattggttcagttcaaagatttaaatatgaatgtgaacagctttcaaaggaaatttgtgaatgaagtcagaaggtgtgaatcactggagagaatcctccgttttctggaagacgagatgcaaaatgagattgtagttcagttgctcgagaaaagcccactgaccccgctcccacgggaaatgattaccctggagactgttctagaaaaactggaaggagagttacaggaagccaaccagaaccagcaggccttgaaacaaagcttcctagaactgacagaactgaaatacctcctgaagaaaacccaagacttctttgagacggaaaccaatttagctgatgatttctttactgaggacacttctggcctcctggagttgaaagcagtgcctgcatatatgaccggaaagttggggttcatagccggtgtgatcaacagggagaggatggcttcctttgagcggttactgtggcgaatctgccgaggaaacgtgtacttgaagttcagtgagatggacgcccctctggaggatcctgtgacgaaagaagaaattcagaagaacatattcatcatattttaccaaggagagcagctcaggcagaaaatcaagaagatctgtgatgggtttcgagccactgtctacccttgcccagagcctgcggtggagcgcagagagatgttggagagcgtcaatgtgaggctggaagatttaatcaccgtcataacacaaacagagtctcaccgccagcgcctgctgcaggaagccgctgccaactggcactcctggctcatcaaggtgcagaagatgaaagctgtctaccacatcctgaacatgtgcaacatcgacgtcacccagcagtgtgtcatcgccgagatctggttcccggtggcagatgccacacgtatcaagagggcactggagcaaggcatggaactaagtggctcctccatggcccccatcatgaccacagtgcaatctaaaacagcccctcccacatttaacaggaccaataaattcacagctggcttccagaatattgttgatgcctatggtgtcggcagctaccgggagataaacccagccccctacaccatcatcactttccccttcctgttcgctgtgatgtttggagactgtggtcatggaaccgtgatgctcctggctgcactttggatgattctgaatgagagacgcttgctctcccagaagacagacaatgagatttggaacaccttcttccacgggcgctatctgatcctacttatgggcatcttctccatctacacgggtttgatctacaatgactgcttctccaagtccttgaacatctttggctcttcttggagtgtccaacccatgttcagaaacggcacatggaatactcatgtaatggaggaaagtctatatctgcagctggacccagccataccaggagtgtattttggaaatccatacccgtttgggattgatccgatttggaacttggcttcaaacaaactcacatttctgaactcgtataaaatgaagatgtcggtgatcctgggaattgtccagatggttttcggtgtcatcctcagccttttcaatcacatatacttcagaagaactctcaacatcattctgcaatttatccctgagatgatttttatcctgtgtctgtttggatacctggttttcatgatcattttcaaatggtgctgctttgacgtccatgtatctcagcacgcccccagcatcctcatccacttcatcaacatgtttctgtttaactacagtgactcttccaacgcacccctctacaaacatcagcaagaagtccaaagtttctttgtggttatggctttgatttctgtgccgtggatgcttctgattaagccgtttattcttagagccagtcatcggaaatcccagctgcaggcatccaggatccaagaagatgccactgagaacattgaaggtgatagctccagcccttctagccgttctggccagaggacttctgcagatacccacggggctctggacgaccatggagaagagttcaactttggagacgtctttgtccaccaagccatccacaccatcgagtactgcctgggctgcatttcaaacacagcctcctacctgcggctctgggccctcagcctggctcatgcacaactgtctgaagtgctctggactatggtgatgaacagcggccttcagacgcgaggctggggaggaatcgtcggggtttttattatttttgccgtatttgctgtcctgacagtagccatccttctgatcatggagggcctctctgctttcctgcacgccctgcgactgcactgggttgagttccagaacaagttctatgtcggggatggttacaagttttctccattctcctttaaacacatcctggatggcacagccgaggagtaggctgagggctgcacctcccacggtggtcaccatgccaatgaaggaagttcagtcttgtctttgatatcagcccctgcaaggcgctcaatgggaaggttgttcttggctcacctgaagcatgaaactgtgtattatttggacgtcagcctgtggatttgatacgacttaaccacgtcagaggaaggactttggcaagtgatattgtcttcatgtggggtattaattctcaaataataaagtaattgacaaatgaggggagaatgctaaacagatgtcttcttgcaatattttaaatattgtatttgagaaaataaacatctgagtcattc

SEQ ID NO: 109977 - DNA, 3090 bp, Homo sapiens
  Payload ID: 1586
  Gene Symbol: ATP6V0A4
  Gene Name: ATPase, H+ transporting, lysosomal V0 subunit a4
  Uniprot ID: Q9HBG4
  ENST ID: ENST00000393054
  CDS Start-End: 239-2761
aacagagctgcctcctggctctttgggagcctgggaggagaaggagccgggaggggcgctgcggggaagccacctgcggattcactggctgctgctccgcccaggactgctagcaagcacggagggctgccagacctggggctccctgctccgtgcgtcaggttggggaaaccaccgtctgccccagaccctgacccaggacccgcctggaggaagctgggaccgaggctgggccaagatggtgtctgtgtttcgaagcgaggagatgtgtttgtcacaactgtttctccaggtggaagctgcatattgctgtgtggctgagctcggagagctcggattggttcagttcaaagatttaaatatgaatgtgaacagctttcaaaggaaatttgtgaatgaagtcagaaggtgtgaatcactggagagaatcctccgttttctggaagacgagatgcaaaatgagattgtagttcagttgctcgagaaaagcccactgaccccgctcccacgggaaatgattaccctggagactgttctagaaaaactggaaggagagttacaggaagccaaccagaaccagcaggccttgaaacaaagcttcctagaactgacagaactgaaatacctcctgaagaaaacccaagacttctttgagacggaaaccaatttagctgatgatttctttactgaggacacttctggcctcctggagttgaaagcagtgcctgcatatatgaccggaaagttggggttcatagccggtgtgatcaacagggagaggatggcttcctttgagcggttactgtggcgaatctgccgaggaaacgtgtacttgaagttcagtgagatggacgcccctctggaggatcctgtgacgaaagaagaaattcagaagaacatattcatcatattttaccaaggagagcagctcaggcagaaaatcaagaagatctgtgatgggtttcgagccactgtctacccttgcccagagcctgcggtggagcgcagagagatgttggagagcgtcaatgtgaggctggaagatttaatcaccgtcataacacaaacagagtctcaccgccagcgcctgctgcaggaagccgctgccaactggcactcctggctcatcaaggtgcagaagatgaaagctgtctaccacatcctgaacatgtgcaacatcgacgtcacccagcagtgtgtcatcgccgagatctggttcccggtggcagatgccacacgtatcaagagggcactggagcaaggcatggaactaagtggctcctccatggcccccatcatgaccacagtgcaatctaaaacagcccctcccacatttaacaggaccaataaattcacagctggcttccagaatattgttgatgcctatggtgtcggcagctaccgggagataaacccagccccctacaccatcatcactttccccttcctgttcgctgtgatgtttggagactgtggtcatggaaccgtgatgctcctggctgcactttggatgattctgaatgagagacgcttgctctcccagaagacagacaatgagatttggaacaccttcttccacgggcgctatctgatcctacttatgggcatcttctccatctacacgggtttgatctacaatgactgcttctccaagtccttgaacatctttggctcttcttggagtgtccaacccatgttcagaaacggcacatggaatactcatgtaatggaggaaagtctatatctgcagctggacccagccataccaggagtgtattttggaaatccatacccgtttgggattgatccgatttggaacttggcttcaaacaaactcacatttctgaactcgtataaaatgaagatgtcggtgatcctgggaattgtccagatggttttcggtgtcatcctcagccttttcaatcacatatacttcagaagaactctcaacatcattctgcaatttatccctgagatgatttttatcctgtgtctgtttggatacctggttttcatgatcattttcaaatggtgctgctttgacgtccatgtatctcagcacgcccccagcatcctcatccacttcatcaacatgtttctgtttaactacagtgactcttccaacgcacccctctacaaacatcagcaagaagtccaaagtttctttgtggttatggctttgatttctgtgccgtggatgcttctgattaagccgtttattcttagagccagtcatcggaaatcccagctgcaggcatccaggatccaagaagatgccactgagaacattgaaggtgatagctccagcccttctagccgttctggccagaggacttctgcagatacccacggggctctggacgaccatggagaagagttcaactttggagacgtctttgtccaccaagccatccacaccatcgagtactgcctgggctgcatttcaaacacagcctcctacctgcggctctgggccctcagcctggctcatgcacaactgtctgaagtgctctggactatggtgatgaacagcggccttcagacgcgaggctggggaggaatcgtcggggtttttattatttttgccgtatttgctgtcctgacagtagccatccttctgatcatggagggcctctctgctttcctgcacgccctgcgactgcactgggttgagttccagaacaagttctatgtcggggatggttacaagttttctccattctcctttaaacacatcctggatggcacagccgaggagtaggctgagggctgcacctcccacggtggtcaccatgccaatgaaggaagttcagtcttgtctttgatatcagcccctgcaaggcgctcaatgggaaggttgttcttggctcacctgaagcatgaaactgtgtattatttggacgtcagcctgtggatttgatacgacttaaccacgtcagaggaaggactttggcaagtgatattgtcttcatgtggggtattaattctcaaataataaagtaattgacaaatgaggggagaatgctaaacagatgtcttcttgcaatattttaaatattgtatttgagaaaataaacatctgagtcattc

SEQ ID NO: 109978 - DNA, 3709 bp, Homo sapiens
  Payload ID: 1587
  Gene Symbol: ATP4A
  Gene Name: ATPase, H+/K+ exchanging, alpha polypeptide
  Uniprot ID: P20648
  ENST ID: ENST00000262623
  CDS Start-End: 30-3137
gttgggtgggagcacaggcaccgggcaccatggggaaggccgagaactatgagctctactcggtggagctgggtcctggccctggcggggacatggctgccaagatgagcaagaagaagaaggcgggtggcgggggtggcaagaggaaggagaagctggagaacatgaagaaggagatggagattaacgaccaccagctgtcagtggcggagctggaacagaaataccagaccagtgccaccaagggcctctctgcgagcctggctgctgagctgctgctgcgggatgggcccaacgcactgcggccaccacggggcaccccagagtacgtcaagttcgcgaggcagctggccgggggcctgcagtgcctcatgtgggttgccgccgccatctgcctcatcgcctttgccatccaggctagtgagggggacctcaccaccgacgacaatctgtacctggcaatcgctctcattgctgtggttgtcgtcaccggctgctttggctactaccaggaattcaagagcaccaacatcatcgccagctttaagaaccttgtgccacagcaagccactgtcatccgcgatggagacaaattccagatcaacgctgaccaactggtggtgggcgacctggtggagatgaaaggtggggacagagtgcccgccgacatccgcatcctggcggcccagggctgcaaggtggacaactcctcgctgacaggggagtctgagccacagacccgctcacccgagtgcacgcacgagagccctctggagacccgcaacatcgccttcttctccaccatgtgccttgagggcaccgtgcagggcctggtggtgaacacgggcgaccgcaccatcattgggcgcatcgcatcgctggcgtcgggggtggaaaacgagaagacacccatcgctatcgagatcgagcattttgtggacatcatcgcgggcctggccattctcttcggtgccacattttttattgtggccatgtgcattggctacaccttcctgcgggccatggtcttcttcatggccatcgtggtggcctatgtgcctgaggggctgctggccactgtcacagtctgcctgtccctgacagccaagcgcctggccagtaagaactgcgtggtcaagaacctggaggcggtggagacattgggctccacttcggtgatctgctcggacaagacagggactctcactcagaaccgcatgactgtgtcccatctgtggtttgacaaccacatccacacagctgacaccacggaagaccagtcagggcagacgtttgaccagtcctcggagacgtggcgggcgctgtgccgggtgctcaccctgtgcaaccgcgccgccttcaagtccggccaggatgcagtgcctgtgcccaagcgcatcgtgattggagacgcatcggagacggcgctgctcaagttctcggagctgacgctgggcaacgccatgggctaccgggaccgcttcccaaaagtctgcgagatacccttcaactccaccaacaagttccagctgtccatccatacgctggaggacccgcgggacccgcgacacttgctggtgatgaagggcgcccccgagcgcgtgctggagcgctgcagctccatccttatcaagggccaggagctgccgctggacgagcagtggcgcgaggccttccagaccgcctacctcagcctgggaggcctgggcgaacgcgtgctcggcttctgccagctctacctgaatgagaaggactacccgcctggctatgccttcgacgtagaggccatgaactttccatctagcggcctctgctttgcgggacttgtatccatgattgacccaccccgggccaccgtccctgatgctgtgctcaagtgtcgcaccgcaggcatccgggtgatcatggtaacgggtgaccaccccatcaccgccaaggccattgcagccagtgtgggcatcatctcggaaggcagcgagacagtggaggacatcgctgcccgcctccgtgtgcccgtagaccaggttaatcgcaaggatgcccgtgcctgtgtgatcaatggcatgcagctgaaggacatggacccatcggaactggtcgaggccctgcgcacccaccccgagatggtgtttgcgcgcaccagcccccagcagaagctggtgatcgtggagagctgccagcggctgggtgcgattgtggccgtcacgggggatggtgtgaatgactccccagctctgaagaaggcagacatcggagtagccatgggcatcgctggctcagatgctgccaaaaatgcagctgacatgatcctgctggatgacaactttgcctccattgtgacaggcgtggagcagggtcgactgatcttcgacaacctgaagaagtctattgcctacacattgaccaagaacatcccagagctgacaccctacctcatctacatcaccgtcagcgtgcccctgcccctcgggtgcatcaccatcctcttcatcgaactctgcactgacattttcccatctgtgtccctggcatatgaaaaggccgagagtgacatcatgcacctgcgtccacgcaacccaaagcgtgacagattggtcaacgagcccctggctgcctactcctacttccagattggtgccattcagtcctttgctggcttcactgactacttcacggcaatggcccaggagggctggttcccactgctgtgcgtggggctgcgggcgcagtgggaggaccaccacctacaagatctgcaggacagctacggccaggagtggacattcgggcagcgcctgtaccagcagtacacctgctacaccgtgttcttcatcagcattgaggtgtgccagatcgccgatgtcctcatccgcaagacgcgccgtctctctgccttccagcaaggcttcttcaggaataagatcctggtgatcgccatcgtgttccaggtctgcatcggctgcttcctgtgctactgccccggcatgcccaacatcttcaacttcatgcccattcggttccagtggtggctggtccccctgccctacggcatcctcatcttcgtctatgatgagatccggaagcttggagttcgctgttgcccagggagctggtgggaccaggaactctactattagagggacgactgccttcaagcatccctgcaactgccacagcaggtgggggcagggctcgtgggaccctctggacagccaccaagatatctgagcaaccaagagtcccagccccaccagtatctgcttctgtagcccacggcaccccaaacttggagggacctgcccactcccctcccccattcccaaggttcgcacctcctggagcagcagcgcctgggcagtcctctgggctggcctcgggaaagccgccacctgtggtggcggtggggctctgacagggagtacagctgaccgcttctggagggtgtttctgttcttaggactccagtccaggctggacggctgcctgagggcccttcgttaaagacacgcttgtgtcctgggcgatggtaataaaaccagctcatgctgactgtgctgtatctggtgccaggcactgtcctcagcgtctctcattagtgcttgtgatctcccacagtcctgtacatgggggctgtttatccagggctgcacctccagtgcctagtacacagcctggcacatagtaggtcctcaataaacctgccttgggg

SEQ ID NO: 109979 - DNA, 650 bp, Homo sapiens
  Payload ID: 1587
  Gene Symbol: ATP4A
  Gene Name: ATPase, H+/K+ exchanging, alpha polypeptide
  ENST ID: ENST00000592767
  CDS Start-End: 1-103
ggagctgccgctggacgagcagtggcgcgaggccttccagaccgcctacctcagcctgggaggcctgggcgaacgcgtgctcggtgatcatggtaacgggtgaccaccccatcaccgccaaggccattgcagccagtgtgggcatcatctcggaaggcagcgagacagtggaggacatcgctgcccgcctccgtgtgcccgtagaccaggttaatcgcaaggatgcccgtgcctgtgtgatcaatggcatgcagctgaaggacatggacccatcggaactggtcgaggccctgcgcacccaccccgagatggtgtttgcgcgcaccagcccccagcagaagctggtgatcgtggagagctgccagcggctggtcgactgatcttcgacaacctgaagaagtctattgcctacacattgaccaagaacatcccagagctgacaccctacctcatctacatcaccgtcagcgtgcccctgcccctcgggtgcatcaccatcctcttcatcgaactctgcactgacattttcccatctgtgtccctggcatatgaaaaggccgagagtgacatcatgcacctgcgtccacgcaacccaaagcgtgacagattggtcaacgagcccctggctgcctactcctacttccagattg

SEQ ID NO: 109980 - DNA, 1488 bp, Homo sapiens
  Payload ID: 1588
  Gene Symbol: ATP4B
  Gene Name: ATPase, H+/K+ exchanging, beta polypeptide
  Uniprot ID: P51164
  ENST ID: ENST00000335288
  CDS Start-End: 43-918
gagggtgcagggagcagacgggaggatctcaggccagggacgatggcggctctgcaggagaagaagacgtgtggccagcgcatggaggagttccagcgttactgctggaacccggacacggggcagatgctgggccgcaccctgtcccggtgggtgtggatcagcctgtactacgtggccttctacgtggtgatgactgggctcttcgccctgtgcctctatgtgctgatgcagacagtggacccgtacacaccggactaccaagaccagctacggtcaccaggggtaaccttaaggccggatgtttacggggagaaaggcctggaaattgtctacaacgtctctgataacagaacctgggcagacctcacacagactctccacgccttcctagcaggctactctccagcagcccaggaggacagcatcaactgcacctccgagcagtacttcttccaggagagtttccgcgctcccaaccacaccaagttctcctgcaagttcacggcagatatgctgcagaactgctcaggcctggcggatcccaacttcggctttgaagaaggaaagccatgttttattattaaaatgaacaggatcgtcaagttcctccccagcaacggctcggcccccagagtggactgcgccttcctggaccagccccgcgagctcggccagccgctgcaggtcaagtactaccctcccaacggcaccttcagtctgcactacttcccttattacgggaagaaagcccagccccactacagcaaccccctggtggcagcgaagctcctcaacatccccaggaacgctgaggtcgccatcgtgtgcaaggtcatggcggagcacgtgaccttcaacaatccccacgacccgtatgaagggaaagtggagttcaaactcaagattgagaagtgaaacggtttgcgcaggggtcctgggcacgcctgcggggtcgctcaaggacaccctcctggttgggcttaccttgcccgtcagttccctgccaaatcatccccaaagtggtttggagcaacggtgttgtcagtgtgcgaactccagagaagcgcccacatctgaaggacctgctcgcgagtatcagttcttccttgttgaattcttacagtttttagatggaatttgctgctataagaatgtccagctaccatgggaacgcaaggcagcaactctctaattaaccaggtcataaaaacgattcgtcttctatgtagacatcactttcttactataatttatttttctacacttcaatatgaactgccccccccacattaatataaaaactactaatgcactgatatgaaacacggcttacactaatgacattctgaattcttgcttttaaaattgcaattcctaagttgtaaacataaaatatattaaagttactcttattgtatgtaaaaaaagaaatcgtgtttcctgatatgggagaaattaaataaaaaccaaacgcttccttaaaaa

SEQ ID NO: 109981 - DNA, 3732 bp, Homo sapiens
  Payload ID: 1589
  Gene Symbol: ATP12A
  Gene Name: ATPase, H+/K+ transporting, nongastric, alpha polypeptide
  Uniprot ID: P54707
  ENST ID: ENST00000218548
  CDS Start-End: 334-3471
aatcctggactctcccgacccctagctgtcggtccccctccctgcgcgcgcgccggcgggtttcctaccctccgaggcgtccgctggcctgcgccctggcggggacgtgggcggggcgggcggcatttaaggctggtgccacctccccggtgcagcggctggcgatcggccgcggaggtgcgtgcagggcccgcgccgccgccggtatctccaccgccaacacctcagccactgccactgccacagccacacgaggccccccaccgtgcgctccgccgctgcggtcccggatccgcgctccacgcccgcagcccgcggcgccaccagcccagcatgcaccagaaaaccccagaaatttactccgtggagctcagcggaactaaggacatcgtgaaaacagacaagggggatggcaaggagaagtataggggtctgaagaacaactgcctggaactcaaaaagaaaaatcacaaagaggagtttcagaaagaactccatctggatgaccacaaactcagcaatagggaattggaagagaaatatggcacagacatcattatgggtctctccagcaccagagctgccgagctcctggcccgggatgggcccaactccctcacccctcccaagcagacgcctgagatcgtcaagttcctcaagcagatggtgggggggttctctatcctcctgtgggtgggcgcctttctctgttggattgcatatgggattcagtactccagcgacaagtctgcatccctgaacaacgtgtacttgggctgtgtgcttggtctggtggtcattttaacggggatctttgcttattaccaagaggcaaaaagcaccaacatcatgtccagcttcaataagatgatccctcagcaagctctcgtcatccgagattccgagaagaagaccatcccttcagagcagctggtggtgggggacattgtggaggtcaaaggaggagaccagatccctgcagacatcagggtgctgtcttctcaggggtgtcgggtggataactcatctctcacgggggagtctgagccccagccccgctcctctgagtttacccatgaaaaccccctggaaacaaagaacatctgcttctattccacaacgtgtctggaagcatctacttcccctgtaggcactgtcaccggcatggttatcaacacgggtgaccgcaccatcattggccatattgcctcattggcctcaggagttggaaatgagaagacgcccattgccattgagatcgagcactttgttcacattgtggcaggagtggctgtctccatcggcatccttttcttcatcatcgctgtgtccctgaagtatcaagtcctggactccatcatcttcctcattggcatcattgtggccaatgtgcccgagggcctcctggccactgtcactgtgaccctgtcgctgacagcaaaacggatggccaagaagaactgcctggtgaagaacctggaggctgtggagaccctcggctccacctccatcatctgctcggacaagactgggacactgacccagaacaggatgacagtggcccatctgtggttcgacaatcagatctttgtggctgacaccagtgaggaccattcaaaccaagtctttgaccaaagctctaggacttgggcctccttatccaagataataacattgtgtaaccgagcagagttcaagccaggacaggaaaatgtccccatcatgaagaaagctgtgattggagatgcctcagaaactgctcttttaaaattctcagaggtcattttgggtgatgtgatggaaattagaaaaagaaaccgcaaagtagctgaaatcccttttaactctactaataaatttcagctctccatccacgagatggatgacccccacggcaagcgcttcctcatggtgatgaagggggcccctgagcgcatcctagagaaatgcagcaccatcatgatcaacggcgaggagcacccactggacaagagcactgccaagaccttccacacagcctacatggagctgggcgggttgggcgagcgtgtgctgggtttctgtcatctctacctgccagcagacgagtttccagaaacctactcatttgacatagacgctatgaactttccgacctccaacctctgttttgtgggactcttgtcaatgatcgatccccctcggtccaccgtgccagatgcagtcaccaaatgccggagtgcagggatcaaggttattatggttactggtgatcatcccatcacagccaaagctattgccaagagtgtggggatcatttcagccaacagtgaaacagtggaagacattgcacatcgcctcaacattgctgtggagcaagttaacaaacgggatgccaaggccgctgtggtgactggcatggagctgaaggacatgagctcagaacagctggatgagatcttagccaactaccaggagattgtctttgcccggacatccccccagcagaagctgatcattgtggagggctgtcagaggcaggatgctgttgttgctgtgaccggggatggagttaatgactctccggctctaaagaaggcagacattgggattgccatggggatagcaggttctgatgcagccaaaaatgcagccgacatggtcttgctggacgacaacttcgcatccatcgtcacaggggtggaggaaggtcgcctgatctttgacaacctcaagaagactattgcttattccctgaccaagaacattgccgagctgtgcccctttctgatctacatcattgtcgggctccccctgcccattggcaccatcaccattctgttcattgacttggggacagacattatcccctccattgccttggcgtacgagaaagctgaaagtgacatcatgaacaggaagcctcgccacaagaataaggacaggctggtgaaccagccgctcgctgtgtactcatacctgcacattggcctcatgcaagccctgggagctttccttgtgtatttcaccgtctatgcacaagagggctttctgccccgcactctcattaacctgcgggtagaatgggagaaggactacgtgaatgacttgaaagacagctatgggcaggaatggacaaggtaccagagggaatacctagaatggacgggctacacggctttctttgttggcatcctagtccagcaaatagcagatctgatcatcaggaaaacccggaggaattccatcttccagcagggtctcttcagaaataaagtcatctgggtggggatcacctcacagatcatcattggtctgatcctctcctatggcctcggaagtgtcacagccttgagtttcaccatgcttagggctcagtactggtttgtggctgtgccgcacgccatcctgatctgggtgtatgatgaggtgcggaagctcttcatcaggctctaccctggaagctggtgggataagaacatgtattattaagaccacctcccttcctatgtctctcagcagcacgttggggcacacttgttcatcttctgaccgtttgctgggctattcccctgcagtgcagacatcgtcaaaattcagacaagaggaaattttcatgcagaaagctgtatgcaggatgctcactgatgttttgcactttaaaactgaaattcaactctttatataggattttcttttctatctccatctcctcattaaaaaatacgtacatttcgaggtaatggtataggg

SEQ ID NO: 109982 - DNA, 4258 bp, Homo sapiens
  Payload ID: 1589
  Gene Symbol: ATP12A
  Gene Name: ATPase, H+/K+ transporting, nongastric, alpha polypeptide
  Uniprot ID: P54707
  ENST ID: ENST00000381946
  CDS Start-End: 168-3287
cggccgcggaggtgcgtgcagggcccgcgccgccgccggtatctccaccgccaacacctcagccactgccactgccacagccacacgaggccccccaccgtgcgctccgccgctgcggtcccggatccgcgctccacgcccgcagcccgcggcgccaccagcccagcatgcaccagaaaaccccagaaatttactccgtggagctcagcggaactaaggacatcgtgaaaacagacaagggggatggcaaggagaagtataggggtctgaagaacaactgcctggaactcaaaaagaaaaatcacaaagaggagtttcagaaagaactccatctggatgaccacaaactcagcaatagggaattggaagagaaatatggcacagacatcattatgggtctctccagcaccagagctgccgagctcctggcccgggatgggcccaactccctcacccctcccaagcagacgcctgagatcgtcaagttcctcaagcagatggtgggggggttctctatcctcctgtgggtgggcgcctttctctgttggattgcatatgggattcagtactccagcgacaagtctgcatccctgaacaacgtgtacttgggctgtgtgcttggtctggtggtcattttaacggggatctttgcttattaccaagaggcaaaaagcaccaacatcatgtccagcttcaataagatgatccctcagcaagctctcgtcatccgagattccgagaagaagaccatcccttcagagcagctggtggtgggggacattgtggaggtcaaaggaggagaccagatccctgcagacatcagggtgctgtcttctcaggggtgtcgggtggataactcatctctcacgggggagtctgagccccagccccgctcctctgagtttacccatgaaaaccccctggaaacaaagaacatctgcttctattccacaacgtgtctggaaggcactgtcaccggcatggttatcaacacgggtgaccgcaccatcattggccatattgcctcattggcctcaggagttggaaatgagaagacgcccattgccattgagatcgagcactttgttcacattgtggcaggagtggctgtctccatcggcatccttttcttcatcatcgctgtgtccctgaagtatcaagtcctggactccatcatcttcctcattggcatcattgtggccaatgtgcccgagggcctcctggccactgtcactgtgaccctgtcgctgacagcaaaacggatggccaagaagaactgcctggtgaagaacctggaggctgtggagaccctcggctccacctccatcatctgctcggacaagactgggacactgacccagaacaggatgacagtggcccatctgtggttcgacaatcagatctttgtggctgacaccagtgaggaccattcaaaccaagtctttgaccaaagctctaggacttgggcctccttatccaagataataacattgtgtaaccgagcagagttcaagccaggacaggaaaatgtccccatcatgaagaaagctgtgattggagatgcctcagaaactgctcttttaaaattctcagaggtcattttgggtgatgtgatggaaattagaaaaagaaaccgcaaagtagctgaaatcccttttaactctactaataaatttcagctctccatccacgagatggatgacccccacggcaagcgcttcctcatggtgatgaagggggcccctgagcgcatcctagagaaatgcagcaccatcatgatcaacggcgaggagcacccactggacaagagcactgccaagaccttccacacagcctacatggagctgggcgggttgggcgagcgtgtgctgggtttctgtcatctctacctgccagcagacgagtttccagaaacctactcatttgacatagacgctatgaactttccgacctccaacctctgttttgtgggactcttgtcaatgatcgatccccctcggtccaccgtgccagatgcagtcaccaaatgccggagtgcagggatcaaggttattatggttactggtgatcatcccatcacagccaaagctattgccaagagtgtggggatcatttcagccaacagtgaaacagtggaagacattgcacatcgcctcaacattgctgtggagcaagttaacaaacgggatgccaaggccgctgtggtgactggcatggagctgaaggacatgagctcagaacagctggatgagatcttagccaactaccaggagattgtctttgcccggacatccccccagcagaagctgatcattgtggagggctgtcagaggcaggatgctgttgttgctgtgaccggggatggagttaatgactctccggctctaaagaaggcagacattgggattgccatggggatagcaggttctgatgcagccaaaaatgcagccgacatggtcttgctggacgacaacttcgcatccatcgtcacaggggtggaggaaggtcgcctgatctttgacaacctcaagaagactattgcttattccctgaccaagaacattgccgagctgtgcccctttctgatctacatcattgtcgggctccccctgcccattggcaccatcaccattctgttcattgacttggggacagacattatcccctccattgccttggcgtacgagaaagctgaaagtgacatcatgaacaggaagcctcgccacaagaataaggacaggctggtgaaccagccgctcgctgtgtactcatacctgcacattggcctcatgcaagccctgggagctttccttgtgtatttcaccgtctatgcacaagagggctttctgccccgcactctcattaacctgcgggtagaatgggagaaggactacgtgaatgacttgaaagacagctatgggcaggaatggacaaggtaccagagggaatacctagaatggacgggctacacggctttctttgttggcatcctagtccagcaaatagcagatctgatcatcaggaaaacccggaggaattccatcttccagcagggtctcttcagaaataaagtcatctgggtggggatcacctcacagatcatcattggtctgatcctctcctatggcctcggaagtgtcacagccttgagtttcaccatgcttagggctcagtactggtttgtggctgtgccgcacgccatcctgatctgggtgtatgatgaggtgcggaagctcttcatcaggctctaccctggaagctggtgggataagaacatgtattattaagaccacctcccttcctatgtctctcagcagcacgttggggcacacttgttcatcttctgaccgtttgctgggctattcccctgcagtgcagacatcgtcaaaattcagacaagaggaaattttcatgcagaaagctgtatgcaggatgctcactgatgttttgcactttaaaactgaaattcaactctttatataggattttcttttctatctccatctcctcattaaaaaatacgtacatttcgaggtaatggtatagggaagaatgtgtttatgtgtatttgaaactccttgatgttaatagtcttgtgtaacccaggcatctactggggcctgccttaagctctagctaggattgctcagaactcctttccacaccctattaaaggccccatgacctccctaagatttctgcagatcccctgagaaggtatgttttcatggtctccttgctcgaaaaaggccaactcacccgagggtctgcaggagatggaagtggcggcaggtttacatcacagcagcacgcatgacctcagctttgactcgtttaactctgagacgtccttcttgaaggcccttgccacagtttccctggccacgccaccccatcccacctctggtcatctccccagccctttatgccccgtcgccctccacccctacatcagctcctccaaaactgagctcccagttcattttgcatatcctaactcaaaatgctcagctaatccaaggggactttctttaccaggattcaaccctagtagagagctgttatggtttcaatagtcatatttatttcttgtaaaacagttgccaggtgctctccagcaataacgttttgtcagtcatgtttcatgttttaacttaggtgtattcatgtgtgacacttccatgttgacaggcccggaaaggcctcatttttaactaaaagatgttttataaacccaggtttaattgtggtgttctaa

SEQ ID NO: 109983 - DNA, 3654 bp, Homo sapiens
  Payload ID: 1590
  Gene Symbol: ATP1A1
  Gene Name: ATPase, Na+/K+ transporting, alpha 1 polypeptide
  Uniprot ID: P05023
  ENST ID: ENST00000295598
  CDS Start-End: 253-3324
ctggggcgcagagcagcggcgggaggaggcggacacgtggcaacagcggtagcagcccgggcggcggcagcaacagcggcggcggcatcggcccgagccgccggccgccctcccaccctcccgccccgcggcagccctagctccctccacttggctcccctggtcccgctcgctcggccgggagctgctctgtgcttttctctctgattctccagcgacaggacccggcgccgggcactgagcaccgccaccatggggaagggggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtggataactcctcgctcactggtgaatcagaaccccagactaggtctccagatttcacaaatgaaaaccccctggagacgaggaacattgccttcttttcaaccaattgtgttgaaggcaccgcacgtggtattgttgtctacactggggatcgcactgtgatgggaagaattgccacacttgcttctgggctggaaggaggccagacccccattgctgcagaaattgaacattttatccacatcatcacgggtgtggctgtgttcctgggtgtgtctttcttcatcctttctctcatccttgagtacacctggcttgaggctgtcatcttcctcatcggtatcatcgtagccaatgtgccggaaggtttgctggccactgtcacggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtgtctcttttgacaagacttcagctacctggcttgctctgtccagaattgcaggtctttgtaacagggcagtgtttcaggctaaccaggaaaacctacctattcttaagcgggcagttgcaggagatgcctctgagtcagcactcttaaagtgcatagagctgtgctgtggttccgtgaaggagatgagagaaagatacgccaaaatcgtcgagatacccttcaactccaccaacaagtaccagttgtctattcataagaaccccaacacatcggagccccaacacctgttggtgatgaagggcgccccagaaaggatcctagaccgttgcagctctatcctcctccacggcaaggagcagcccctggatgaggagctgaaagacgcctttcagaacgcctatttggagctggggggcctcggagaacgagtcctaggtttctgccacctctttctgccagatgaacagtttcctgaagggttccagtttgacactgacgatgtgaatttccctatcgataatctgtgctttgttgggctcatctccatgattgaccctccacgggcggccgttcctgatgccgtgggcaaatgtcgaagtgctggaattaaggtcatcatggtcacaggagaccatccaatcacagctaaagctattgccaaaggtgtgggcatcatctcagaaggcaatgagaccgtggaagacattgctgcccgcctcaacatcccagtcagccaggtgaaccccagggatgccaaggcctgcgtagtacacggcagtgatctaaaggacatgacctccgagcagctggatgacattttgaagtaccacactgagatagtgtttgccaggacctcccctcagcagaagctcatcattgtggaaggctgccaaagacagggtgctatcgtggctgtgactggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggttcctgccatctccctggcttatgagcaggctgagagtgacatcatgaagagacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaaacctacctggtggttctgtgccttcccctactctcttctcatcttcgtatatgacgaagtcagaaaactcatcatcaggcgacgccctggcggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctatggggggaggggggagggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatggaa

SEQ ID NO: 109984 - DNA, 698 bp, Homo sapiens
  Payload ID: 1590
  Gene Symbol: ATP1A1
  Gene Name: ATPase, Na+/K+ transporting, alpha 1 polypeptide
  ENST ID: ENST00000369494
  CDS Start-End: 265-698
caagagctgtaccgaaagaggcaccaacaaatgtggttgctccataatggagagaatgtcaagaatgttgactatctttagacctgcttcattaatagataagatagaaactaaagaacccacccagttggaagaagttattagtcaagtagtgctgcacacgtgaccacagaagttaaaaaggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtga

SEQ ID NO: 109985 - DNA, 3572 bp, Homo sapiens
  Payload ID: 1590
  Gene Symbol: ATP1A1
  Gene Name: ATPase, Na+/K+ transporting, alpha 1 polypeptide
  Uniprot ID: P05023
  ENST ID: ENST00000369496
  CDS Start-End: 266-3244
gatatgtaataatgtctttgcaaagcaaagaatataaacagtataaaagtactagcatttagatgtattgtatcatttaatccttaaaaacatgaaatgaggttggcactattctttatctccacgctgtggaagaggaaattgaaatgtagaagttagtaacttgcctaaggatacactgctggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtggataactcctcgctcactggtgaatcagaaccccagactaggtctccagatttcacaaatgaaaaccccctggagacgaggaacattgccttcttttcaaccaattgtgttgaaggcaccgcacgtggtattgttgtctacactggggatcgcactgtgatgggaagaattgccacacttgcttctgggctggaaggaggccagacccccattgctgcagaaattgaacattttatccacatcatcacgggtgtggctgtgttcctgggtgtgtctttcttcatcctttctctcatccttgagtacacctggcttgaggctgtcatcttcctcatcggtatcatcgtagccaatgtgccggaaggtttgctggccactgtcacggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtgtctcttttgacaagacttcagctacctggcttgctctgtccagaattgcaggtctttgtaacagggcagtgtttcaggctaaccaggaaaacctacctattcttaagcgggcagttgcaggagatgcctctgagtcagcactcttaaagtgcatagagctgtgctgtggttccgtgaaggagatgagagaaagatacgccaaaatcgtcgagatacccttcaactccaccaacaagtaccagttgtctattcataagaaccccaacacatcggagccccaacacctgttggtgatgaagggcgccccagaaaggatcctagaccgttgcagctctatcctcctccacggcaaggagcagcccctggatgaggagctgaaagacgcctttcagaacgcctatttggagctggggggcctcggagaacgagtcctaggtttctgccacctctttctgccagatgaacagtttcctgaagggttccagtttgacactgacgatgtgaatttccctatcgataatctgtgctttgttgggctcatctccatgattgaccctccacgggcggccgttcctgatgccgtgggcaaatgtcgaagtgctggaattaaggtcatcatggtcacaggagaccatccaatcacagctaaagctattgccaaaggtgtgggcatcatctcagaaggcaatgagaccgtggaagacattgctgcccgcctcaacatcccagtcagccaggtgaaccccagggatgccaaggcctgcgtagtacacggcagtgatctaaaggacatgacctccgagcagctggatgacattttgaagtaccacactgagatagtgtttgccaggacctcccctcagcagaagctcatcattgtggaaggctgccaaagacagggtgctatcgtggctgtgactggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggttcctgccatctccctggcttatgagcaggctgagagtgacatcatgaagagacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaaacctacctggtggttctgtgccttcccctactctcttctcatcttcgtatatgacgaagtcagaaaactcatcatcaggcgacgccctggcggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctatggggggaggggggagggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatgg

SEQ ID NO: 109986 - DNA, 579 bp, Homo sapiens
  Payload ID: 1590
  Gene Symbol: ATP1A1
  Gene Name: ATPase, Na+/K+ transporting, alpha 1 polypeptide
  ENST ID: ENST00000440951
  CDS Start-End: 1-474
agacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaagactctgacgcagtacagttaatctgtgcacaggaaagaagagctgtttgaagaggttattcggtaaatgcagagaatgtctttgtagtataaattattgctctatataaaactgcttgtaagtttt

SEQ ID NO: 109987 - DNA, 654 bp, Homo sapiens
  Payload ID: 1590
  Gene Symbol: ATP1A1
  Gene Name: ATPase, Na+/K+ transporting, alpha 1 polypeptide
  ENST ID: ENST00000418797
  CDS Start-End: 336-654
agcgcccggggaggccatccgcaggtgggcgcggggcctggattccacagaggggcggagtccctcagtcaggcgctggctgcaatcacacccgagcgccagccccctccagcatccctgagtcccagaggagatcgccgaagcgctggaaaagccgttccgcccacgacttctggtgccgggtcggcggcgactgggggagcccagttccgagaccgtaccgcacccactgcggacctcctgggccctacatagttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcag

SEQ ID NO: 109988 - DNA, 3763 bp, Homo sapiens
  Payload ID: 1590
  Gene Symbol: ATP1A1
  Gene Name: ATPase, Na+/K+ transporting, alpha 1 polypeptide
  Uniprot ID: P05023
  ENST ID: ENST00000537345
  CDS Start-End: 364-3435
agcagcgggggcggccccgggactgagccggcatccctgagcctggctcccctccctgcgaccgccgtcacctccttctccttccttttccctccgccctccgtgccctgaggaaaggcgcgctcctccccttcccctggggcgctccgccggggcctcctcccgggcctccgttcccgccgcggccccggttccggcgggggcagcctccgggttcggggctccttctcctggggacgctggggcttagcttgctccgcgcagaggcggccgccctcccccaaagaaaaaactggctgcttctaagtgcgaagccggctgggcgggctggtgccagaaagggtgtgtcttcactgccctaagatggcctttaaggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtggataactcctcgctcactggtgaatcagaaccccagactaggtctccagatttcacaaatgaaaaccccctggagacgaggaacattgccttcttttcaaccaattgtgttgaaggcaccgcacgtggtattgttgtctacactggggatcgcactgtgatgggaagaattgccacacttgcttctgggctggaaggaggccagacccccattgctgcagaaattgaacattttatccacatcatcacgggtgtggctgtgttcctgggtgtgtctttcttcatcctttctctcatccttgagtacacctggcttgaggctgtcatcttcctcatcggtatcatcgtagccaatgtgccggaaggtttgctggccactgtcacggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtgtctcttttgacaagacttcagctacctggcttgctctgtccagaattgcaggtctttgtaacagggcagtgtttcaggctaaccaggaaaacctacctattcttaagcgggcagttgcaggagatgcctctgagtcagcactcttaaagtgcatagagctgtgctgtggttccgtgaaggagatgagagaaagatacgccaaaatcgtcgagatacccttcaactccaccaacaagtaccagttgtctattcataagaaccccaacacatcggagccccaacacctgttggtgatgaagggcgccccagaaaggatcctagaccgttgcagctctatcctcctccacggcaaggagcagcccctggatgaggagctgaaagacgcctttcagaacgcctatttggagctggggggcctcggagaacgagtcctaggtttctgccacctctttctgccagatgaacagtttcctgaagggttccagtttgacactgacgatgtgaatttccctatcgataatctgtgctttgttgggctcatctccatgattgaccctccacgggcggccgttcctgatgccgtgggcaaatgtcgaagtgctggaattaaggtcatcatggtcacaggagaccatccaatcacagctaaagctattgccaaaggtgtgggcatcatctcagaaggcaatgagaccgtggaagacattgctgcccgcctcaacatcccagtcagccaggtgaaccccagggatgccaaggcctgcgtagtacacggcagtgatctaaaggacatgacctccgagcagctggatgacattttgaagtaccacactgagatagtgtttgccaggacctcccctcagcagaagctcatcattgtggaaggctgccaaagacagggtgctatcgtggctgtgactggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggttcctgccatctccctggcttatgagcaggctgagagtgacatcatgaagagacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaaacctacctggtggttctgtgccttcccctactctcttctcatcttcgtatatgacgaagtcagaaaactcatcatcaggcgacgccctggcggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctatggggggaggggggagggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatgg

SEQ ID NO: 109989 - DNA, 5421 bp, Homo sapiens
  Payload ID: 1591
  Gene Symbol: ATP1A2
  Gene Name: ATPase, Na+/K+ transporting, alpha 2 polypeptide
  Uniprot ID: P50993
  ENST ID: ENST00000361216
  CDS Start-End: 90-3152
gtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatgaaaaaaaaa

SEQ ID NO: 109990 - DNA, 3338 bp, Homo sapiens
  Payload ID: 1591
  Gene Symbol: ATP1A2
  Gene Name: ATPase, Na+/K+ transporting, alpha 2 polypeptide
  ENST ID: ENST00000392233
  CDS Start-End: 86-3115
ccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaacctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtcc

SEQ ID NO: 109991 - DNA, 4413 bp, Homo sapiens
  Payload ID: 1591
  Gene Symbol: ATP1A2
  Gene Name: ATPase, Na+/K+ transporting, alpha 2 polypeptide
  ENST ID: ENST00000447527
  CDS Start-End: 1-2144
tccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatgaaaaaaaaa

SEQ ID NO: 109992 - DNA, 3597 bp, Homo sapiens
  Payload ID: 1592
  Gene Symbol: ATP1A3
  Gene Name: ATPase, Na+/K+ transporting, alpha 3 polypeptide
  Uniprot ID: P13637
  ENST ID: ENST00000302102
  CDS Start-End: 201-3242
tcccgcggacgcgggcatatgaggaggcggaggcggcggccgccgcagcctctgtgcggtgggaccaacggacggacggacggacgcgcgcacctaccgaggcgcgggcgctgcagaggctcccagcccaagcctgagcctgagcccgccccgaggtccccgccccgcccgcctggctctctcgccgcggagccgccaagatgggggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggttgggtggagaaggaaacctactactgacctcagccccaccacatcgcccatctcttccccgtcccccaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagagaa

SEQ ID NO: 109993 - DNA, 3818 bp, Homo sapiens
  Payload ID: 1592
  Gene Symbol: ATP1A3
  Gene Name: ATPase, Na+/K+ transporting, alpha 3 polypeptide
  ENST ID: ENST00000441343
  CDS Start-End: 139-3818
gaccaacggacggacggacggacgcgcgcacctaccgaggcgcgggcgctgcagaggctcccagcccaagcctgagcctgagcccgccccgaggtccccgccccgcccgcctggctctctcgccgcggagccgccaagatgggggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggtgagggagctcggcaaggcagccgaggggggcggggggcagcagggtctcaggcagctggtcccaggctcccctcgccctgctggatggctctgccacctggttcccactcttctctctcttcccatctctccgggcacccactctgtcttctcacgggtctctgtctgtgtggtttccttgtctctctccctctctgtccctctctctgctgggcggctcgccttgcctgtctctctccatctcttactctgtctctttctttccttctttgtctctccaggttgggtggagaaggaaacctactactgacctcagccccaccacatcgcccatctcttccccgtcccccaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagagaa

SEQ ID NO: 109994 - DNA, 3427 bp, Homo sapiens
  Payload ID: 1592
  Gene Symbol: ATP1A3
  Gene Name: ATPase, Na+/K+ transporting, alpha 3 polypeptide
  Uniprot ID: P13637
  ENST ID: ENST00000543770
  CDS Start-End: 37-3111
gtgtgtgtgtgcagcccctcatgtaggggagcaggcatgggaggctgggaggaggagaggaacaggagagccacggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggttgggtggagaaggaaacctactactgacctcagccccaccacatcgcccatctcttccccgtcccccaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctgg

SEQ ID NO: 109995 - DNA, 3618 bp, Homo sapiens
  Payload ID: 1592
  Gene Symbol: ATP1A3
  Gene Name: ATPase, Na+/K+ transporting, alpha 3 polypeptide
  Uniprot ID: P13637
  ENST ID: ENST00000545399
  CDS Start-End: 185-3265
atatgaggaggcggaggcggcggccgccgcagcctctgtgcggtgggaccaacggacggacggacggacgcgcgcacctaccgaggcgcgggcgctgcagaggctcccagcccaagcctgagcctgagcccgccccgaggtccccgccccgcccgcctggctctctcgccgcggagccgccaagatggggtctggtggctctgacagctatcgtatcgccacctcgcaggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggttgggtggagaaggaaacctactactgacctcagccccaccacatcgcccatctcttccccgtcccccaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagag

SEQ ID NO: 109996 - DNA, 889 bp, Homo sapiens
  Payload ID: 1592
  Gene Symbol: ATP1A3
  Gene Name: ATPase, Na+/K+ transporting, alpha 3 polypeptide
  ENST ID: ENST00000473086
  CDS Start-End: 136-889
gagaagactggagaaagaatagagggctgagaccagaggtgaagcgggagggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttca

SEQ ID NO: 109997 - DNA, 3458 bp, Homo sapiens
  Payload ID: 1592
  Gene Symbol: ATP1A3
  Gene Name: ATPase, Na+/K+ transporting, alpha 3 polypeptide
  ENST ID: ENST00000602133
  CDS Start-End: 154-3105
aagatgggggtaggtgctgagccggctgggcgccgcttccgtgtgacattgtggggccggtgacattgggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggttgggtggagaaggaaacctactactgacctcagccccaccacatcgcccatctcttccccgtcccccaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagag

SEQ ID NO: 109998 - DNA, 3839 bp, Homo sapiens
  Payload ID: 1593
  Gene Symbol: ATP1A4
  Gene Name: ATPase, Na+/K+ transporting, alpha 4 polypeptide
  Uniprot ID: Q13733
  ENST ID: ENST00000368081
  CDS Start-End: 472-3561
agcaaccacagggcctgggactggggggttcccagatccttgaagctcactccgcctcctcactctcactgcatttcccaccttcctgtgggccttgcggcatcttcatcactgaggcacctggttacgcttcacctcttgtttcctgccctcactgcattccctcacctctacctttttatccttccaccctaggcttctctcctccctcttccctcactcctgactcttcctcttcccagcggacggctggaggaccgctcagtctctcctctctcacttcccttcctctctctcaccttcaccacccaacacctccctccctgcctctttctttctgctccctcattctctccccaccactctcttctcgtggcccccttgcccgcgcgccctcttcccttccccttgcctcactctctcagctttcttcccacagttgagctcgggcagctctttctggggatagctatggggctttgggggaagaaagggacagtggctccccatgaccagagtccaagacgaagacctaaaaaagggcttatcaagaaaaaaatggtgaagagggaaaaacagaagcgcaatatggaggaactgaagaaggaagtggtcatggatgatcacaaattaaccttggaagagctgagcaccaagtactccgtggacctgacaaagggccatagccaccaaagggcaaaggaaatcctgactcgaggtggacccaatactgttaccccaccccccaccactccagaatgggtcaaattctgtaagcaactgttcggaggcttctccctcctactatggactggggccattctctgctttgtggcctacagcatccagatatatttcaatgaggagcctaccaaagacaacctctacctgagcatcgtactgtccgtcgtggtcatcgtcactggctgcttctcctattatcaggaggccaagagctccaagatcatggagtcttttaagaacatggtgcctcagcaagctctggtaattcgaggaggagagaagatgcaaattaatgtacaagaggtggtgttgggagacctggtggaaatcaagggtggagaccgagtccctgctgacctccggcttatctctgcacaaggatgtaaggtggacaactcatccttgactggggagtcagaaccccagagccgctcccctgacttcacccatgagaaccctctggagacccgaaacatctgcttcttttccaccaactgtgtggaaggaaccgcccggggtattgtgattgctacgggagactccacagtgatgggcagaattgcctccctgacgtcaggcctggcggttggccagacacctatcgctgctgagatcgaacacttcatccatctgatcactgtggtggccgtcttccttggtgtcactttttttgcgctctcacttctcttgggctatggttggctggaggctatcatttttctcattggcatcattgtggccaatgtgcctgaggggctgttggccacagtcactgtgtgcctgaccctcacagccaagcgcatggcgcggaagaactgcctggtgaagaacctggaggcggtggagacgctgggctccacgtccaccatctgctcagacaagacgggcaccctcacccagaaccgcatgaccgtcgcccacatgtggtttgatatgaccgtgtatgaggccgacaccactgaagaacagactggaaaaacatttaccaagagctctgatacctggtttatgctggcccgaatcgctggcctctgcaaccgggctgactttaaggctaatcaggagatcctgcccattgctaagagggccacaacaggtgatgcttccgagtcagccctcctcaagttcatcgagcagtcttacagctctgtggcggagatgagagagaaaaaccccaaggtggcagagattccctttaattctaccaacaagtaccagatgtccatccaccttcgggaggacagctcccagacccacgtactgatgatgaagggtgctccggagaggatcttggagttttgttctacctttcttctgaatgggcaggagtactcaatgaacgatgaaatgaaggaagccttccaaaatgcctacttagaactgggaggtctgggggaacgtgtgctaggcttctgcttcttgaatctgcctagcagcttctccaagggattcccatttaatacagatgaaataaatttccccatggacaacctttgttttgtgggcctcatatccatgattgaccctccccgagctgcagtgcctgatgctgtgagcaagtgtcgcagtgcaggaattaaggtgatcatggtaacaggagatcatcccattacagctaaggccattgccaagggtgtgggcatcatctcagaaggcactgagacggcagaggaagtcgctgcccggcttaagatccctatcagcaaggtcgatgccagtgctgccaaagccattgtggtgcatggtgcagaactgaaggacatacagtccaagcagcttgatcagatcctccagaaccaccctgagatcgtgtttgctcggacctcccctcagcagaagctcatcattgtcgagggatgtcagaggctgggagccgttgtggccgtgacaggtgacggggtgaacgactcccctgcgctgaagaaggctgacattggcattgccatgggcatctctggctctgacgtctctaagcaggcagccgacatgatcctgctggatgacaactttgcctccatcgtcacgggggtggaggagggccgcctgatctttgacaacctgaagaaatccatcatgtacaccctgaccagcaacatccccgagatcacgcccttcctgatgttcatcatcctcggtatacccctgcctctgggaaccataaccatcctctgcattgatctcggcactgacatggtccctgccatctccttggcttatgagtcagctgaaagcgacatcatgaagaggcttccaaggaacccaaagacggataatctggtgaaccaccgtctcattggcatggcctatggacagattgggatgatccaggctctggctggattctttacctactttgtaatcctggctgagaatggttttaggcctgttgatctgctgggcatccgcctccactgggaagataaatacttgaatgacctggaggacagctacggacagcagtggacctatgagcaacgaaaagttgtggagttcacatgccaaacggccttttttgtcaccatcgtggttgtgcagtgggcggatctcatcatctccaagactcgccgcaactcacttttccagcagggcatgagaaacaaagtcttaatatttgggatcctggaggagacactcttggctgcatttctgtcctacactccaggcatggacgtggccctgcgaatgtacccactcaagataacctggtggctctgtgccattccctacagtattctcatcttcgtctatgatgaaatcagaaaactcctcatccgtcagcacccggatggctgggtggaaagggagacgtactactaaactcagcagatgaagagcttcatgtgacacaggggtgttgtgagagctgggatggggccagagattataagtttgacacaacatctgagacactaggatgaattatcttggatgagaaagatgggcaatcctgggctggcttgagggaatcatgggcagaggatgaggtgggctgaagggaagcccagcctgcatctagctggagccccgcagggaggggcatggtcctgctgaatcccgtagccagtctagacagtaaatgtctggaaaagccctca

SEQ ID NO: 109999 - DNA, 886 bp, Homo sapiens
  Payload ID: 1593
  Gene Symbol: ATP1A4
  Gene Name: ATPase, Na+/K+ transporting, alpha 4 polypeptide
  Uniprot ID: Q13733
  ENST ID: ENST00000470705
  CDS Start-End: 111-608
caccagcccagccagaagcaagtcccagcccccagccctcccctggcctaccttttggggcccttctctgaaccaggctcccctgtcctgcaactctgtcattcacagggatgatccaggctctggctggattctttacctactttgtaatcctggctgagaatggttttaggcctgttgatctgctgggcatccgcctccactgggaagataaatacttgaatgacctggaggacagctacggacagcagtggacctatgagcaacgaaaagttgtggagttcacatgccaaacggccttttttgtcaccatcgtggttgtgcagtgggcggatctcatcatctccaagactcgccgcaactcacttttccagcagggcatgagaaacaaagtcttaatatttgggatcctggaggagacactcttggctgcatttctgtcctacactccaggcatggacgtggccctgcgaatgtacccactcaagataacctggtggctctgtgccattccctacagtattctcatcttcgtctatgatgaaatcagaaaactcctcatccgtcagcacccggatggctgggtggaaagggagacgtactactaaactcagcagatgaagagcttcatgtgacacaggggtgttgtgagagctgggatggggccagagattataagtttgacacaacatctgagacactaggatgaattatcttggatgagaaagatgggcaatcctgggctggcttgagggaatcatgggcagaggatgaggtgggctgaagggaagcccagcctgcatctagctggagccccgcagggaggggcatggtcctgctgaatcccgtagccagtctagacagtaaatgtctggaaaagccctca

SEQ ID NO: 110000 - DNA, 3800 bp, Homo sapiens
  Payload ID: 1593
  Gene Symbol: ATP1A4
  Gene Name: ATPase, Na+/K+ transporting, alpha 4 polypeptide
  ENST ID: ENST00000477338
  CDS Start-End: 456-2009
gggactggggggttcccagatccttgaagctcactccgcctcctcactctcactgcatttcccaccttcctgtgggccttgcggcatcttcatcactgaggcacctggttacgcttcacctcttgtttcctgccctcactgcattccctcacctctacctttttatccttccaccctaggcttctctcctccctcttccctcactcctgactcttcctcttcccagcggacggctggaggaccgctcagtctctcctctctcacttcccttcctctctctcaccttcaccacccaacacctccctccctgcctctttctttctgctccctcattctctccccaccactctcttctcgtggcccccttgcccgcgcgccctcttcccttccccttgcctcactctctcagctttcttcccacagttgagctcgggcagctctttctggggatagctatggggctttgggggaagaaagggacagtggctccccatgaccagagtccaagacgaagacctaaaaaagggcttatcaagaaaaaaatggtgaagagggaaaaacagaagcgcaatatggaggaactgaagaaggaagtggtcatggatgatcacaaattaaccttggaagagctgagcaccaagtactccgtggacctgacaaagggccatagccaccaaagggcaaaggaaatcctgactcgaggtggacccaatactgttaccccaccccccaccactccagaatgggtcaaattctgtaagcaactgttcggaggcttctccctcctactatggactggggccattctctgctttgtggcctacagcatccagatatatttcaatgaggagcctaccaaagacaacctctacctgagcatcgtactgtccgtcgtggtcatcgtcactggctgcttctcctattatcaggaggccaagagctccaagatcatggagtcttttaagaacatggtgcctcagcaagctctggtaattcgaggaggagagaagatgcaaattaatgtacaagaggtggtgttgggagacctggtggaaatcaagggtggagaccgagtccctgctgacctccggcttatctctgcacaaggatgtaaggtggacaactcatccttgactggggagtcagaaccccagagccgctcccctgacttcacccatgagaaccctctggagacccgaaacatctgcttcttttccaccaactgtgtggaaggaaccgcccggggtattgtgattgctacgggagactccacagtgatgggcagaattgcctccctgacgtcaggcctggcggttggccagacacctatcgctgctgagatcgaacacttcatccatctgatcactgtggtggccgtcttccttggtgtcactttttttgcgctctcacttctcttgggctatggttggctggaggctatcatttttctcattggcatcattgtggccaatgtgcctgaggggctgttggccacagtcactgtgtgcctgaccctcacagccaagcgcatggcgcggaagaactgcctggtgaagaacctggaggcggtggagacgctgggctccacgtccaccatctgctcagacaagacgggcaccctcacccagaaccgcatgaccgtcgcccacatgtggtttgatatgaccgtgtatgaggccgacaccactgaagaacagactggaaaaacatttaccaagagctctgatacctggtttatgctggcccgaatcgctggcctctgcaaccgggctgactttaaggctaatcaggagatcctgcccattgctaagagggccacaacaggtgatgcttccgagtcagccctcctcaagttcatcgagcagtcttacagctctgtggcggagatgagagagaaaaaccccaaggtggcagagattccctttaattctaccaacaagtaccaggtacagaacccacaaagatgtccatccaccttcgggaggacagctcccagacccacgtactgatgatgaagggtgctccggagaggatcttggagttttgttctacctttcttctgaatgggcaggagtactcaatgaacgatgaaatgaaggaagccttccaaaatgcctacttagaactgggaggtctgggggaacgtgtgctaggcttctgcttcttgaatctgcctagcagcttctccaagggattcccatttaatacagatgaaataaatttccccatggacaacctttgttttgtgggcctcatatccatgattgaccctccccgagctgcagtgcctgatgctgtgagcaagtgtcgcagtgcaggaattaaggtgatcatggtaacaggagatcatcccattacagctaaggccattgccaagggtgtgggcatcatctcagaaggcactgagacggcagaggaagtcgctgcccggcttaagatccctatcagcaaggtcgatgccagtgctgccaaagccattgtggtgcatggtgcagaactgaaggacatacagtccaagcagcttgatcagatcctccagaaccaccctgagatcgtgtttgctcggacctcccctcagcagaagctcatcattgtcgagggatgtcagaggctgggagccgttgtggccgtgacaggtgacggggtgaacgactcccctgcgctgaagaaggctgacattggcattgccatgggcatctctggctctgacgtctctaagcaggcagccgacatgatcctgctggatgacaactttgcctccatcgtcacgggggtggaggagggccgcctgatctttgacaacctgaagaaatccatcatgtacaccctgaccagcaacatccccgagatcacgcccttcctgatgttcatcatcctcggtatacccctgcctctgggaaccataaccatcctctgcattgatctcggcactgacatggtccctgccatctccttggcttatgagtcagctgaaagcgacatcatgaagaggcttccaaggaacccaaagacggataatctgggatgatccaggctctggctggattctttacctactttgtaatcctggctgagaatggttttaggcctgttgatctgctgggcatccgcctccactgggaagataaatacttgaatgacctggaggacagctacggacagcagtggacctatgagcaacgaaaagttgtggagttcacatgccaaacggccttttttgtcaccatcgtggttgtgcagtgggcggatctcatcatctccaagactcgccgcaactcacttttccagcagggcatgagaaacaaagtcttaatatttgggatcctggaggagacactcttggctgcatttctgtcctacactccaggcatggacgtggccctgcgaatgtacccactcaagataacctggtggctctgtgccattccctacagtattctcatcttcgtctatgatgaaatcagaaaactcctcatccgtcagcacccggatggctgggtggaaagggagacgtactactaaactcagcagatgaagagcttcatgtgacacaggggtgttgtgagagctgggatggggccagagattataagtttgacacaacatctgagacactaggatgaattatcttggatgagaaagatgggcaatcctgggctggcttgagggaatcatgggcagaggatgaggtgggctgaagggaagcccagcctgcatctagctggagccccgcagggaggggcatggtcctgctgaatcccgtagccagtctagacagtaaatgtctggaaaagccctca

SEQ ID NO: 110001 - DNA, 1883 bp, Homo sapiens
  Payload ID: 1594
  Gene Symbol: ATP1B1
  Gene Name: ATPase, Na+/K+ transporting, beta 1 polypeptide
  Uniprot ID: P05026
  ENST ID: ENST00000367815
  CDS Start-End: 508-1419
aattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccgcccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaa

SEQ ID NO: 110002 - DNA, 2608 bp, Homo sapiens
  Payload ID: 1594
  Gene Symbol: ATP1B1
  Gene Name: ATPase, Na+/K+ transporting, beta 1 polypeptide
  Uniprot ID: P05026
  ENST ID: ENST00000367816
  CDS Start-End: 530-1441
gcccacaaggggcacagccgggcagtcaggaaccggggctgccggctgggctggcctgcaaagaagagggaagggccggaactgcaaccgcagtggcggggagtgcgagggggcggcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccgcccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaattttttttttttttttttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacattc

SEQ ID NO: 110003 - DNA, 718 bp, Homo sapiens
  Payload ID: 1594
  Gene Symbol: ATP1B1
  Gene Name: ATPase, Na+/K+ transporting, beta 1 polypeptide
  ENST ID: ENST00000494797
  CDS Start-End: 329-718
atcatgaccatcaccaccaacaccactggcaccaccactgcagtcattcagggagtcctgaacagaggccgattggtgttcctgcttgggaggatctgtgggaatcggcaggagaatgagtcagggaaatagtgcttagctgacattttgaaatggaagaagctggaatatatgaatttttgtaaagaaaaaaaaatgcagcctgtgagtctctcttgattgaaaattaaagggttaataatgcatcacacttcaagttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttc

SEQ ID NO: 110004 - DNA, 3153 bp, Homo sapiens
  Payload ID: 1595
  Gene Symbol: ATP1B2
  Gene Name: ATPase, Na+/K+ transporting, beta 2 polypeptide
  Uniprot ID: P14415
  ENST ID: ENST00000250111
  CDS Start-End: 408-1280
ccacctctctctgcctttttgtaccccgctttttttctgcgttctgctcggtttttgtagccgtctgtttttgcaccccatttcgttttgtttctagacggtttggtggggggtgaagctgcattcataccccttcctcttgttattctcccctgctctgacagcaccccttttcatcgcagttggggggcctaggatcggtgcatcttccgccgcgctgccagcaccccgcagcgcgtggtcgtgcaccccggaatctgcagcagctgcatatctgaggggggtctcctttgcccgcgccgccttcgctccccgtgcttttgggtgtgtggagggcttcagcgcgcggcgcccccgcttctccgcaaccccccgccccgcgcccggactcgccccgcgccaccaagatggtcatccagaaagagaagaagagctgcgggcaggtggttgaggagtggaaggagttcgtgtggaacccgaggacgcaccagtttatgggccgcaccgggaccagctgggcctttatcctcctcttctacctcgttttttatgggttcctcaccgccatgttcaccctcaccatgtgggtgatgctgcagactgtctccgaccatacccccaagtaccaggaccgactggccacaccgggcttgatgattcgccccaagactgagaaccttgatgtcattgtcaatgtcagtgacactgaaagctgggaccagcatgttcagaagctcaacaagttcttggagccttacaacgactctatccaagcccaaaagaatgatgtctgccgccctggacgctattacgaacagccagataatggagtcctcaactaccccaaacgtgcctgccaattcaaccggacccagctgggcaactgctccggcattggggactccacccactatggttacagcactgggcagccctgtgtcttcatcaagatgaaccgggtcatcaacttctatgcaggagcaaaccagagcatgaatgttacctgtgctgggaagcgagatgaagatgctgagaatctcggcaacttcgtcatgttccccgccaacggcaacatcgacctcatgtacttcccctactatggcaaaaagttccacgtgaactacacacagcccctggtggctgtgaagttcctgaatgtgacccccaacgtggaggtgaatgtagaatgtcgcatcaacgccgccaacatcgccacagacgatgagcgagacaagttcgccggccgcgtggccttcaaactccgcatcaacaaaacctgaggccccttcctcccaccccatctctctcctgtggatgctcctggaatgtccctgaccctgcctgatccctccctcacccaccccaaaggtatttttgataacagagctatgacttgtctgagcctcacatccttttccttgacttctcaacccagcctgaagtccattgcggttccgtcactcgcctttcccaccaacttctcccaacctcagatcagtcagacagggagctgggctaagatggccacggaggagttaggagcctttctagttctggtttagctgtgagagctatccactctcctgcctgcatatcccctgagagttataggaagtgcccactgacccacccacccacctacaccccccgccacacacacacacaaacgtgcacacgcgtctcatttgacccctttgcttccagagatgaatgtggcactccctccttccattcctaagctctggccaccgtcccttgatctctcatactttctccctgtctacacagtcgccatcttggtgactttgaatttatctggctcctgggcaggtcttctcctcctctccatccctattccctcctctgaaatgcacccctttgtaattgaggacaaggtggttctgtggccttttccctctttgctggcacgttctgcttctcaccctctggtgactctgtgagctgggaaatgagggactggaagtgaggcctgtgttgacccttcctgaaaatcctctagcagcccccgacttcagcagtttctttctttgtttttttgagatggagtttcgctcttgttgcccaggctggagtgcaatggtgcaatctcagctcactgcaacttccgcatcccaggttcaagcgattctcccgcctcaggttcccgagtagctgggactacaggcatgtgccaccatgcccggctaatttctttctttctttttttttttttttgcattttttagtagagatgggggtttctccttgttggtcaggctggtctcgaactcccgacctcaggtgatccacctgcctcggcctcccaaagtgttgggattacaggcgtgagccaccgcgcccggccttcagtttcttcctaggccgttctgtcacccaaatagctgctacccagaggggcggggttgacctaggctgaatatccactttgtttttatggatggctcccttcccccattcgccttcccagaatatccttcaagttccacttcccagggagctctgggggaggggcggccattctggctccgtccccagtggccaccttggaaacatcggctggctttgggactattccacctccttcccctgagcccagatctgcccccaccatcctttctctggcttcttttagcaagttatcaactaatcactaactccttccttttcctctgcatgccagcctgaaaattccaaatctagcctctgaatgtcttggctccatctcttcagacccctttgcctttaaaaaaaaaacaaaaacaaaaacaaaaaaacccataatgcccacagaatgtcaaatgaggggcctcctgcctcctgctctgaatattctgtagctgtagaggcattttaaccctttgtcctccagcatcccttcacttcctcatcctctctaacctcctttttctttttttaatgctgcagcctccacactccacccacaggtggacccttccctttttctctagctggatctgtgtttcttcccttcgggcccccatgttttcctgcacccgccctaccatggtctctctctgcagttatttaatgcctgtgtcagatctactgtaaaaagaggattaagtaaaataaaatgagagcaattatatatataaatatatatcatacaca

SEQ ID NO: 110005 - DNA, 580 bp, Homo sapiens
  Payload ID: 1595
  Gene Symbol: ATP1B2
  Gene Name: ATPase, Na+/K+ transporting, beta 2 polypeptide
  ENST ID: ENST00000577026
  CDS Start-End: 81-580
agatgcaacatggacacagaattctggggaacctacaacgtgtgggagttcagccagactccagatgagtataaggcttgatgattcgccccaagactgagaaccttgatgtcattgtcaatgtcagtgacactgaaagctgggaccagcatgttcagaagctcaacaagttcttggagccttacaacgactctatccaagcccaaaagaatgatgtctgccgccctggacgctattacgaacagccagataatggagtcctcaactaccccaaacgtgcctgccaattcaaccggacccagctgggcaactgctccggcattggggactccacccactatggttacagcactgggcagccctgtgtcttcatcaagatgaaccgggtcatcaacttctatgcaggagcaaaccagagcatgaatgttacctgtgctgggaagcgagatgaagatgctgagaatctcggcaacttcgtcatgttccccgccaacggcaacatcgacctcatgtacttcccctactatggcaaaaagttccacgtgaactacacacagcccctggtggctgtgaagttcct

SEQ ID NO: 110006 - DNA, 557 bp, Homo sapiens
  Payload ID: 1595
  Gene Symbol: ATP1B2
  Gene Name: ATPase, Na+/K+ transporting, beta 2 polypeptide
  ENST ID: ENST00000577113
  CDS Start-End: 1-518
acgaacagccagataatggagtcctcaactaccccaaacgtgcctgccaattcaaccggacccagctgggcaactgctccggcattggggactccacccactatggttacagcactgggcagccctgtgtcttcatcaagatgaaccgggtcatcaacttctatgcaggagcaaaccagagcatgaatgttacctgtgctgggaagaggccccatcaccatagaaacaaggggaaactgattcctgaggatgggcgagatgaagatgctgagaatctcggcaacttcgtcatgttccccgccaacggcaacatcgacctcatgtacttcccctactatggcaaaaagttccacgtgaactacacacagcccctggtggctgtgaagttcctgaatgtgacccccaacgtggaggtgaatgtagaatgtcgcatcaacgccgccaacatcgccacagacgatgagcgagacaagttcgccggccgcgtggccttcaaactccgcatcaacaaaacctgaggccccttcctcccaccccatctctctcctgtggatgct

SEQ ID NO: 110007 - DNA, 1811 bp, Homo sapiens
  Payload ID: 1596
  Gene Symbol: ATP1B3
  Gene Name: ATPase, Na+/K+ transporting, beta 3 polypeptide
  Uniprot ID: P54709
  ENST ID: ENST00000286371
  CDS Start-End: 189-1028
ccaagcggccgcccggcgcggcgcggcgcagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtgga

SEQ ID NO: 110008 - DNA, 734 bp, Homo sapiens
  Payload ID: 1596
  Gene Symbol: ATP1B3
  Gene Name: ATPase, Na+/K+ transporting, beta 3 polypeptide
  ENST ID: ENST00000475483
  CDS Start-End: 334-734
gtcacagagcccagagagcgtcctgtaggaacgtcacagagcccagagaacgcctggggacggtcggggaggcagttcggggaggggacgattaagttccctcagagaggaagccgcgggccgactggagtcgttttcgtgctctccgcacccgcccgccgcgggtagcatcttctcagcgccccggcgcccaggaacgcccaggaaacccagtcctcctcctaagcaacctgcggcgcggggacgcccgccttttgctattattataaacgtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattg

SEQ ID NO: 110009 - DNA, 421 bp, Homo sapiens
  Payload ID: 1596
  Gene Symbol: ATP1B3
  Gene Name: ATPase, Na+/K+ transporting, beta 3 polypeptide
  ENST ID: ENST00000487199
  CDS Start-End: 1-84
ataattggattaaagcctgaaggagtgccaaggatagattgtgtttcaaagttagttggcgtgctagtcatcagtgctatctgagatttaatgaaatatggtgcattttccttaagacaaataatgtaaaagatggaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaa

SEQ ID NO: 110010 - DNA, 1951 bp, Homo sapiens
  Payload ID: 1596
  Gene Symbol: ATP1B3
  Gene Name: ATPase, Na+/K+ transporting, beta 3 polypeptide
  ENST ID: ENST00000465172
  CDS Start-End: 187-321
aagcggccgcccggcgcggcgcggcgcagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggatcgcagtatgtggtagggaagtgatgctgtctgaaggtgacatcctgttctcctctcttctgtcctctccatccttattttggccacctggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagacaaataatgtaaaagatggaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatat

SEQ ID NO: 110011 - DNA, 837 bp, Homo sapiens
  Payload ID: 1596
  Gene Symbol: ATP1B3
  Gene Name: ATPase, Na+/K+ transporting, beta 3 polypeptide
  ENST ID: ENST00000462082
  CDS Start-End: 87-356
cttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataa

SEQ ID NO: 110012 - DNA, 1708 bp, Homo sapiens
  Payload ID: 1596
  Gene Symbol: ATP1B3
  Gene Name: ATPase, Na+/K+ transporting, beta 3 polypeptide
  ENST ID: ENST00000466678
  CDS Start-End: 1-131
cgaagaacgagaagaagtccctcaaccagagcctggccgagtggaagctcttcatctacaacccgaccaccggagaattcctggggcgcaccgccaagagctggggatcgcagtatgtggtagggaagtgatgctgtctgaaggtgacatcctgttctcctctcttctgtcctctccatccttattttggccacctggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgt

SEQ ID NO: 110013 - DNA, 418 bp, Homo sapiens
  Payload ID: 1596
  Gene Symbol: ATP1B3
  Gene Name: ATPase, Na+/K+ transporting, beta 3 polypeptide
  ENST ID: ENST00000495216
  CDS Start-End: 60-418
cttgaatttggacagtgaaaaggcccttaaaaaggatcgcagtatgtggtagggaagtgatgctgtctgaaggtgacatcctgttctcctctcttctgtcctctccatccttattttggccacctggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttt

SEQ ID NO: 110014 - DNA, 3868 bp, Homo sapiens
  Payload ID: 1597
  Gene Symbol: ATP1B4
  Gene Name: ATPase, Na+/K+ transporting, beta 4 polypeptide
  Uniprot ID: Q9UN42
  ENST ID: ENST00000218008
  CDS Start-End: 58-1131
ctccagaactctcacccgattgcctgcctctgctgcgtctttgcccactgaacagccatgagaaggcaactccggtccagaagggctccatcctttccttacagttatcgctacagactcgatgatccggatgaagcgaaccagaactacttagcagatgaagaggaggaagcagaagaagaggctcgggtgacggtggtgcccaaatcggaggaggaggaagaagaggaggagaaagaagaggaggaagaggaggaaaaggaggaggaagagggtcaaggtcagccaacaggcaatgcctggtggcagaaattgcagatcatgagtgaatacctgtgggatccagagagaaggatgtttctggcccgaacaggtcagagttggagcctgatcttactcatttacttcttcttctatgcctccttggctgctgtgatcaccctctgcatgtacacactatttctgaccatcagtccctatataccaaccttcacggagcgggtaaagcctcctggagttatgatcagacccttcgcccatagccttaacttcaacttcaacgtttctgaacccgacacttggcagcattatgtgattagcctaaatggctttctccagggttataatgacagtcttcaagaggaaatgaatgtagattgtcccccggggcagtacttcatccaagatggcaatgaggatgaggacaagaaggcctgccaatttaagcgctccttcctaaagaactgctctggtctggaggacccaacttttggatactctactggacagccctgcatccttctaaagatgaaccggattgtaggctttcgtcctgagcttggagatcctgtgaaggtttcctgcaaagttcagagaggtgatgaaaatgacatccgatccatcagttactacccagagtcggcttcttttgacctccgctactacccttactacggcaaactgactcacgttaactacacatcccccttggtggcaatgcactttacagacgtggtgaagaaccaagcagtgcctgtgcagtgccaactgaagggcaaaggcgtcataaatgatgtcatcaatgatcgttttgtgggcagggtaatctttaccctgaacatagaaacttaagaacttcagggggccattcttaccagttctgtttctgttttatctcatggtatctctggtagcacctgaattctttttcttcaattaggacacagccagatggacatctaagacagccgatcatctttccttgcctatgacatgtgtataaaatgacattgtgggagctgttcgattttttaaaggtagtgtctcctgatgacaaacagagtatattaatttcctttccctccacttaaaactaaagcctgttcttgctgctggtaatctccctgtagcgtaaacatagtatctgataaaatttacaatagccacgcaatagccatcaaggagaatttctattatgattataaattcatcatgttttctaaaattctgttggttttagaggtcagattcctcccaaccaggctaataacctaacacatgtttaaaaaaaatctgcctaagccgggtgtggtggcatgcatctgtagtcccacctattcaggagattaaggcaggaggatcacttgagcccaggaggtcaaggctgcagtgagctgcactgcattccagcctgggtgacagagtgagatcctgtctctgaagaaaaaaaaaacctgcctggcaaggtccttccctgggaatcaccactcggtccaacctagacaaccaagaccgctatacctaaagacctctatatcctggtgcctaagaaacttctgcctcccacagacaactaagtgcttattcaaagactaggttattttcaactgggaaaaaagcagtgctaacaggatattgttctgggatagagatgaagaccgtccttgtgactttttaaagaggtggggctcactgcaactggggagaacacttagcatatggatatgattggtgtttgattccttgctctctggtgtaatcgtctaaaggcaaacattcctgcaaacaggtttttctcagcttcaggcagaggagacaacatggaagaagattcccaccagctaattcttcttgggctatttgtttgacagtagcatgatgttttttgagaccatcaggggtggttacatagaccagcagctacagctctggaaattgaaatcataatctgtcaatgaatacatgacaagacagaacgttccttgccaggccaggcaaaagccaaggcccattagccagtttagcatttactttaaaaatgacatgaggcagattcttatccaggatgtggatcagccaggtcactttgtcttatctttggtcacctgatcactcaactgcttcttaacacctccaccagggggaaggctggcacaaggagaaaaaaaaagcaagcatcagcgaatagtatagtgtctcagggtccgaagcaagtttaaatgccacctaggaggatccaaagtctgaatctcctctacaatgtttcctttctcccaaaacagggaactgactgtctggtagtgaagacaagcaagtggagaagttatacgatatagtttaatgagagttaaaaaactagtatgtggaaagctatgggaatatgaggaaaaatatcttgagctaagaaagtagcagaggaaatttcacatgcaaagccacagtcatgaagagaccatggtgtgtctgggtaactgtgagcagtttatgtaactggaatgaaaagggctcagaggaatggcagggatggcaagagatccagctagagaggtattcagggatggaaagaggactttgagttttatccaataggtgaaaatgagtaattaaagcattttaatcagggaggctctgtgatcacatttgtgttttattttattttactttattatttatttgtttatttttgagatggagtttcgctgttgtcacccaggctggagtgcagtggtgtgatctcggctcactgcaacctccacctcccggattcaagtgattctccagcctcagcctcctgagtagctgggattacaggcacacaccaccatgcccagctaacttttgtatttttggcggagacagggtttcaccatgttggccaggctggtctcgaactcctgacctcaagtgatccgcctgcctcagcctcccacagtgctgggattacaggcgtgagccaccgcacccggcttgcaatttagaaagggcacttggcaaccactatgtgaagggtgattggagaaggacaagactgtggaatggggaataaggaaggaggagtttggagaatgactccaaaggtttgagcttggctagaaccggtaagatggtgacattgttgatcaagactgggaatataagagagaagcaggtttggagagatcaattttgaacattttagacatgattttctattggtcagacattgatgtggagatgtaaacacatgtagggttggtgagaaggaaagatgagaacaaaagcaacattgggttaagggaactcgcttaagaaattttaagctatttaatcttgggaactgaagccagtcatgtaaacatactataccaatctagtccctaacagtgttttttctcttgtggcagaaagaattgctgttcctctttggaatctccttcccagacaccttcaaagtcttattgacacagtaaagggaggccaaccactactaacaagttctagaagatataggatcttctatagtaggttaatggaaaatacaaaaacaaacaaacatacaatgaaactgcctcctctcaacccattttcttaacaaattcaattttcaaaa

SEQ ID NO: 110015 - DNA, 3856 bp, Homo sapiens
  Payload ID: 1597
  Gene Symbol: ATP1B4
  Gene Name: ATPase, Na+/K+ transporting, beta 4 polypeptide
  Uniprot ID: Q9UN42
  ENST ID: ENST00000361319
  CDS Start-End: 58-1119
ctccagaactctcacccgattgcctgcctctgctgcgtctttgcccactgaacagccatgagaaggcaactccggtccagaagggctccatcctttccttacagttatcgctacagactcgatgatccggatgaagcgaaccagaactacttagcagatgaagaggaggaagcagaagaagaggctcgggtgacggtggtgcccaaatcggaggaggaggaagaagaggaggagaaagaagaggaggaagaggaggaaaaggaggaggaagagggtcaaggtcagccaacaggcaatgcctggtggcagaaattgcagatcatgagtgaatacctgtgggatccagagagaaggatgtttctggcccgaacaggcctgatcttactcatttacttcttcttctatgcctccttggctgctgtgatcaccctctgcatgtacacactatttctgaccatcagtccctatataccaaccttcacggagcgggtaaagcctcctggagttatgatcagacccttcgcccatagccttaacttcaacttcaacgtttctgaacccgacacttggcagcattatgtgattagcctaaatggctttctccagggttataatgacagtcttcaagaggaaatgaatgtagattgtcccccggggcagtacttcatccaagatggcaatgaggatgaggacaagaaggcctgccaatttaagcgctccttcctaaagaactgctctggtctggaggacccaacttttggatactctactggacagccctgcatccttctaaagatgaaccggattgtaggctttcgtcctgagcttggagatcctgtgaaggtttcctgcaaagttcagagaggtgatgaaaatgacatccgatccatcagttactacccagagtcggcttcttttgacctccgctactacccttactacggcaaactgactcacgttaactacacatcccccttggtggcaatgcactttacagacgtggtgaagaaccaagcagtgcctgtgcagtgccaactgaagggcaaaggcgtcataaatgatgtcatcaatgatcgttttgtgggcagggtaatctttaccctgaacatagaaacttaagaacttcagggggccattcttaccagttctgtttctgttttatctcatggtatctctggtagcacctgaattctttttcttcaattaggacacagccagatggacatctaagacagccgatcatctttccttgcctatgacatgtgtataaaatgacattgtgggagctgttcgattttttaaaggtagtgtctcctgatgacaaacagagtatattaatttcctttccctccacttaaaactaaagcctgttcttgctgctggtaatctccctgtagcgtaaacatagtatctgataaaatttacaatagccacgcaatagccatcaaggagaatttctattatgattataaattcatcatgttttctaaaattctgttggttttagaggtcagattcctcccaaccaggctaataacctaacacatgtttaaaaaaaatctgcctaagccgggtgtggtggcatgcatctgtagtcccacctattcaggagattaaggcaggaggatcacttgagcccaggaggtcaaggctgcagtgagctgcactgcattccagcctgggtgacagagtgagatcctgtctctgaagaaaaaaaaaacctgcctggcaaggtccttccctgggaatcaccactcggtccaacctagacaaccaagaccgctatacctaaagacctctatatcctggtgcctaagaaacttctgcctcccacagacaactaagtgcttattcaaagactaggttattttcaactgggaaaaaagcagtgctaacaggatattgttctgggatagagatgaagaccgtccttgtgactttttaaagaggtggggctcactgcaactggggagaacacttagcatatggatatgattggtgtttgattccttgctctctggtgtaatcgtctaaaggcaaacattcctgcaaacaggtttttctcagcttcaggcagaggagacaacatggaagaagattcccaccagctaattcttcttgggctatttgtttgacagtagcatgatgttttttgagaccatcaggggtggttacatagaccagcagctacagctctggaaattgaaatcataatctgtcaatgaatacatgacaagacagaacgttccttgccaggccaggcaaaagccaaggcccattagccagtttagcatttactttaaaaatgacatgaggcagattcttatccaggatgtggatcagccaggtcactttgtcttatctttggtcacctgatcactcaactgcttcttaacacctccaccagggggaaggctggcacaaggagaaaaaaaaagcaagcatcagcgaatagtatagtgtctcagggtccgaagcaagtttaaatgccacctaggaggatccaaagtctgaatctcctctacaatgtttcctttctcccaaaacagggaactgactgtctggtagtgaagacaagcaagtggagaagttatacgatatagtttaatgagagttaaaaaactagtatgtggaaagctatgggaatatgaggaaaaatatcttgagctaagaaagtagcagaggaaatttcacatgcaaagccacagtcatgaagagaccatggtgtgtctgggtaactgtgagcagtttatgtaactggaatgaaaagggctcagaggaatggcagggatggcaagagatccagctagagaggtattcagggatggaaagaggactttgagttttatccaataggtgaaaatgagtaattaaagcattttaatcagggaggctctgtgatcacatttgtgttttattttattttactttattatttatttgtttatttttgagatggagtttcgctgttgtcacccaggctggagtgcagtggtgtgatctcggctcactgcaacctccacctcccggattcaagtgattctccagcctcagcctcctgagtagctgggattacaggcacacaccaccatgcccagctaacttttgtatttttggcggagacagggtttcaccatgttggccaggctggtctcgaactcctgacctcaagtgatccgcctgcctcagcctcccacagtgctgggattacaggcgtgagccaccgcacccggcttgcaatttagaaagggcacttggcaaccactatgtgaagggtgattggagaaggacaagactgtggaatggggaataaggaaggaggagtttggagaatgactccaaaggtttgagcttggctagaaccggtaagatggtgacattgttgatcaagactgggaatataagagagaagcaggtttggagagatcaattttgaacattttagacatgattttctattggtcagacattgatgtggagatgtaaacacatgtagggttggtgagaaggaaagatgagaacaaaagcaacattgggttaagggaactcgcttaagaaattttaagctatttaatcttgggaactgaagccagtcatgtaaacatactataccaatctagtccctaacagtgttttttctcttgtggcagaaagaattgctgttcctctttggaatctccttcccagacaccttcaaagtcttattgacacagtaaagggaggccaaccactactaacaagttctagaagatataggatcttctatagtaggttaatggaaaatacaaaaacaaacaaacatacaatgaaactgcctcctctcaacccattttcttaacaaattcaattttcaaaa

SEQ ID NO: 110016 - DNA, 4644 bp, Homo sapiens
  Payload ID: 1597
  Gene Symbol: ATP1B4
  Gene Name: ATPase, Na+/K+ transporting, beta 4 polypeptide
  ENST ID: ENST00000539306
  CDS Start-End: 85-1029
aaccagtgtctcctgtaccagcagaagctccagaactctcacccgattgcctgcctctgctgcgtctttgcccactgaacagccatgagaaggcaactccggtccagaagggctccatcctttccttacagttatcgctacagactcgatgatccggatgaagcgaaccagaactacttagcagatgaagaggaggaagcagaagaagaggctcgggtgacggtggtgcccaaatcggaggaggaggaagaagaggaggagaaagaagaggaggaagaggaggaaaaggaggaggaagagggtcaaggtcagccaacaggcaatgcctggtggcagaaattgcagatcatgagtgaatacctgtgggatccagagagaaggatgtttctggcccgaacaggtcagagttggagagttatgatcagacccttcgcccatagccttaacttcaacttcaacgtttctgaacccgacacttggcagcattatgtgattagcctaaatggctttctccagggttataatgacagtcttcaagaggaaatgaatgtagattgtcccccggggcagtacttcatccaagatggcaatgaggatgaggacaagaaggcctgccaatttaagcgctccttcctaaagaactgctctggtctggaggacccaacttttggatactctactggacagccctgcatccttctaaagatgaaccggattgtaggctttcgtcctgagcttggagatcctgtgaaggtttcctgcaaagttcagagaggtgatgaaaatgacatccgatccatcagttactacccagagtcggcttcttttgacctccgctactacccttactacggcaaactgactcacgttaactacacatcccccttggtggcaatgcactttacagacgtggtgaagaaccaagcagtgcctgtgcagtgccaactgaagggcaaaggcgtcataaatgatgtcatcaatgatcgttttgtgggcagggtaatctttaccctgaacatagaaacttaagaacttcagggggccattcttaccagttctgtttctgttttatctcatggtatctctggtagcacctgaattctttttcttcaattaggacacagccagatggacatctaagacagccgatcatctttccttgcctatgacatgtgtataaaatgacattgtgggagctgttcgattttttaaaggtagtgtctcctgatgacaaacagagtatattaatttcctttccctccacttaaaactaaagcctgttcttgctgctggtaatctccctgtagcgtaaacatagtatctgataaaatttacaatagccacgcaatagccatcaaggagaatttctattatgattataaattcatcatgttttctaaaattctgttggttttagaggtcagattcctcccaaccaggctaataacctaacacatgtttaaaaaaaatctgcctaagccgggtgtggtggcatgcatctgtagtcccacctattcaggagattaaggcaggaggatcacttgagcccaggaggtcaaggctgcagtgagctgcactgcattccagcctgggtgacagagtgagatcctgtctctgaagaaaaaaaaaacctgcctggcaaggtccttccctgggaatcaccactcggtccaacctagacaaccaagaccgctatacctaaagacctctatatcctggtgcctaagaaacttctgcctcccacagacaactaagtgcttattcaaagactaggttattttcaactgggaaaaaagcagtgctaacaggatattgttctgggatagagatgaagaccgtccttgtgactttttaaagaggtggggctcactgcaactggggagaacacttagcatatggatatgattggtgtttgattccttgctctctggtgtaatcgtctaaaggcaaacattcctgcaaacaggtttttctcagcttcaggcagaggagacaacatggaagaagattcccaccagctaattcttcttgggctatttgtttgacagtagcatgatgttttttgagaccatcaggggtggttacatagaccagcagctacagctctggaaattgaaatcataatctgtcaatgaatacatgacaagacagaacgttccttgccaggccaggcaaaagccaaggcccattagccagtttagcatttactttaaaaatgacatgaggcagattcttatccaggatgtggatcagccaggtcactttgtcttatctttggtcacctgatcactcaactgcttcttaacacctccaccagggggaaggctggcacaaggagaaaaaaaaagcaagcatcagcgaatagtatagtgtctcagggtccgaagcaagtttaaatgccacctaggaggatccaaagtctgaatctcctctacaatgtttcctttctcccaaaacagggaactgactgtctggtagtgaagacaagcaagtggagaagttatacgatatagtttaatgagagttaaaaaactagtatgtggaaagctatgggaatatgaggaaaaatatcttgagctaagaaagtagcagaggaaatttcacatgcaaagccacagtcatgaagagaccatggtgtgtctgggtaactgtgagcagtttatgtaactggaatgaaaagggctcagaggaatggcagggatggcaagagatccagctagagaggtattcagggatggaaagaggactttgagttttatccaataggtgaaaatgagtaattaaagcattttaatcagggaggctctgtgatcacatttgtgttttattttattttactttattatttatttgtttatttttgagatggagtttcgctgttgtcacccaggctggagtgcagtggtgtgatctcggctcactgcaacctccacctcccggattcaagtgattctccagcctcagcctcctgagtagctgggattacaggcacacaccaccatgcccagctaacttttgtatttttggcggagacagggtttcaccatgttggccaggctggtctcgaactcctgacctcaagtgatccgcctgcctcagcctcccacagtgctgggattacaggcgtgagccaccgcacccggcttgcaatttagaaagggcacttggcaaccactatgtgaagggtgattggagaaggacaagactgtggaatggggaataaggaaggaggagtttggagaatgactccaaaggtttgagcttggctagaaccggtaagatggtgacattgttgatcaagactgggaatataagagagaagcaggtttggagagatcaattttgaacattttagacatgattttctattggtcagacattgatgtggagatgtaaacacatgtagggttggtgagaaggaaagatgagaacaaaagcaacattgggttaagggaactcgcttaagaaattttaagctatttaatcttgggaactgaagccagtcatgtaaacatactataccaatctagtccctaacagtgttttttctcttgtggcagaaagaattgctgttcctctttggaatctccttcccagacaccttcaaagtcttattgacacagtaaagggaggccaaccactactaacaagttctagaagatataggatcttctatagtaggttaatggaaaatacaaaaacaaacaaacatacaatgaaactgcctcctctcaacccattttcttaacaaattcaattttcaaaactaacctttaaaaagaaaaggaacaaaatgaaaaagacaataacttttaaaccacttgaaaattacctcaatcaaactctcaagattcagtagtaaaagataatagaatgttagatctggaaaggatattagagagtgtttagaaaaaacaacttgcattgcatctgactccaggtccagtgctctttctactctgagctgctgcttaccagaaagtaccatcttcttaaaaatcaatgaatgatatcccaaacattttgaaacgtatgtaaattttgagttaaaatagttaacatttcacaggaattcaactactggtgctatactttatacataatacattatcctgttaaatgcattgactattagacaaggaattatgaatcatttgtcaaataatatttatctttcaatggaatccattgtgtccacaattgcaaagcaatattgaagggtactaagatagtttgggttgtcagctaggacatgaaaaatgtaggtttactatacagaactggatatgataatatattcattaaagttatgttctaactgttcaatagacttctagtagattaatttaaatagttccccataccgtgctgcatcaggatttgatttgtatgccatctgttgcaatgcacttggttttacttgcttgtcaatgagaaatactacttccaaatgtcttcatggttttgtccatactggactttgggttatgatttttcaccttctactcccctgaaatcattatcctaaagtaactttttttaggcacctattttctggggatcaacatgtaaaaaaacatttatattgtcttgaggagttgtcaacaacaataaattgaaataaaaaagaaatgtatgattttc

SEQ ID NO: 110017 - DNA, 923 bp, Homo sapiens
  Payload ID: 1598
  Gene Symbol: ABCA1
  Gene Name: ATP-binding cassette, sub-family A (ABC1), member 1
  ENST ID: ENST00000374733
  CDS Start-End: 320-691
gtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagtgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtaagctgatgcctccagcttcctcagtagggctgatggcaattacgttgtgcagctactggaaagaaatgaataaacccttgtccttgtaatggtggtgaaggggagggaggtagtttgaatacaacttcacttaattttacttccctattcaggcaggaattgccaaaccatccaggagtggaatatgcaacctggcgtcatgggccagctggttaaaataaaattgatttctggctta

SEQ ID NO: 110018 - DNA, 10494 bp, Homo sapiens
  Payload ID: 1598
  Gene Symbol: ABCA1
  Gene Name: ATP-binding cassette, sub-family A (ABC1), member 1
  Uniprot ID: O95477
  ENST ID: ENST00000374736
  CDS Start-End: 396-7181
agagcacaggctttgaccgatagtaacctctgcgctcggtgcagccgaatctataaaaggaactagtcccggcaaaaaccccgtaattgcgagcgagagtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagttaatgaccagccacggcgtccctgctgtgagctctggccgctgccttccagggctcccgagccacacgctgggggtgctggctgagggaacatggcttgttggcctcagctgaggttgctgctgtggaagaacctcactttcagaagaagacaaacatgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaagggagaaactggctgcagcagagcgagtacttcgttccaacatggacatcctgaagccaatcctgagaacactaaactctacatctcccttcccgagcaaggagctggctgaagccacaaaaacattgctgcatagtcttgggactctggcccaggagctgttcagcatgagaagctggagtgacatgcgacaggaggtgatgtttctgaccaatgtgaacagctccagctcctccacccaaatctaccaggctgtgtctcgtattgtctgcgggcatcccgagggaggggggctgaagatcaagtctctcaactggtatgaggacaacaactacaaagccctctttggaggcaatggcactgaggaagatgctgaaaccttctatgacaactctacaactccttactgcaatgatttgatgaagaatttggagtctagtcctctttcccgcattatctggaaagctctgaagccgctgctcgttgggaagatcctgtatacacctgacactccagccacaaggcaggtcatggctgaggtgaacaagaccttccaggaactggctgtgttccatgatctggaaggcatgtgggaggaactcagccccaagatctggaccttcatggagaacagccaagaaatggaccttgtccggatgctgttggacagcagggacaatgaccacttttgggaacagcagttggatggcttagattggacagcccaagacatcgtggcgtttttggccaagcacccagaggatgtccagtccagtaatggttctgtgtacacctggagagaagctttcaacgagactaaccaggcaatccggaccatatctcgcttcatggagtgtgtcaacctgaacaagctagaacccatagcaacagaagtctggctcatcaacaagtccatggagctgctggatgagaggaagttctgggctggtattgtgttcactggaattactccaggcagcattgagctgccccatcatgtcaagtacaagatccgaatggacattgacaatgtggagaggacaaataaaatcaaggatgggtactgggaccctggtcctcgagctgacccctttgaggacatgcggtacgtctgggggggcttcgcctacttgcaggatgtggtggagcaggcaatcatcagggtgctgacgggcaccgagaagaaaactggtgtctatatgcaacagatgccctatccctgttacgttgatgacatctttctgcgggtgatgagccggtcaatgcccctcttcatgacgctggcctggatttactcagtggctgtgatcatcaagggcatcgtgtatgagaaggaggcacggctgaaagagaccatgcggatcatgggcctggacaacagcatcctctggtttagctggttcattagtagcctcattcctcttcttgtgagcgctggcctgctagtggtcatcctgaagttaggaaacctgctgccctacagtgatcccagcgtggtgtttgtcttcctgtccgtgtttgctgtggtgacaatcctgcagtgcttcctgattagcacactcttctccagagccaacctggcagcagcctgtgggggcatcatctacttcacgctgtacctgccctacgtcctgtgtgtggcatggcaggactacgtgggcttcacactcaagatcttcgctagcctgctgtctcctgtggcttttgggtttggctgtgagtactttgccctttttgaggagcagggcattggagtgcagtgggacaacctgtttgagagtcctgtggaggaagatggcttcaatctcaccacttcggtctccatgatgctgtttgacaccttcctctatggggtgatgacctggtacattgaggctgtctttccaggccagtacggaattcccaggccctggtattttccttgcaccaagtcctactggtttggcgaggaaagtgatgagaagagccaccctggttccaaccagaagagaatatcagaaatctgcatggaggaggaacccacccacttgaagctgggcgtgtccattcagaacctggtaaaagtctaccgagatgggatgaaggtggctgtcgatggcctggcactgaatttttatgagggccagatcacctccttcctgggccacaatggagcggggaagacgaccaccatgtcaatcctgaccgggttgttccccccgacctcgggcaccgcctacatcctgggaaaagacattcgctctgagatgagcaccatccggcagaacctgggggtctgtccccagcataacgtgctgtttgacatgctgactgtcgaagaacacatctggttctatgcccgcttgaaagggctctctgagaagcacgtgaaggcggagatggagcagatggccctggatgttggtttgccatcaagcaagctgaaaagcaaaacaagccagctgtcaggtggaatgcagagaaagctatctgtggccttggcctttgtcgggggatctaaggttgtcattctggatgaacccacagctggtgtggacccttactcccgcaggggaatatgggagctgctgctgaaataccgacaaggccgcaccattattctctctacacaccacatggatgaagcggacgtcctgggggacaggattgccatcatctcccatgggaagctgtgctgtgtgggctcctccctgtttctgaagaaccagctgggaacaggctactacctgaccttggtcaagaaagatgtggaatcctccctcagttcctgcagaaacagtagtagcactgtgtcatacctgaaaaaggaggacagtgtttctcagagcagttctgatgctggcctgggcagcgaccatgagagtgacacgctgaccatcgatgtctctgctatctccaacctcatcaggaagcatgtgtctgaagcccggctggtggaagacatagggcatgagctgacctatgtgctgccatatgaagctgctaaggagggagcctttgtggaactctttcatgagattgatgaccggctctcagacctgggcatttctagttatggcatctcagagacgaccctggaagaaatattcctcaaggtggccgaagagagtggggtggatgctgagacctcagatggtaccttgccagcaagacgaaacaggcgggccttcggggacaagcagagctgtcttcgcccgttcactgaagatgatgctgctgatccaaatgattctgacatagacccagaatccagagagacagacttgctcagtgggatggatggcaaagggtcctaccaggtgaaaggctggaaacttacacagcaacagtttgtggcccttttgtggaagagactgctaattgccagacggagtcggaaaggattttttgctcagattgtcttgccagctgtgtttgtctgcattgcccttgtgttcagcctgatcgtgccaccctttggcaagtaccccagcctggaacttcagccctggatgtacaacgaacagtacacatttgtcagcaatgatgctcctgaggacacgggaaccctggaactcttaaacgccctcaccaaagaccctggcttcgggacccgctgtatggaaggaaacccaatcccagacacgccctgccaggcaggggaggaagagtggaccactgccccagttccccagaccatcatggacctcttccagaatgggaactggacaatgcagaacccttcacctgcatgccagtgtagcagcgacaaaatcaagaagatgctgcctgtgtgtcccccaggggcaggggggctgcctcctccacaaagaaaacaaaacactgcagatatccttcaggacctgacaggaagaaacatttcggattatctggtgaagacgtatgtgcagatcatagccaaaagcttaaagaacaagatctgggtgaatgagtttaggtatggcggcttttccctgggtgtcagtaatactcaagcacttcctccgagtcaagaagttaatgatgccatcaaacaaatgaagaaacacctaaagctggccaaggacagttctgcagatcgatttctcaacagcttgggaagatttatgacaggactggacaccaaaaataatgtcaaggtgtggttcaataacaagggctggcatgcaatcagctctttcctgaatgtcatcaacaatgccattctccgggccaacctgcaaaagggagagaaccctagccattatggaattactgctttcaatcatcccctgaatctcaccaagcagcagctctcagaggtggctctgatgaccacatcagtggatgtccttgtgtccatctgtgtcatctttgcaatgtccttcgtcccagccagctttgtcgtattcctgatccaggagcgggtcagcaaagcaaaacacctgcagttcatcagtggagtgaagcctgtcatctactggctctctaattttgtctgggatatgtgcaattacgttgtccctgccacactggtcattatcatcttcatctgcttccagcagaagtcctatgtgtcctccaccaatctgcctgtgctagcccttctacttttgctgtatgggtggtcaatcacacctctcatgtacccagcctcctttgtgttcaagatccccagcacagcctatgtggtgctcaccagcgtgaacctcttcattggcattaatggcagcgtggccacctttgtgctggagctgttcaccgacaataagctgaataatatcaatgatatcctgaagtccgtgttcttgatcttcccacatttttgcctgggacgagggctcatcgacatggtgaaaaaccaggcaatggctgatgccctggaaaggtttggggagaatcgctttgtgtcaccattatcttgggacttggtgggacgaaacctcttcgccatggccgtggaaggggtggtgttcttcctcattactgttctgatccagtacagattcttcatcaggcccagacctgtaaatgcaaagctatctcctctgaatgatgaagatgaagatgtgaggcgggaaagacagagaattcttgatggtggaggccagaatgacatcttagaaatcaaggagttgacgaagatatatagaaggaagcggaagcctgctgttgacaggatttgcgtgggcattcctcctggtgagtgctttgggctcctgggagttaatggggctggaaaatcatcaactttcaagatgttaacaggagataccactgttaccagaggagatgctttccttaacaaaaatagtatcttatcaaacatccatgaagtacatcagaacatgggctactgccctcagtttgatgccatcacagagctgttgactgggagagaacacgtggagttctttgcccttttgagaggagtcccagagaaagaagttggcaaggttggtgagtgggcgattcggaaactgggcctcgtgaagtatggagaaaaatatgctggtaactatagtggaggcaacaaacgcaagctctctacagccatggctttgatcggcgggcctcctgtggtgtttctggatgaacccaccacaggcatggatcccaaagcccggcggttcttgtggaattgtgccctaagtgttgtcaaggaggggagatcagtagtgcttacatctcatagtatggaagaatgtgaagctctttgcactaggatggcaatcatggtcaatggaaggttcaggtgccttggcagtgtccagcatctaaaaaataggtttggagatggttatacaatagttgtacgaatagcagggtccaacccggacctgaagcctgtccaggatttctttggacttgcatttcctggaagtgttctaaaagagaaacaccggaacatgctacaataccagcttccatcttcattatcttctctggccaggatattcagcatcctctcccagagcaaaaagcgactccacatagaagactactctgtttctcagacaacacttgaccaagtatttgtgaactttgccaaggaccaaagtgatgatgaccacttaaaagacctctcattacacaaaaaccagacagtagtggacgttgcagttctcacatcttttctacaggatgagaaagtgaaagaaagctatgtatgaagaatcctgttcatacggggtggctgaaagtaaagaggaactagactttcctttgcaccatgtgaagtgttgtggagaaaagagccagaagttgatgtgggaagaagtaaactggatactgtactgatactattcaatgcaatgcaattcaatgcaatgaaaacaaaattccattacaggggcagtgcctttgtagcctatgtcttgtatggctctcaagtgaaagacttgaatttagttttttacctatacctatgtgaaactctattatggaacccaatggacatatgggtttgaactcacacttttttttttttttttgttcctgtgtattctcattggggttgcaacaataattcatcaagtaatcatggccagcgattattgatcaaaatcaaaaggtaatgcacatcctcattcactaagccatgccatgcccaggagactggtttcccggtgacacatccattgctggcaatgagtgtgccagagttattagtgccaagtttttcagaaagtttgaagcaccatggtgtgtcatgctcacttttgtgaaagctgctctgctcagagtctatcaacattgaatatcagttgacagaatggtgccatgcgtggctaacatcctgctttgattccctctgataagctgttctggtggcagtaacatgcaacaaaaatgtgggtgtctccaggcacgggaaacttggttccattgttatattgtcctatgcttcgagccatgggtctacagggtcatccttatgagactcttaaatatacttagatcctggtaagaggcaaagaatcaacagccaaactgctggggctgcaagctgctgaagccagggcatgggattaaagagattgtgcgttcaaacctagggaagcctgtgcccatttgtcctgactgtctgctaacatggtacactgcatctcaagatgtttatctgacacaagtgtattatttctggctttttgaattaatctagaaaatgaaaagatggagttgtattttgacaaaaatgtttgtactttttaatgttatttggaattttaagttctatcagtgacttctgaatccttagaatggcctctttgtagaaccctgtggtatagaggagtatggccactgccccactatttttattttcttatgtaagtttgcatatcagtcatgactagtgcctagaaagcaatgtgatggtcaggatctcatgacattatatttgagtttctttcagatcatttaggatactcttaatctcacttcatcaatcaaatattttttgagtgtatgctgtagctgaaagagtatgtacgtacgtataagactagagagatattaagtctcagtacacttcctgtgccatgttattcagctcactggtttacaaatataggttgtcttgtggttgtaggagcccactgtaacaatactgggcagcctttttttttttttttttaattgcaacaatgcaaaagccaagaaagtataagggtcacaagtctaaacaatgaattcttcaacagggaaaacagctagcttgaaaacttgctgaaaaacacaacttgtgtttatggcatttagtaccttcaaataattggctttgcagatattggataccccattaaatctgacagtctcaaatttttcatctcttcaatcactagtcaagaaaaatataaaaacaacaaatacttccatatggagcatttttcagagttttctaacccagtcttatttttctagtcagtaaacatttgtaaaaatactgtttcactaatacttactgttaactgtcttgagagaaaagaaaaatatgagagaactattgtttggggaagttcaagtgatctttcaatatcattactaacttcttccactttttccagaatttgaatattaacgctaaaggtgtaagacttcagatttcaaattaatctttctatattttttaaatttacagaatattatataacccactgctgaaaaagaaaaaaatgattgttttagaagttaaagtcaatattgattttaaatataagtaatgaaggcatatttccaataactagtgatatggcatcgttgcattttacagtatcttcaaaaatacagaatttatagaataatttctcctcatttaatatttttcaaaatcaaagttatggtttcctcattttactaaaatcgtattctaattcttcattatagtaaatctatgagcaactccttacttcggttcctctgatttcaaggccatattttaaaaaatcaaaaggcactgtgaactattttgaagaaaacacaacattttaatacagattgaaaggacctcttctgaagctagaaacaatctatagttatacatcttcattaatactgtgttaccttttaaaatagtaattttttacattttcctgtgtaaacctaattgtggtagaaatttttaccaactctatactcaatcaagcaaaatttctgtatattccctgtggaatgtacctatgtgagtttcagaaattctcaaaatacgtgttcaaaaatttctgcttttgcatctttgggacacctcagaaaacttattaacaactgtgaatatgagaaatacagaagaaaataataagccctctatacataaatgcccagcacaattcattgttaaaaaacaaccaaacctcacactactgtatttcattatctgtactgaaagcaaatgctttgtgactattaaatgttgcacatcattcattcactgtatagtaatcattgactaaagccatttgtctgtgttttcttcttgtggttgtatatatcaggtaaaatattttccaaagagccatgtgtcatgtaatactgaaccactttgatattgagacattaatttgtacccttgttattatctactagtaataatgtaatactgtagaaatattgctctaattcttttcaaaattgttgcatcccccttagaatgtttctatttccataaggatttaggtatgctattatcccttcttataccctaagatgaagctgtttttgtgctctttgttcatcattggccctcattccaagcactttacgctgtctgtaatgggatctatttttgcactggaatatctgagaattgcaaaactagacaaaagtttcacaacagatttctaagttaaatcattttcattaaaaggaaaaaagaaaaaaaattttgtatgtcaataactttatatgaagtattaaaatgcatatttctatgttgtaatataatgagtcacaaaataaagctgtgacagttctgttggtctacagaaa

SEQ ID NO: 110019 - DNA, 1540 bp, Homo sapiens
  Payload ID: 1598
  Gene Symbol: ABCA1
  Gene Name: ATP-binding cassette, sub-family A (ABC1), member 1
  ENST ID: ENST00000423487
  CDS Start-End: 298-1389
gtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagttaatgaccagccacggcgtccctgctgtgagctctggccgctgccttccagggctcccgagccacacgctgggggtgctggctgagggaacatggcttgttggcctcagctgaggttgctgctgtggaagaacctcactttcagaagaagacaaacatgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaagggagaaactggctgcagcagagcgagtacttcgttccaacatggacatcctgaagccaatcctgatggatgtgacatgtgatgacattgcacatgggcagttaactgtgccaagaagtgcagcagtagcagcaaccggagatgcaaagcccaacatgatggggagagaaactcttctttcaatatgtgcttctgtaccaaaagtggaatttcacgagagacatattttgaaacatttctccttttgtgtgtgcgtgagtgtttccctgtttccagccaagggtattgtgagtttctcctgggcctccttcagaatctgggtgctctggaaagcagtgttttggcaacatggggaaagtatggcagtgtgggagggtcagctgggtctgggtttgaatattgcatttgaatattttaccagcattgatgtcggataaattatttagtccctgtaagcctcagttttctcttcttctacatacacataatatatttgactctttgttgtgattattggttacacatatgaagagcctggtgtggggcctggcacacaataggtgctcaataaatagaagttgataattt

SEQ ID NO: 110020 - DNA, 6362 bp, Homo sapiens
  Payload ID: 1599
  Gene Symbol: ABCA10
  Gene Name: ATP-binding cassette, sub-family A (ABC1), member 10
  Uniprot ID: Q8WWZ4
  ENST ID: ENST00000269081
  CDS Start-End: 911-5542
tagtagtactaacaacgttttataggagcacaattaattttacttaggataagtgttgttattattgtttttattgttgttctgttagttactcaaaacttcattctaattgtgccctgagtttgttaaaataccatactgtatttttgtgtaacatgtaaataggcattaatttttgagaaatagaaatgtttatccttaatgtatttttaatttgctaacattgattttttattttctttcctgaaatagcttatttcctaaaatgaaagaatttattctcagatgaataatttttatatcagctattcttatcagagcaataaacaaataccaatgatgcgctcagccaacaattcattacactctctgaagagtaactggacaaggagaaaaacatagggaaaaaaccaacagaatttgttggcatgttctacacacagaccatggcttttcagaagccaagctgaatcaaaacagttttaaaagaggcaaccatttgtagaggagtccttgaaggattcttcattgttttcttggacaaaaagagaccagtggatccaagtgcttcaaatacttctctcttattttcttaactctattgctctgcaatatttactttaccctgttaatgaacaggacaaaatggttaaaaaagagataagcgtgcgtcaacaaattcaggctcttctgtacaagaattttcttaaaaaatggagaataaaaagagagtttattggaatggacaataacattgtttctagggctatatttgtgcatcttttcggaacacttcagagctacccgttttcctgaacaacctcctaaagtcctgggaagcgtggatcagtttaatgactctggcctggtagtggcatatacaccagtcagtaacataacacaaaggataatgaataagatggccttggcttcctttatgaaaggaagaacagtcattgggacaccagatgaagagaccatggatatagaacttccaaaaaaataccatgaaatggtgggagttatatttagtgatactttctcatatcgcctgaagtttaattggggatatagaatcccagttataaaggagcactctgaatacacagaacactgttgggccatgcatggtgaaattttttgttacttggcaaagtactggctaaaagggtttgtagcttttcaagctgcaattaatgctgcaattatagaagtcacaacaaatcattctgtaatggaggagttgacatcagttattggaataaatatgaagataccacctttcatttctaagggagaaattatgaatgaatggtttcattttacttgcttagtttctttctcttcttttatatactttgcatcattaaatgttgcaagggaaagaggaaaatttaagaaactgatgacagtgatgggtctccgagagtcagcattctggctctcctggggattgacatacatttgcttcatcttcattatgtccatttttatggctctggtcataacatcaatcccaattgtatttcatactggcttcatggtgatattcacactctatagcttatatggcctttctttgatagcattggctttcctcatgagtgttttaataaggaaacctatgctcgctggtttggctggatttctcttcactgtattttggggatgtctgggattcactgtgttatatagacaacttcctttatctttgggatgggtattaagtcttcttagcccttttgccttcactgctggaatggcccagattacacacctggataattacttaagtggtgttatttttcctgatccctctggggattcatacaaaatgatagccacttttttcattttggcatttgatactcttttctatttgatattcacattatattttgagcgagttttacctgataaagatggccatggggattctccattatttttccttaagtcctcattttggtccaaacatcaaaatactcatcatgaaatctttgagaatgaaataaatcctgagcattcctctgatgattcttttgaaccggtgtctccagaattccatggaaaagaagccataagaatcagaaatgttataaaagaatataatggaaagactggaaaagtagaagcattgcaaggcatattttttgacatatatgaaggacagatcactgcaatacttgggcataatggagctggtaaatcaacactgctaaacattcttagtggattgtctgtttctacagaaggatcagccactatttataatactcaactctctgaaataactgacatggaagaaattagaaagaatattggattttgtccacagttcaattttcaatttgacttcctcactgtgagagaaaacctcagggtatttgctaaaataaaagggattcagccaaaggaagtggaacaagaggtaaaaagaattataatggaattagacatgcaaagcattcaagacattattgctaaaaaattaagtggtgggcagaagagaaaactaacactagggattgccatcttaggagatcctcaggttttgctgctagatgaaccaactgctggattggatcccttttcaagacaccgagtgtggagcctcctgaaggagcataaagtagaccgacttatcctcttcagtacccaattcatggatgaggctgacatcttggctgataggaaagtatttctgtctaatgggaagttgaaatgtgcaggatcatctttgtttctgaagcgaaagtggggtattggatatcatttaagtttacacaggaatgaaatgtgtgacacagaaaaaatcacatcccttattaagcagcacattcctgatgccaagttaacaacagaaagtgaagaaaaacttgtatatagtttgcctttggaaaaaacgaacaaatttccagatctttacagtgaccttgataagtgttctgaccagggcataaggaattatgctgtttcagtgacatctctgaatgaagtattcttgaacctagaaggaaaatcagcaattgatgaaccagattttgacattgggaaacaagagaaaatacatgtgacaagaaatactggagatgagtctgaaatggaacaggttctttgttctcttcctgaaacaagaaaggctgtcagtagtgcagctctctggagacgacaaatctatgcagtggcaacacttcgcttcttaaagttaaggcgtgaaaggagagctcttttgtgtttgttactagtacttggaattgcttttatccccatcattctagagaagataatgtataaagtaactcgtgaaactcattgttgggagttttcacccagtatgtatttcctttctctggaacaaatcccgaagacgcctcttaccagcctgttaatcgttaataatacaggatcaaatattgaagacctcgtgcattcactgaagtgtcaggatatagttttggaaatagatgactttagaaacagaaatggctcagatgatccctcctacaatggagccatcatagtgtctggtgaccagaaggattacagattttctgttgcgtgtaataccaagaaattgaattgttttcctgttcttatgggaattgttagcaatgcccttatgggaatttttaacttcacggagcttattcaaatggagagcacttcattttctcgtgatgacatagtgctggatcttggttttatagatgggtccatatttttgttgttgatcacaaactgcgtttctccttttatcggcatgagcagcatcagcgattataaaaaaaatgttcaatcccagttatggatttcaggcctctggccttcagcatactggtgtggacaggctctggtggacattccattatacttcttgattctcttttcaatacatttaatttactacttcatatttctgggattccagctttcatgggaactcatgtttgttttggtggtatgcataattggttgtgcagtttctcttatattcctcacatatgtgctttcattcatctttcgcaagtggagaaaaaataatggcttttggtcttttggcttttttattatcttaatatgtgtatccacaattatggtatcaactcaatatgaaaaactcaacttaattttgtgcatgattttcataccttccttcactttgctggggtatgtcatgttattgatccagctcgactttatgagaaacttggacagtctggacaatagaataaatgaagtcaataaaaccattcttttaacaaccttaataccataccttcagagtgttattttcctttttgtcataaggtgtctggaaatgaagtatggaaatgaaataatgaataaagacccagttttcagaatctctccacggagtagagaaactcatcccaatccggaagagcccgaagaagaagatgaagatgttcaagctgaaagagtccaagcagcaaatgcactcactgctccaaacttggaggaggaaccagtcataactgcaagctgtttacacaaggaatattatgagacaaagaaaagttgcttttcaacaagaaagaagaaaatagccatcagaaatgtttccttttgtgttaaaaaaggtgaagttttgggattactaggacacaatggagctggtaaaagtacttccattaaaatgataactgggtgcacaaagccaactgcaggagtggtggtgttacaaggcagcagagcatcagtaaggcaacagcatgacaacagcctcaagttcttggggtactgccctcaggagaactcactgtggcccaagcttacaatgaaagagcacttggagttgtatgcagctgtgaaaggactgggcaaagaagatgctgctctcagtatttcacgattggtggaagctcttaagctccaggaacaacttaaggctcctgtgaaaactctatcagagggaataaagagaaagctgtgctttgtgctgagcatcctggggaacccatcagtggtgcttctagatgagccgttcaccgggatggaccccgaggggcagcagcaaatgtggcagatacttcaggctaccgttaaaaacaaggagaggggcaccctcttgaccacccattacatgtcagaggctgaggctgtgtgtgaccgtatggccatgatggtgtcaggaacgctaaggtgtattggttccattcaacatctgaaaaacaagtttggtagagattatttactagaaataaaaatgaaagaacctacccaggtggaagctctccacacagagattttgaagcttttcccacaggctgcttggcaggaaagatattcctctttaatggcgtataagttacctgtggaggatgtccaccctctatctcgggcctttttcaagttagaggcgatgaaacagaccttcaacctggaggaatacagcctctctcaggctaccttggagcaggtattcttagaactctgtaaagagcaggagctgggaaatgttgatgataaaattgatacaacagttgaatggaaacttctcccacaggaagacccttaaaatgaagaacctcctaacattcaattttaggtcctactacattgttagtttccataattctacaagaatgtttccttttacttcagttaacaaaagaaaacatttaataaacattcaataatgattacagttttcatttttaaaaatttaggatgaaggaaacaaggaaatatagggaaaagtagtagacaaaattaacaaaatcagacatgttattcatccccaacatgggtctattttgtgcttaaaaataatttaaaaatcatacaatattaggttggttatcggttattatcaataaagctaacactgagaacattttacaaataaaaatatgaggtttttagcctgaacttcaaatgtatcagctatttttaaacattatttactcggattctaatttaatgtgacattgactataagaaggtctgataaactgatgaaatggcacagcataacatttaattataatgacattctgattataaaataaatgcatgtgaattttagtacatattgaagttatatggaagaagatagccataatctgtaagaaagtaccgcagttaatattttctttagccaacttatattcaatgtattttttatggatcctttttcaaaggtagtatcagtaggcatagtcattttctgtatcttttcacctcacagttcatgaacatttcccatgtcattatagcacttttgtgttatataattgctgcattaatgttatagctgtattgatgtaataccagagttgttacgttcgggttatatgcaagtttatttcttagaaataaaactttgatggactttt

SEQ ID NO: 110021 - DNA, 4875 bp, Homo sapiens
  Payload ID: 1599
  Gene Symbol: ABCA10
  Gene Name: ATP-binding cassette, sub-family A (ABC1), member 10
  ENST ID: ENST00000523419
  CDS Start-End: 85-4065
aaagtcctgggaagcgtggatcagtttaatgactctggcctggtagtggcatatacaccagtcagtaacataacacaaaggataatgaataagatggccttggcttcctttatgaaaggaagaacagtcattgggacaccagatgaagagaccatggatatagaacttccaaaaaaataccatgaaatggtgggagttatatttagtgatactttctcatatcgcctgaagtttaattggggatatagaatcccagttataaaggagcactctgaatacacagaacactgttgggccatgcatggtgaaattttttgttacttggcaaagtactggctaaaagggtttgtagcttttcaagctgcaattaatgctgcaattatagaagtcacaacaaatcattctgtaatggaggagttgacatcagttattggaataaatatgaagataccacctttcatttctaagggagaaattatgaatgaatggtttcattttacttgcttagtttctttctcttcttttatatactttgcatcattaaatgttgcaagggaaagaggaaaatttaagaaactgatgacagtgatgggtctccgagagtcagcattctggctctcctggggattgacatacatttgcttcatcttcattatgtccatttttatggctctggtcataacatcaatcccaattgtatttcatactggcttcatggtgatattcacactctatagcttatatggcctttctttgatagcattggctttcctcatgagtgttttaataaggaaacctatgctcgctggtttggctggatttctcttcactgtattttggggatgtctgggattcactgtgttatatagacaacttcctttatctttgggatgggtattaagtcttcttagcccttttgccttcactgctggaatggcccagattacacacctggataattacttaagtggtgttatttttcctgatccctctggggattcatacaaaatgatagccacttttttcattttggcatttgatactcttttctatttgatattcacattatattttgagcgagttttacctgataaagatggccatggggattctccattatttttccttaagtcctcattttggtccaaacatcaaaatactcatcatgaaatctttgagaatgaaataaatcctgagcattcctctgatgattcttttgaaccggtgtctccagaattccatggaaaagaagccataagaatcagaaatgttataaaagaatataatggaaagactggaaaagtagaagcattgcaaggcatattttttgacatatatgaaggacagatcactgcaatacttgggcataatggagctggtaaatcaacactgctaaacattcttagtggattgtctgtttctacagaaggatcagccactatttataatactcaactctctgaaataactgacatggaagaaattagaaagaatattggattttgtccacagttcaattttcaatttgacttcctcactgtgagagaaaacctcagggtatttgctaaaataaaagggattcagccaaaggaagtggaacaagaggtaaaaagaattataatggaattagacatgcaaagcattcaagacattattgctaaaaaattaagtggtgggcagaagagaaaactaacactagggattgccatcttaggagatcctcaggttttgctgctagatgaaccaactgctggattggatcccttttcaagacaccgagtgtggagcctcctgaaggagcataaagtagaccgacttatcctcttcagtacccaattcatggatgaggctgacatcttggctgataggaaagtatttctgtctaatgggaagttgaaatgtgcaggatcatctttgtttctgaagcgaaagtggggtattggatatcatttaagtttacacaggaatgaaatgtgtgacacagaaaaaatcacatcccttattaagcagcacattcctgatgccaagttaacaacagaaagtgaagaaaaacttgtatatagtttgcctttggaaaaaacgaacaaatttccagatctttacagtgaccttgataagtgttctgaccagggcataaggaattatgctgtttcagtgacatctctgaatgaagtattcttgaacctagaaggaaaatcagcaattgatgaaccagattttgacattgggaaacaagagaaaatacatgtgacaagaaatactggagatgagtctgaaatggaacaggttctttgttctcttcctgaaacaagaaaggctgtcagtagtgcagctctctggagacgacaaatctatgcagtggcaacacttcgcttcttaaagttaaggcgtgaaaggagagctcttttgtgtttgttactagtacttggaattgcttttatccccatcattctagagaagataatgtataaagtaactcgtgaaactcattgttgggagttttcacccagtatgtatttcctttctctggaacaaatcccgaagacgcctcttaccagcctgttaatcgttaataatacaggatcaaatattgaagacctcgtgcattcactgaagtgtcaggatatagttttggaaatagatgactttagaaacagaaatggctcagatgatccctcctacaatggagccatcatagtgtctggtgaccagaaggattacagattttctgttgcgtgtaataccaagaaattgaattgttttcctgttcttatgggaattgttagcaatgcccttatgggaatttttaacttcacggagcttattcaaatggagagcacttcattttctcgtgatgacatagtgctggatcttggttttatagatgggtccatatttttgttgttgatcacaaactgcgtttctccttttatcggcatgagcagcatcagcgattataaaaaaaatgttcaatcccagttatggatttcaggcctctggccttcagcatactggtgtggacaggctctggtggacattccattatacttcttgattctcttttcaatacatttaatttactacttcatatttctgggattccagctttcatgggaactcatgtttgttttggtggtatgcataattggttgtgcagtttctcttatattcctcacatatgtgctttcattcatctttcgcaagtggagaaaaaataatggcttttggtcttttggcttttttattatcttaatatgtgtatccacaattatggtatcaactcaatatgaaaaactcaacttaattttgtgcatgattttcataccttccttcactttgctggggtatgtcatgttattgatccagctcgactttatgagaaacttggacagtctggacaatagaataaatgaagtcaataaaaccattcttttaacaaccttaataccataccttcagagtgttattttcctttttgtcataaggtgtctggaaatgaagtatggaaatgaaataatgaataaagacccagttttcagaatctctccacggagtagagaaactcatcccaatccggaagagcccgaagaagaagatgaagatgttcaagctgaaagagtccaagcagcaaatgcactcactgctccaaacttggaggaggaaccagtcataactgcaagctgtttacacaaggaatattatgagacaaagaaaagttgcttttcaacaagaaagaagaaaatagccatcagaaatgtttccttttgtgttaaaaaaggtgaagttttgggattactaggacacaatggagctggtaaaagtacttccattaaaatgataactgggtgcacaaagccaactgcaggagtggtggtgttacaaggcagcagagcatcagtaaggcaacagcatgacaacagcctcaagttcttggggtactgccctcaggagaactcactgtggcccaagcttacaatgaaagagcacttggagttgtatgcagctgtgaaaggactgggcaaagaagatgctgctctcagtatttcacgctgtgctttgtgctgagcatcctggggaacccatcagtggtgcttctagatgagccgttcaccgggatggaccccgaggggcagcagcaaatgtggcagatacttcaggctaccgttaaaaacaaggagaggggcaccctcttgaccacccattacatgtcagaggctgaggctgtgtgtgaccgtatggccatgatggtgtcaggaacgctaaggtgtattggttccattcaacatctgaaaaacaagtttggtagagattatttactagaaataaaaatgaaagaacctacccaggtggaagctctccacacagagattttgaagcttttcccacaggctgcttggcaggaaagatattcctctttaatggcgtataagttacctgtggaggatgtccaccctctatctcgggcctttttcaagttagaggcgatgaaacagaccttcaacctggaggaatacagcctctctcaggctaccttggagcaggtattcttagaactctgtaaagagcaggagctgggaaatgttgatgataaaattgatacaacagttgaatggaaacttctcccacaggaagacccttaaaatgaagaacctcctaacattcaattttaggtcctactacattgttagtttccataattctacaagaatgtttccttttacttcagttaacaaaagaaaacatttaataaacattcaataatgattacagttttcatttttaaaaatttaggatgaaggaaacaaggaaatatagggaaaagtagtagacaaaattaacaaaatcagacatgttattcatccccaacatgggtct

SEQ ID NO: 110022 - DNA, 584 bp, Homo sapiens
  Payload ID: 1599
  Gene Symbol: ABCA10
  Gene Name: ATP-binding cassette, sub-family A (ABC1), member 10
  ENST ID: ENST00000524273
  CDS Start-End: 1-413
ttagtgatactttctcatatcgcctgaagtttaattggggatatagaatcccagttataaaggagcactctgaatacacagaacactgttgggccatgcatggtgaaattttttgttacttggcaaagtactggctaaaagggtttgtagcttttcaagctgcaattaatgctgcaattatagaagtcacaacaaatcattctgtaatggaggagttgacatcagttattggaataaatatgaagataccacctttcatttctaagggagaaattatgaatgaatggtttcattttacttgcttagtttctttctcttcttttatatactttgcatcattaaatgttgcaagggaaagaggaaaatttaagaaactgatgacagtgatgggtctccgagagtcagcattctgaggcagtaaaatgtgaggttatgaataacgagtgaagccagatggcatggataagggtctcatctctgttgcctaccagctggtgacactggattacacacctggataattacttaagtggtgttatttttcctgatccctctggggattcatacaaaatgatagccacttt

SEQ ID NO: 110023 - DNA, 6125 bp, Homo sapiens
  Payload ID: 1599
  Gene Symbol: ABCA10
  Gene Name: ATP-binding cassette, sub-family A (ABC1), member 10
  Uniprot ID: Q8WWZ4
  ENST ID: ENST00000522406
  CDS Start-End: 388-1746
cttcattgttttcttggacaaaaagagaccagtggatccaagtgcttcaaatacttctctcttattttcttaactctattgctctgcaatatttactttaccctgttaatgaacaggacaaaatggttaaaaaagagataagcgtgcgtcaacaaattcaggctcttctgtacaagaattttcttaaaaaatggagaataaaaagagagtttattggaatggacaataacattgtttctagggctatatttgtgcatcttttcggaacacttcagagctacccgttttcctgaacaacctcctaaagtcctgggaagcgtggatcagtttaatgactctggcctggtagtggcatatacaccagtcagtaacataacacaaaggataatgaataagatggccttggcttcctttatgaaaggaagaacagtcattgggacaccagatgaagagaccatggatatagaacttccaaaaaaataccatgaaatggtgggagttatatttagtgatactttctcatatcgcctgaagtttaattggggatatagaatcccagttataaaggagcactctgaatacacagaacactgttgggccatgcatggtgaaattttttgttacttggcaaagtactggctaaaagggtttgtagcttttcaagctgcaattaatgctgcaattatagaagtcacaacaaatcattctgtaatggaggagttgacatcagttattggaataaatatgaagataccacctttcatttctaagggagaaattatgaatgaatggtttcattttacttgcttagtttctttctcttcttttatatactttgcatcattaaatgttgcaagggaaagaggaaaatttaagaaactgatgacagtgatgggtctccgagagtcagcattctggctctcctggggattgacatacatttgcttcatcttcattatgtccatttttatggctctggtcataacatcaatcccaattgtatttcatactggcttcatggtgatattcacactctatagcttatatggcctttctttgatagcattggctttcctcatgagtgttttaataaggaaacctatgctcgctggtttggctggatttctcttcactgtattttggggatgtctgggattcactgtgttatatagacaacttcctttatctttgggatgggtattaagtcttcttagcccttttgccttcactgctggaatggcccagattacacacctggataattacttaagtggtgttatttttcctgatccctctggggattcatacaaaatgatagccacttttttcattttggcatttgatactcttttctatttgatattcacattatattttgagcgagttttacctgataaagatggccatggggattctccattatttttccttaagtcctcattttggtccaaacatcaaaatactcatcatgaaatctttgagaatgaaataaatcctgagcattcctctgatgattcttttgaaccggtgtctccagaattccatggaaaagaagccataagaatcagaaatgttataaaagaatataatggaaagactggaaaagtagaagcattgcaaggaagtgaggagcgtctctgccccgccgcccatcgtctgagatgtggggagcgcctctgccccgccgcccatcatctgggatgtgaggagcgcccctgcccggccgcgaccccgtctgggaactgaggagtgtctctgcccgaccgccaccctgtctgggagatgaggagcgtctctgcccggccgccccgtctgagaagcatattttttgacatatatgaaggacagatcactgcaatacttgggcataatggagctggtaaatcaacactgctaaacattcttagtggattgtctgtttctacagaaggatcagccactatttataatactcaactctctgaaataactgacatggaagaaattagaaagaatattggattttgtccacagttcaattttcaatttgacttcctcactgtgagagaaaacctcagggtatttgctaaaataaaagggattcagccaaaggaagtggaacaagaggtaaaaagaattataatggaattagacatgcaaagcattcaagacattattgctaaaaaattaagtggtgggcagaagagaaaactaacactagggattgccatcttaggagatcctcaggttttgctgctagatgaaccaactgctggattggatcccttttcaagacaccgagtgtggagcctcctgaaggagcataaagtagaccgacttatcctcttcagtacccaattcatggatgaggctgacatcttggctgataggaaagtatttctgtctaatgggaagttgaaatgtgcaggatcatctttgtttctgaagcgaaagtggggtattggatatcatttaagtttacacaggaatgaaatgtgtgacacagaaaaaatcacatcccttattaagcagcacattcctgatgccaagttaacaacagaaagtgaagaaaaacttgtatatagtttgcctttggaaaaaacgaacaaatttccagatctttacagtgaccttgataagtgttctgaccagggcataaggaattatgctgtttcagtgacatctctgaatgaagtattcttgaacctagaaggaaaatcagcaattgatgaaccagattttgacattgggaaacaagagaaaatacatgtgacaagaaatactggagatgagtctgaaatggaacaggttctttgttctcttcctgaaacaagaaaggctgtcagtagtgcagctctctggagacgacaaatctatgcagtggcaacacttcgcttcttaaagttaaggcgtgaaaggagagctcttttgtgtttgttactagtacttggaattgcttttatccccatcattctagagaagataatgtataaagtaactcgtgaaactcattgttgggagttttcacccagtatgtatttcctttctctggaacaaatcccgaagacgcctcttaccagcctgttaatcgttaataatacaggatcaaatattgaagacctcgtgcattcactgaagtgtcaggatatagttttggaaatagatgactttagaaacagaaatggctcagatgatccctcctacaatggagccatcatagtgtctggtgaccagaaggattacagattttctgttgcgtgtaataccaagaaattgaattgttttcctgttcttatgggaattgttagcaatgcccttatgggaatttttaacttcacggagcttattcaaatggagagcacttcattttctcgttgtatataaatctagacaaaattaatgttcggaaggcttgtcaaggaagcaatttggatattaaattgtctcctgtggatccagggaaggatgacatagtgctggatcttggttttatagatgggtccatatttttgttgttgatcacaaactgcgtttctccttttatcggcatgagcagcatcagcgattataaaaaaaatgttcaatcccagttatggatttcaggcctctggccttcagcatactggtgtggacaggctctggtggacattccattatacttcttgattctcttttcaatacatttaatttactacttcatatttctgggattccagctttcatgggaactcatgtttgttttggtggtatgcataattggttgtgcagtttctcttatattcctcacatatgtgctttcattcatctttcgcaagtggagaaaaaataatggcttttggtcttttggcttttttattatcttaatatgtgtatccacaattatggtatcaactcaatatgaaaaactcaacttaattttgtgcatgattttcataccttccttcactttgctggggtatgtcatgttattgatccagctcgactttatgagaaacttggacagtctggacaatagaataaatgaagtcaataaaaccattcttttaacaaccttaataccataccttcagagtgttattttcctttttgtcataaggtgtctggaaatgaagtatggaaatgaaataatgaataaagacccagttttcagaatctctccacggagtagagaaactcatcccaatccggaagagcccgaagaagaagatgaagatgttcaagctgaaagagtccaagcagcaaatgcactcactgctccaaacttggaggaggaaccagtcataactgcaagctgtttacacaaggaatattatgagacaaagaaaagttgcttttcaacaagaaagaagaaaatagccatcagaaatgtttccttttgtgttaaaaaaggtgaagttttgggattactaggacacaatggagctggtaaaagtacttccattaaaatgataactgggtgcacaaagccaactgcaggagtggtggtgttacaaggcagcagagcatcagtaaggcaacagcatgacaacagcctcaagttcttggggtactgccctcaggagaactcactgtggcccaagcttacaatgaaagagcacttggagttgtatgcagctgtgaaaggactgggcaaagaagatgctgctctcagtatttcacgattggtggaagctcttaagctccaggaacaacttaaggctcctgtgaaaactctatcagagggaataaagagaaagctgtgctttgtgctgagcatcctggggaacccatcagtggtgcttctagatgagccgttcaccgggatggaccccgaggggcagcagcaaatgtggcagatacttcaggctaccgttaaaaacaaggagaggggcaccctcttgaccacccattacatgtcagaggctgaggctgtgtgtgaccgtatggccatgatggtgtcaggaacgctaaggtgtattggttccattcaacatctgaaaaacaagtttggtagagattatttactagaaataaaaatgaaagaacctacccaggtggaagctctccacacagagattttgaagcttttcccacaggctgcttggcaggaaagatattcctctttaatggcgtataagttacctgtggaggatgtccaccctctatctcgggcctttttcaagttagaggcgatgaaacagaccttcaacctggaggaatacagcctctctcaggctaccttggagcaggtattcttagaactctgtaaagagcaggagctgggaaatgttgatgataaaattgatacaacagttgaatggaaacttctcccacaggaagacccttaaaatgaagaacctcctaacattcaattttaggtcctactacattgttagtttccataattctacaagaatgtttccttttacttcagttaacaaaagaaaacatttaataaacattcaataatgattacagttttcatttttaaaaatttaggatgaaggaaacaaggaaatatagggaaaagtagtagacaaaattaacaaaatcagacatgttattcatccccaacatgggtctattttgtgcttaaaaataatttaaaaatcatacaatattaggttggttatcggttattatcaataaagctaacactgagaacattttacaaataaaaatatgaggtttttagcctgaacttcaaatgtatcagctatttttaaacattatttactcggattctaatttaatgtgacattgactataagaaggtctgataaactgatgaaatggcacagcataacatttaattataatgacattctgattataaaataaatgcatgtgaattttagtacatattgaagttatatggaagaagatagccataatctgtaagaaagtaccgcagttaatattttctttagccaacttatattcaatgtattttttatggatcctttttcaaaggtagtatcagtaggcatagtcattttctgtatcttttcacctcacagttcatgaacatttcccatgtcattatagcacttttgtgttatataattgctgcattaatgttatagctgtattgatgtaataccagagttgttacgttcgggttatatgcaagtttatttcttagaaataaaactttgatggacttt

SEQ ID NO: 110024 - DNA, 1311 bp, Homo sapiens
  Payload ID: 1599
  Gene Symbol: ABCA10
  Gene Name: ATP-binding cassette, sub-family A (ABC1), member 10
  Uniprot ID: Q8WWZ4
  ENST ID: ENST00000523512
  CDS Start-End: 410-688
gtagaggagtccttgaaggattcttcattgttttcttggacaaaaagagaccagtggatccaagtgcttcaaatacttctctcttattttcttaactctattgctctgcaatatttactttaccctgttaatgaacaggacaaaatggttaaaaaagagataagcgtgcgtcaacaaattcaggctcttctgtacaagaattttcttaaaaaatggagaataaaaagagagtttattggaatggacaataacattgtttctagggctatatttgtgcatcttttcggaacacttcagagctacccgttttcctgaacaacctcctaaagtcctgggaagcgtggatcagtttaatgactctggcctggtagtggcatatacaccagtcagtaacataacacaaaggataatgaataagatggccttggcttcctttatgaaaggaagaacagtcattgggacaccagatgaagagaccatggatatagaacttccaaaaaaataccatgaaatggtgggagttatatttagtgatactttctcatatcgcctgaagtttaattggggatatagaatcccagttataaaggagcactctgaatacacaggtcacaacaaatcattctgtaatggaggagttgacatcagttattggaataaatatgaagataccacctttcatttctaagggagaaattatgaatgaatggtttcattttacttgcttagtttctttctcttcttttatatactttgcatcattaaatgttgcaagggaaagaggaaaatttaagaaactgatgacagtgatgggtctccgagagtcagcattctggctctcctggggattgacatacatttgcttcatcttcattatgtccatttttatggctctggtcataacatcaatcccaattgtatttcatactggcttcatggtgatattcacactctatagcttatatggcctttctttgatagcattggctttcctcatgagtgttttaataaggaaacctatgctcgctggtttggctggatttctcttcactgtattttggggatgtctgggattcactgtgttatatagacaacttcctttatctttgggatgggtattaagtcttcttagcccttttgccttcactgctggaatggcccagattacacacctggataattacttaagtggtgttatttttcctgatccctctggggattcatacaaaatgatagccacttttttcattttggcatttgatactcttttctatttgatattcacattatattttgagcgagttttacctg

SEQ ID NO: 110025 - DNA, 5375 bp, Homo sapiens
  Payload ID: 1599
  Gene Symbol: ABCA10
  Gene Name: ATP-binding cassette, sub-family A (ABC1), member 10
  ENST ID: ENST00000518929
  CDS Start-End: 85-1107
aaagtcctgggaagcgtggatcagtttaatgactctggcctggtagtggcatatacaccagtcagtaacataacacaaaggataatgaataagatggccttggcttcctttatgaaaggaagaacagtcattgggacaccagatgaagagaccatggatatagaacttccaaaaaaataccatgaaatggtgggagttatatttagtgatactttctcatatcgcctgaagtttaattggggatatagaatcccagttataaaggagcactctgaatacacagaacactgttgggccatgcatggtgaaattttttgttacttggcaaagtactggctaaaagggtttgtagcttttcaagctgcaattaatgctgcaattatagaagtcacaacaaatcattctgtaatggaggagttgacatcagttattggaataaatatgaagataccacctttcatttctaagggagaaattatgaatgaatggtttcattttacttgcttagtttctttctcttcttttatatactttgcatcattaaatgttgcaagggaaagaggaaaatttaagaaactgatgacagtgatgggtctccgagagtcagcattctggctctcctggggattgacatacatttgcttcatcttcattatgtccatttttatggctctggtcataacatcaatcccaattgtatttcatactggcttcatggtgatattcacactctatagcttatatggcctttctttgatagcattggctttcctcatgagtgttttaataaggaaacctatgctcgctggtttggctggatttctcttcactgtattttggggatgtctgggattcactgtgttatatagacaacttcctttatctttgggatgggtattaagtcttcttagcccttttgccttcactgctggaatggcccagattacacacctggataattacttaagtggtgttatttttcctgatccctctggggattcatacaaaatgatagccacttttttcattttggcatttgatactcttttctatttgatattcacattatattttgagcgagttttacctgaatcagaaatgttataaaagaatataatggaaagactggaaaagtagaagcattgcaaggaagtgaggagcgtctctgccccgccgcccatcgtctgagatgtggggagcgcctctgccccgccgcccatcatctgggatgtgaggagcgcccctgcccggccgcgaccccgtctgggaactgaggagtgtctctgcccgaccgccaccctgtctgggagatgaggagcgtctctgcccggccgccccgtctgagaagtgaggagcccctctgcccggcagccaccccgtctgggaagcatattttttgacatatatgaaggacagatcactgcaatacttgggcataatggagctggtaaatcaacactgctaaacattcttagtggattgtctgtttctacagaaggatcagccactatttataatactcaactctctgaaataactgacatggaagaaattagaaagaatattggattttgtccacagttcaattttcaatttgacttcctcactgtgagagaaaacctcagggtatttgctaaaataaaagggattcagccaaaggaagtggaacaagaggtaaaaagaattataatggaattagacatgcaaagcattcaagacattattgctaaaaaattaagtggtgggcagaagagaaaactaacactagggattgccatcttaggagatcctcaggttttgctgctagatgaaccaactgctggattggatcccttttcaagacaccgagtgtggagcctcctgaaggagcataaagtagaccgacttatcctcttcagtacccaattcatggatgaggctgacatcttggctgataggaaagtatttctgtctaatgggaagttgaaatgtgcaggatcatctttgtttctgaagcgaaagtggggtattggatatcatttaagtttacacaggaatgaaatgtgtgacacagaaaaaatcacatcccttattaagcagcacattcctgatgccaagttaacaacagaaagtgaagaaaaacttgtatatagtttgcctttggaaaaaacgaacaaatttccagatctttacagtgaccttgataagtgttctgaccagggcataaggaattatgctgtttcagtgacatctctgaatgaagtattcttgaacctagaaggaaaatcagcaattgatgaaccagattttgacattgggaaacaagagaaaatacatgtgacaagaaatactggagatgagtctgaaatggaacaggttctttgttctcttcctgaaacaagaaaggctgtcagtagtgcagctctctggagacgacaaatctatgcagtggcaacacttcgcttcttaaagttaaggcgtgaaaggagagctcttttgtgtttgttactagtacttggaattgcttttatccccatcattctagagaagataatgtataaagtaactcgtgaaactcattgttgggagttttcacccagtatgtatttcctttctctggaacaaatcccgaagacgcctcttaccagcctgttaatcgttaataatacaggatcaaatattgaagacctcgtgcattcactgaagtgtcaggatatagttttggaaatagatgactttagaaacagaaatggctcagatgatccctcctacaatggagccatcatagtgtctggtgaccagaaggattacagattttctgttgcgtgtaataccaagaaattgaattgttttcctgttcttatgggaattgttagcaatgcccttatgggaatttttaacttcacggagcttattcaaatggagagcacttcattttctcgtgatgacatagtgctggatcttggttttatagatgggtccatatttttgttgttgatcacaaactgcgtttctccttttatcggcatgagcagcatcagcgattataaaaaaaatgttcaatcccagttatggatttcaggcctctggccttcagcatactggtgtggacaggctctggtggacattccattatacttcttgattctcttttcaatacatttaatttactacttcatatttctgggattccagctttcatgggaactcatgtttgttttggtggtatgcataattggttgtgcagtttctcttatattcctcacatatgtgctttcattcatctttcgcaagtggagaaaaaataatggcttttggtcttttggcttttttattatcttaatatgtgtatccacaattatggtatcaactcaatatgaaaaactcaacttaattttgtgcatgattttcataccttccttcactttgctggggtatgtcatgttattgatccagctcgactttatgagaaacttggacagtctggacaatagaataaatgaagtcaataaaaccattcttttaacaaccttaataccataccttcagagtgttattttcctttttgtcataaggtgtctggaaatgaagtatggaaatgaaataatgaataaagacccagttttcagaatctctccacggagtagagaaactcatcccaatccggaagagcccgaagaagaagatgaagatgttcaagctgaaagagtccaagcagcaaatgcactcactgctccaaacttggaggaggaaccagtcataactgcaagctgtttacacaaggaatattatgagacaaagaaaagttgcttttcaacaagaaagaagaaaatagccatcagaaatgtttccttttgtgttaaaaaaggtgaagttttgggattactaggacacaatggagctggtaaaagtacttccattaaaatgataactgggtgcacaaagccaactgcaggagtggtggtgttacaaggcagcagagcatcagtaaggcaacagcatgacaacagcctcaagttcttggggtactgccctcaggagaactcactgtggcccaagcttacaatgaaagagcacttggagttgtatgcagctgtgaaaggactgggcaaagaagatgctgctctcagtatttcacggtacagagagaagtctcacaatttgtagcaggaggaaggggaaaatatgtcatttcttcattatatattaaaaggaaattataaacaatgtctttaaattttcatgcaaataaaatgattcaaatacctgaataagaaccaaatcataagatttagcatttatgaaaacgttaaggaagcttaaatttactatctagaataatagtgcttagagtttcctacagttgttttagataggtccatttgccatatacttcatgtataatcacactgttttttgtcagattggtggaagctcttaagctccaggaacaacttaaggctcctgtgaaaactctatcagagggaataaagagaaaggtatgggccaggctcggggtttccctgtgcacccatggctgggtgccgacgggctgttccttgcattgcagctgtgctttgtgctgagcatcctggggaacccatcagtggtgcttctagatgagccgttcaccgggatggaccccgaggggcagcagcaaatgtggcagatacttcaggctaccgttaaaaacaaggagaggggcaccctcttgaccacccattacatgtcagaggctgaggctgtgtgtgaccgtatggccatgatggtgtcaggaacgctaaggtgtattggttccattcaacatctgaaaaacaagtttggtagagattatttactagaaataaaaatgaaagaacctacccaggtggaagctctccacacagagattttgaagcttttcccacaggctgcttggcaggaaagatattcctctttaatggcgtataagttacctgtggaggatgtccaccctctatctcgggcctttttcaagttagaggcgatgaaacagaccttcaacctggaggaatacagcctctctcaggctaccttggagcaggtattcttagaactctgtaaagagcaggagctgggaaatgttgatgataaaattgatacaacagttgaatggaaacttctcccacaggaagacccttaaaatgaagaacctcctaacattcaattttaggtcctactacattgttagtttccataattctacaagaatgtttccttttacttcagttaacaaaagaaaacatttaataaacattcaataatgattacagttttcatttttaaaaatttaggatgaaggaaacaaggaaatatagggaaaagtagtagacaaaattaacaaaatcagacatgttattcatccccaacatgggtct

SEQ ID NO: 110026 - DNA, 531 bp, Homo sapiens
  Payload ID: 1599
  Gene Symbol: ABCA10
  Gene Name: ATP-binding cassette, sub-family A (ABC1), member 10
  ENST ID: ENST00000521538
  CDS Start-End: 1-229
atattcctctttaatggcgtataagttacctgtggaggatgtccaccctctatctcgggcctttttcaagttagaggcgatgaaacagaccttcaacctggaggaatacagcctctctcaggctaccttggagcagaagcagtgtgaggcctcactggatgcagatattggcaccacgcttcttgtacaacctgtggtttcagaatcccaactgaaaaagtcagcctaaaagtgtcctgtgaaacacctgggaagataggacgtcaggcaagcaacaacttcaatgcaaaatgtgtcttgttccaaaagtgacaggaggaccactgccacagaaaccaccctaaagtcagaagcagcggtaagaagataggcctgatggaagcagagctgacatgcagttgctgactttcacatgcttccaacaagcagattttgcagcagagcaatatgaaacattgattggatgaatacagaagcaaatgaatcagaaaatttagcaggattgtgttagattgggcaaaaaaaaaaaaa

SEQ ID NO: 110027 - DNA, 362 bp, Homo sapiens
  Payload ID: 1599
  Gene Symbol: ABCA10
  Gene Name: ATP-binding cassette, sub-family A (ABC1), member 10
  ENST ID: ENST00000522787
  CDS Start-End: 1-138
tattcctctttaatggcgtataagttacctgtggaggatgtccaccctctatctcgggcctttttcaagttagaggcgatgaaacagaccttcaacctggaggaatacagcctctctcaggctaccttggagcagtgacaggaggaccactgccacagaaaccaccctaaagtcagaagcagcggtaagaagataggcctgatggaagcagagctgacatgcagttgctgactttcacatgcttccaacaagcagattttgcagcagagcaatatgaaacattgattggatgaatacagaagcaaatgaatcagaaaatttagcaggattgtgttagattgggcaaaaaaaaaaaaaaacaa

SEQ ID NO: 110028 - DNA, 9100 bp, Homo sapiens
  Payload ID: 1600
  Gene Symbol: ABCA12
  Gene Name: ATP-binding cassette, sub-family A (ABC1), member 12
  Uniprot ID: Q86UK0
  ENST ID: ENST00000272895
  CDS Start-End: 221-8008
gaagagttgattgagaagtgcctcttggttaaggattaaccacagggaaaaatccagcagaaacagaagaactgtgggtttcttaccccagccctcaaggaagctatgccgtgaaaggggtactgatacactgacatacagcaagttggacggggcatcagttcttcatttgtggagtggagaaaagaagaggaaatctctcatttggggcatttgaaggatggcttccctgtttcatcagcttcagatcctggtctggaaaaattggctaggtgtaaaaaggcagccgctttggacacttgtcttgatcttatggccagtcattattttcataattttggctattactcggaccaaatttcctccaactgcaaaaccaacttgttacctcgcacctcgaaaccttcctagtactggattctttccattcctgcagaccctactctgtgacacagactctaaatgcaaagacacaccctatggcccacaagatctgcttcgtaggaaaggaattgatgatgcactatttaaagacagtgagattctgagaaagtcatccaacctggataaggacagcagtttatcattccagagcacccaagttccagaaagaaggcatgcatcactagccacagtatttcccagtccaagttctgatttggaaatccccggaacatatactttcaatggcagtcaagtgctcgcacgaattcttggcttggaaaagctgttaaagcaaaattcaacttcagaagatatacgaagagaactatgtgacagctattcaggatacattgtggatgatgccttctcttggacctttctaggaagaaatgtttttaacaaattttgcctttctaacatgacccttttagagtcttctctccaagaactaaacaaacagttctcccagctatccagtgaccccaacaatcagaagatagtgtttcaggaaatagtcagaatgctgtctttcttctcacaagtgcaagagcagaaagctgtgtggcagcttctgtctagttttccaaatgtgtttcagaatgacacatcactaagcaatctatttgatgttcttcgaaaggcaaacagtgtgctgctggttgtgcagaaggtttatccacgttttgcaactaacgaaggtttcagaaccctccagaagtctgttaaacatctgctgtacactctggactccccagctcaaggtgactccgataatataacgcatgtgtggaatgaggatgatggacagaccttatctccaagcagtctggctgcacagctcctaattctggaaaactttgaagatgccctcttaaatatatcagcaaatagtccttatattccttacttggcatgtgtgagaaatgtgactgacagtttggccagaggttcaccagaaaatctaagactcctgcagtccacaatacgatttaaaaaatcttttcttcgcaatggttcctatgaagattactttcctccagttcctgaagtcctaaaatcaaaactgtctcaacttcgaaacttgaccgaacttctttgtgaatctgaaactttcagtttgatagagaagtcatgccagctctctgatatgagctttgggagcctgtgtgaagaaagtgagtttgatctgcaactcctcgaagcggcagagctgggcaccgaaatagcagccagcttactgtaccatgacaatgtcatatctaaaaaagtgagagatttgctgactggagatccaagcaaaattaatttaaatatggatcagtttctagaacaggcactgcaaatgaattacttggaaaatatcactcagttaataccgatcatagaagccatgctgcatgtcaataacagtgcagatgcttctgaaaagccaggtcagttactagaaatgtttaaaaatgttgaagagctgaaagaagatttaaggagaacaacaggaatgtccaacaggactattgacaagttgctggccattcccatccctgataatagagctgagattatttctcaggtgttctggctgcattcctgtgatactaatatcaccactcccaaactagaagatgcaatgaaagaattctgcaacctgtctctttcagagagatcccggcagtcttacctcatcggactcacccttctgcactacttaaacatttacaacttcacatacaaggtgtttttcccgaggaaagatcaaaagccagtagaaaagatgatggagctcttcataagactaaaagagattctcaatcagatggcttctggcacacatccgctgctagacaaaatgagatccctgaagcaaatgcatctgcccagaagtgttccattaacacaggcaatgtacagaagcaaccgaatgaacacaccacaaggatcatttagcaccatctcccaagcattatgttctcaaggaattaccactgaatatttaactgccatgctgccctcttcccagaggccaaaaggcaaccacaccaaggattttttgacttataaattaactaaagagcaaattgcttcaaaatatggaattcccataaattccacaccattttgcttctccctttataaagacatcattaacatgcccgctggacctgtgatttgggctttcttgaaacctatgttgttgggaagaattttgtatgcaccatataacccagtcacaaaggcaataatggaaaagtccaatgtaactctgagacagctggcggaattaagagaaaaatctcaagagtggatggataagtcgccacttttcatgaattccttccatctgttaaaccaggcaattccaatgctccagaatactctaaggaacccttttgtgcaagtttttgtaaagttctccgtgggactcgatgctgttgaactattgaaacagatagatgaactcgatattctaagactgaaattagagaacaacattgacatcatcgatcagcttaacacactatcttccctgacagtaaatatttcctcttgtgtattatatgaccgtattcaggcagcaaaaaccatagatgaaatggagagagaggctaaaaggctctacaaaagcaacgaactctttggaagtgttatttttaagcttccttctaacagaagctggcacagaggctatgactctggaaatgtctttcttcctcctgtcataaaatataccatccggatgagtctcaagaccgcacagaccacaagaagcctaagaaccaagatttgggctccagggccacacaattctccatcacacaaccagatctatggcagggcttttatttatttacaggatagtattgaaagagcaatcattgaattgcaaactggaaggaactcccaggaaatagcagtccaggttcaagcaattccttatccctgcttcatgaaagacaacttcctaaccagtgtctcttattctcttccaattgtgcttatggttgcctgggttgtatttatagctgcctttgtaaaaaagcttgtctatgagaaagacctccggcttcatgagtacatgaagatgatgggtgtgaactcctgcagccatttctttgcctggcttatagagagtgttggatttttactggttaccatcgtgatcctcatcattatactcaagtttggcaatattcttcctaaaacaaatgggttcattttgttcctgtatttttcggactacagcttctcggttattgccatgagctatcttatcagtgtcttcttcaacaacaccaacattgcagctctgatcggaagcctcatctacatcattgccttctttccatttattgttctggttacagtggagaatgagttgagctatgtattgaaagtgttcatgagcctgctgtccccaacagcattcagctatgcaagccaatacattgcacgatacgaagaacagggcattggtcttcagtgggaaaatatgtacacctccccggttcaggatgacaccacctcatttggctggctgtgctgtctaatcctagctgactctttcatttatttccttattgcttggtatgtcaggaatgtcttcccagggacatacggtatggcagctccctggtattttccaattcttccttcctattggaaggagcgatttgggtgtgcagaggtgaagcctgagaagagcaatggcctcatgtttactaacatcatgatgcagaacaccaacccatctgccagtcctgaatacatgttttcctctaacatcgagcctgaacctaaagatctcacagtcggggttgccctgcatggggtcacaaagatctatggctcaaaagttgctgttgataacctcaatctgaacttttatgaagggcatattacttcattgctggggcccaatggagctgggaaaactactaccatttccatgttaactgggctgtttggggcctcagcaggcaccatttttgtatatggaaaagatatcaaaacagacctacacacggtacggaagaacatgggagtctgtatgcagcacgacgtcttgttcagttacctcactactaaggagcaccttctcctatatggttccatcaaagttcctcactggactaaaaagcagctccacgaggaagtaaaaaggactttaaaagatactggactatatagccatcgtcataagagagttggaacactgtcaggaggcatgaagaggaagttatctatatccatagctctcattggtggatcaagggtagtaattttggatgaaccatctactggagttgacccatgttctcgccgaagtatatgggatgttatatccaagaacaaaactgccagaacaatcattctgtcaacgcaccacttggacgaggctgaagtgctgagtgaccgcatcgccttcctggagcagggtgggcttaggtgctgtgggtccccattttacctcaaggaagcctttggcgatgggtatcacctcacgcttaccaagaagaagagtccaaatttaaatgcaaatgcagtatgtgacaccatggccgtgacagcaatgatccaatcacatctccccgaagcctacctcaaggaggatattgggggagagcttgtttatgtacttcctccattcagcaccaaagtctcaggggcctacctgtcactcctacgggcactcgacaatggcatgggtgacctcaacatcgggtgctacggcatttcagataccaccgtggaggaggtctttctgaacttgaccaaagagtcacaaaaaaatagtgctatgagtcttgagcacttaacacaaaagaaaattgggaattccaatgccaatggcatctcaactcctgacgatttatctgtgagcagcagcaatttcacagacagagatgacaaaatcctgacaagaggagagaggctggatggctttggactgttgctgaagaagatcatggctatactcatcaagaggttccaccacacccgcaggaactggaaaggtctcattgctcaggttatcctccccatcgtctttgttaccactgccatgggccttggcacactgagaaattccagcaacagttatccagagattcagatctccccctctctttatggtacctccgaacagacagccttctatgctaattatcacccgagcacggaagcacttgtctcagcaatgtgggacttccctggaattgacaacatgtgtctgaacaccagtgatctacagtgtttaaacaaagacagtctggaaaaatggaacaccagtggagaacccatcactaattttggtgtttgctcctgctcagaaaatgtccaggaatgtcctaaatttaactattccccaccgcacagaagaacttactcatcccaggtaatttataacctcactgggcaacgagtggaaaattatcttatatcaactgcaaatgagtttgtccaaaaaagatatggaggttggagttttgggctgcctttgacaaaagaccttcgttttgatataacaggagtccctgccaatagaacacttgccaaggtatggtatgatccagaaggctatcactcccttccagcttacctcaacagcctgaataatttccttctgcgagttaacatgtcaaaatacgatgctgcccgacatggcatcatcatgtatagccatccttatccaggagtgcaagaccaagaacaagccacaatcagcagtttaatcgatattttagtggcactgtctatcttgatgggctactctgtcaccaccgccagctttgtcacctatgttgtaagggaacatcaaaccaaagccaaacagttgcagcacatttcaggcattggcgtgacatgctactgggtaacaaacttcatttatgacatggttttctacttggtgcctgtagcgttttcaattggtatcattgcgattttcaaattacctgcattctacagtgaaaacaacctaggcgctgtatctctcctacttctcctgtttgggtatgcaacattttcctggatgtacttgctggctgggctcttccatgaaacaggaatggccttcatcacttacgtctgtgtcaacttgttttttggcattaattccattgtttccctgtcagtggtatactttctttccaaggaaaagcctaatgatccgactttagaacttatttctgaaaccctcaagcgcattttcctgattttcccacaattctgttttggctacggtttgattgaactttctcaacaacagtcggtcctagacttcttaaaagcatatggagtggaatacccaaatgaaacctttgagatgaataaactaggtgcaatgtttgtggctttggtttctcagggcaccatgtttttttccttgcgactcttaatcaacgaatccctgataaagaaactcaggcttttcttcagaaaatttaattcttcacatgtaagggagacaatagatgaggatgaagatgtgcgggctgagagattaagagttgagagtggtgcagctgaatttgacttggtccaactttattgtctcacaaagacctaccaacttatccacaaaaagattatagctgtaaacaacatcagcattgggatacctgctggagagtgttttgggcttcttggagtgaatggagcaggaaagaccactatattcaagatgctgacaggagacatcattccttcaagtggaaacattctgatcagaaataagaccggatctctgggtcacgttgattctcacagctcattagttggctactgtcctcaggaagatgccttagatgacctggtaactgtggaagaacatttgtatttctatgccagggtacatggaattccagaaaaggatattaaagaaactgttcataaactccttaggagacttcacctgatgcccttcaaggacagagctacctctatgtgcagttatggcacaaaaagaaaattatccactgcactggccttgatagggaaaccttccattctactgctggatgagccgagctctggcatggatccgaagtcgaaacggcacctctggaagatcatttcagaagaagtacagaacaaatgttccgtcatcctcacatctcacagcatggaagaatgtgaagctctctgtaccaggttggccattatggtgaatggaaagtttcaatgtattggatctttgcagcacataaagagcaggtttggacgaggatttactgtcaaagttcacttgaagaataacaaagtgaccatggagaccctcacaaagttcatgcagctgcactttccaaaaacatacttaaaagatcagcacctcagcatgctagagtatcatgtaccagtcacagcaggaggagtcgcaaacatttttgatctgctggaaaccaacaagactgctttaaatattacaaatttcttagtgagtcagaccactctggaagaggttttcatcaactttgccaaagaccagaagtcctatgaaactgctgataccagcagccaaggttccactataagtgttgactcacaagatgaccagatggagtcttaacacttccagcaaactcaatctcagcgtgtgaccaatggcttcattttgaagaaaagccacagaagatacacttccgcaagatatcttcattttaaagtaaagtaatatactgtatggaaagttacaactgtgttagactaacaagtaattataaaaggaaatttttccttctaaggtcagtgagtgttgttgctactgaaatgaattcctgtatactcaacactgtgagcatgctaatgtatatgctggtgattcttatgcaaaggtgaagccacctcaagatgaatatcttaatttattactttcaataaaaagacagtttaaaaggcatggattttggtagttgaaatataagagtggagaagaaaagtcagatggtttgtggcaggtgccaccgggcaagcagacaacataatttatttccagaaaacaacagaatgaacatcatcatgaatacatgaatcggctgtgatgtgtgaactgctaagggccaaatgaacgtttgcagagcagtgggcacaatgtttacaatgtatgtgtatgtcactttcggtacctgtgaatgcatggggacgtgctgaacccgaaaaaaagtgcctttccataaggactgcaatagagagggcaatttaccctggtggtacacggaacctagattcactcctgccatgccttgccaatagtaagctgcagggtggaacaagaaatcacttgctctggggggaagggaggggggaatgggtgtgtcagctgggtagatacaaaccctgaaaagagaatccatgtgctactggcaggcaacattttttaaagctctttcagaaaccctcatatttggggtttcttttcaggaaacattcctgtggagggaaaacgaatatgaagataattttcagctaattatctgggtgacccagaatcgtgtatatggctataggatagacttcttaataatggcaagtgacgtggccctggggaaaggtgctttatgtaccgtgtgtgcgtgtatgtgtgtgtatctatacaagtttgtcagctttggcatgactgtttgtctcgaaaaccaataaactcaaagtttagaaaaactca

SEQ ID NO: 110029 - DNA, 7005 bp, Homo sapiens
  Payload ID: 1600
  Gene Symbol: ABCA12
  Gene Name: ATP-binding cassette, sub-family A (ABC1), member 12
  Uniprot ID: Q86UK0
  ENST ID: ENST00000389661
  CDS Start-End: 160-6993
atttcctataaatatcacaaatatttccaacaaaagagcatagatgtcttttatacaattcttttgagaatgattctgcagatttctgcattttctcctcattaatttgacctgggatggttttcactgaggaaaaaaatctttaagcaaacatgttaaatgtttacctatataaaaattattacttcaggtgactccgataatataacgcatgtgtggaatgaggatgatggacagaccttatctccaagcagtctggctgcacagctcctaattctggaaaactttgaagatgccctcttaaatatatcagcaaatagtccttatattccttacttggcatgtgtgagaaatgtgactgacagtttggccagaggttcaccagaaaatctaagactcctgcagtccacaatacgatttaaaaaatcttttcttcgcaatggttcctatgaagattactttcctccagttcctgaagtcctaaaatcaaaactgtctcaacttcgaaacttgaccgaacttctttgtgaatctgaaactttcagtttgatagagaagtcatgccagctctctgatatgagctttgggagcctgtgtgaagaaagtgagtttgatctgcaactcctcgaagcggcagagctgggcaccgaaatagcagccagcttactgtaccatgacaatgtcatatctaaaaaagtgagagatttgctgactggagatccaagcaaaattaatttaaatatggatcagtttctagaacaggcactgcaaatgaattacttggaaaatatcactcagttaataccgatcatagaagccatgctgcatgtcaataacagtgcagatgcttctgaaaagccaggtcagttactagaaatgtttaaaaatgttgaagagctgaaagaagatttaaggagaacaacaggaatgtccaacaggactattgacaagttgctggccattcccatccctgataatagagctgagattatttctcaggtgttctggctgcattcctgtgatactaatatcaccactcccaaactagaagatgcaatgaaagaattctgcaacctgtctctttcagagagatcccggcagtcttacctcatcggactcacccttctgcactacttaaacatttacaacttcacatacaaggtgtttttcccgaggaaagatcaaaagccagtagaaaagatgatggagctcttcataagactaaaagagattctcaatcagatggcttctggcacacatccgctgctagacaaaatgagatccctgaagcaaatgcatctgcccagaagtgttccattaacacaggcaatgtacagaagcaaccgaatgaacacaccacaaggatcatttagcaccatctcccaagcattatgttctcaaggaattaccactgaatatttaactgccatgctgccctcttcccagaggccaaaaggcaaccacaccaaggattttttgacttataaattaactaaagagcaaattgcttcaaaatatggaattcccataaattccacaccattttgcttctccctttataaagacatcattaacatgcccgctggacctgtgatttgggctttcttgaaacctatgttgttgggaagaattttgtatgcaccatataacccagtcacaaaggcaataatggaaaagtccaatgtaactctgagacagctggcggaattaagagaaaaatctcaagagtggatggataagtcgccacttttcatgaattccttccatctgttaaaccaggcaattccaatgctccagaatactctaaggaacccttttgtgcaagtttttgtaaagttctccgtgggactcgatgctgttgaactattgaaacagatagatgaactcgatattctaagactgaaattagagaacaacattgacatcatcgatcagcttaacacactatcttccctgacagtaaatatttcctcttgtgtattatatgaccgtattcaggcagcaaaaaccatagatgaaatggagagagaggctaaaaggctctacaaaagcaacgaactctttggaagtgttatttttaagcttccttctaacagaagctggcacagaggctatgactctggaaatgtctttcttcctcctgtcataaaatataccatccggatgagtctcaagaccgcacagaccacaagaagcctaagaaccaagatttgggctccagggccacacaattctccatcacacaaccagatctatggcagggcttttatttatttacaggatagtattgaaagagcaatcattgaattgcaaactggaaggaactcccaggaaatagcagtccaggttcaagcaattccttatccctgcttcatgaaagacaacttcctaaccagtgtctcttattctcttccaattgtgcttatggttgcctgggttgtatttatagctgcctttgtaaaaaagcttgtctatgagaaagacctccggcttcatgagtacatgaagatgatgggtgtgaactcctgcagccatttctttgcctggcttatagagagtgttggatttttactggttaccatcgtgatcctcatcattatactcaagtttggcaatattcttcctaaaacaaatgggttcattttgttcctgtatttttcggactacagcttctcggttattgccatgagctatcttatcagtgtcttcttcaacaacaccaacattgcagctctgatcggaagcctcatctacatcattgccttctttccatttattgttctggttacagtggagaatgagttgagctatgtattgaaagtgttcatgagcctgctgtccccaacagcattcagctatgcaagccaatacattgcacgatacgaagaacagggcattggtcttcagtgggaaaatatgtacacctccccggttcaggatgacaccacctcatttggctggctgtgctgtctaatcctagctgactctttcatttatttccttattgcttggtatgtcaggaatgtcttcccagggacatacggtatggcagctccctggtattttccaattcttccttcctattggaaggagcgatttgggtgtgcagaggtgaagcctgagaagagcaatggcctcatgtttactaacatcatgatgcagaacaccaacccatctgccagtcctgaatacatgttttcctctaacatcgagcctgaacctaaagatctcacagtcggggttgccctgcatggggtcacaaagatctatggctcaaaagttgctgttgataacctcaatctgaacttttatgaagggcatattacttcattgctggggcccaatggagctgggaaaactactaccatttccatgttaactgggctgtttggggcctcagcaggcaccatttttgtatatggaaaagatatcaaaacagacctacacacggtacggaagaacatgggagtctgtatgcagcacgacgtcttgttcagttacctcactactaaggagcaccttctcctatatggttccatcaaagttcctcactggactaaaaagcagctccacgaggaagtaaaaaggactttaaaagatactggactatatagccatcgtcataagagagttggaacactgtcaggaggcatgaagaggaagttatctatatccatagctctcattggtggatcaagggtagtaattttggatgaaccatctactggagttgacccatgttctcgccgaagtatatgggatgttatatccaagaacaaaactgccagaacaatcattctgtcaacgcaccacttggacgaggctgaagtgctgagtgaccgcatcgccttcctggagcagggtgggcttaggtgctgtgggtccccattttacctcaaggaagcctttggcgatgggtatcacctcacgcttaccaagaagaagagtccaaatttaaatgcaaatgcagtatgtgacaccatggccgtgacagcaatgatccaatcacatctccccgaagcctacctcaaggaggatattgggggagagcttgtttatgtacttcctccattcagcaccaaagtctcaggggcctacctgtcactcctacgggcactcgacaatggcatgggtgacctcaacatcgggtgctacggcatttcagataccaccgtggaggaggtctttctgaacttgaccaaagagtcacaaaaaaatagtgctatgagtcttgagcacttaacacaaaagaaaattgggaattccaatgccaatggcatctcaactcctgacgatttatctgtgagcagcagcaatttcacagacagagatgacaaaatcctgacaagaggagagaggctggatggctttggactgttgctgaagaagatcatggctatactcatcaagaggttccaccacacccgcaggaactggaaaggtctcattgctcaggttatcctccccatcgtctttgttaccactgccatgggccttggcacactgagaaattccagcaacagttatccagagattcagatctccccctctctttatggtacctccgaacagacagccttctatgctaattatcacccgagcacggaagcacttgtctcagcaatgtgggacttccctggaattgacaacatgtgtctgaacaccagtgatctacagtgtttaaacaaagacagtctggaaaaatggaacaccagtggagaacccatcactaattttggtgtttgctcctgctcagaaaatgtccaggaatgtcctaaatttaactattccccaccgcacagaagaacttactcatcccaggtaatttataacctcactgggcaacgagtggaaaattatcttatatcaactgcaaatgagtttgtccaaaaaagatatggaggttggagttttgggctgcctttgacaaaagaccttcgttttgatataacaggagtccctgccaatagaacacttgccaaggtatggtatgatccagaaggctatcactcccttccagcttacctcaacagcctgaataatttccttctgcgagttaacatgtcaaaatacgatgctgcccgacatggcatcatcatgtatagccatccttatccaggagtgcaagaccaagaacaagccacaatcagcagtttaatcgatattttagtggcactgtctatcttgatgggctactctgtcaccaccgccagctttgtcacctatgttgtaagggaacatcaaaccaaagccaaacagttgcagcacatttcaggcattggcgtgacatgctactgggtaacaaacttcatttatgacatggttttctacttggtgcctgtagcgttttcaattggtatcattgcgattttcaaattacctgcattctacagtgaaaacaacctaggcgctgtatctctcctacttctcctgtttgggtatgcaacattttcctggatgtacttgctggctgggctcttccatgaaacaggaatggccttcatcacttacgtctgtgtcaacttgttttttggcattaattccattgtttccctgtcagtggtatactttctttccaaggaaaagcctaatgatccgactttagaacttatttctgaaaccctcaagcgcattttcctgattttcccacaattctgttttggctacggtttgattgaactttctcaacaacagtcggtcctagacttcttaaaagcatatggagtggaatacccaaatgaaacctttgagatgaataaactaggtgcaatgtttgtggctttggtttctcagggcaccatgtttttttccttgcgactcttaatcaacgaatccctgataaagaaactcaggcttttcttcagaaaatttaattcttcacatgtaagggagacaatagatgaggatgaagatgtgcgggctgagagattaagagttgagagtggtgcagctgaatttgacttggtccaactttattgtctcacaaagacctaccaacttatccacaaaaagattatagctgtaaacaacatcagcattgggatacctgctggagagtgttttgggcttcttggagtgaatggagcaggaaagaccactatattcaagatgctgacaggagacatcattccttcaagtggaaacattctgatcagaaataagaccggatctctgggtcacgttgattctcacagctcattagttggctactgtcctcaggaagatgccttagatgacctggtaactgtggaagaacatttgtatttctatgccagggtacatggaattccagaaaaggatattaaagaaactgttcataaactccttaggagacttcacctgatgcccttcaaggacagagctacctctatgtgcagttatggcacaaaaagaaaattatccactgcactggccttgatagggaaaccttccattctactgctggatgagccgagctctggcatggatccgaagtcgaaacggcacctctggaagatcatttcagaagaagtacagaacaaatgttccgtcatcctcacatctcacagcatggaagaatgtgaagctctctgtaccaggttggccattatggtgaatggaaagtttcaatgtattggatctttgcagcacataaagagcaggtttggacgaggatttactgtcaaagttcacttgaagaataacaaagtgaccatggagaccctcacaaagttcatgcagctgcactttccaaaaacatacttaaaagatcagcacctcagcatgctagagtatcatgtaccagtcacagcaggaggagtcgcaaacatttttgatctgctggaaaccaacaagactgctttaaatattacaaatttcttagtgagtcagaccactctggaagaggttttcatcaactttgccaaagaccagaagtcctatgaaactgctgataccagcagccaaggttccactataagtgttgactcacaagatgaccagatggagtcttaacacttccagcaa

SEQ ID NO: 110030 - DNA, 485 bp, Homo sapiens
  Payload ID: 1600
  Gene Symbol: ABCA12
  Gene Name: ATP-binding cassette, sub-family A (ABC1), member 12
  ENST ID: ENST00000412081
  CDS Start-End: 197-469
ttggttaaggattaaccacagggaaaaatccagcagaaacagaagaactgtgggtttcttaccccagccctcaaggaagctatgccgtgaaaggggtactgatacactgacatacagcaagttggacggggcatcagttcttcatttgtggagtggagaaaagaagaggaaatctctcatttggggcatttgaaggatggcttccctgtttcatcagcttcagatcctggtctggaaaaattggctaggtgtaaaaaggcagccgctttggacacttgtcttgatcttatggccagtcattattttcataattttggctattactcggaccaaatttcctccaactgcaaaaccaacttgggattcttctacttggaacacttgtgatggatggatggcccagattttttttttttcctgcataaatgaggaaactgactcaagatacagggttatgattgcacaataaatcatttgcaaagcta

SEQ ID NO: 110031 - DNA, 463 bp, Homo sapiens
  Payload ID: 1601
  Gene Symbol: ABCA13
  Gene Name: ATP-binding cassette, sub-family A (ABC1), member 13
  ENST ID: ENST00000435451
  CDS Start-End: 1-463
cctggagagcatccgtcagtgtggagtggccctctgcatcgtgctgggattctccatcctgtctgcatccatcggcagctctgtgctcttttacttggtttccgtctgcctgtgtgttgccgttattgtcgccttccagttaacagcttttactttccgcaagaacttggcagccacggccctcctgctgtcacttttcggatatgcaactcttccatggatgtacctgatgtccagaatcttttccagttcggacgtggctttcatttcctatgtctcactaaacttcatctttggcctttgtaccatgctcataaccattatgccccggttgctagccatcatctccaaagctaagaatttacagaatatctatgatgtcctcaagtgggtctttactatttttcctcaattctgtcttggtcaaggactggtagaactctgctataatcagatcaaatat

SEQ ID NO: 110032 - DNA, 4480 bp, Homo sapiens
  Payload ID: 1601
  Gene Symbol: ABCA13
  Gene Name: ATP-binding cassette, sub-family A (ABC1), member 13
  ENST ID: ENST00000411975
  CDS Start-End: 1-2496
gtgcagggcgtccagctgctccgcgcacaagtggccgcgatcctggcccggaggctccgccgcacgctgcgcgccgggaagagcaccctcgccgacctgctgctgccagtcctcttcgtggccttggccatgggcttgttcatggtgagacccctggccaccgagtaccctcccctcagactcacacctggacattaccagcgggccgagacctactttttcaggaagaattcttcatgctggcgcacagatcccttttctcacccagaattccaggattcatgtggctgcctgaagtgtccaaatagaagtgctagtgctccctacctgaccaaccacctgggccacacactgttgaatctctcaggcttcaatatggaggagtacttgctggcaccatctgaaaaaccaaggcttggaggttggtcttttggattaaaaatccccagtgaagctggaggtgcaaatggaaacatatcaaaacccccaactctggcaaaggtgtggtataatcagaagggttttcattccctaccttcctacttaaatcatctaaacaaccttattttgtggcagcacctaccccctactgtggactggagacaatacggaataacactctacagccacccatatggaggggccttgctgaacgaggacaagatcctggagagcatccgtcagtgtggagtggccctctgcatcgtgctgggattctccatcctgtctgcatccatcggcagctctgtggtgagggacagggtgattggagccaaaaggttgcagcacataagtggccttggctacaggatgtactggttcacaaacttcctatatgacatgctcttttacttggtttccgtctgcctgtgtgttgccgttattgtcgccttccagttaacagcttttactttccgcaagaacttggcagccacggccctcctgctgtcacttttcggatatgcaactcttccatggatgtacctgatgtccagaatcttttccagttcggacgtggctttcatttcctatgtctcactaaacttcatctttggcctttgtaccatgctcataaccattatgccccggttgctagccatcatctccaaagctaagaatttacagaatatctatgatgtcctcaagtgggtctttactatttttcctcaattctgtcttggtcaaggactggtagaactctgctataatcagatcaaatatgacctgacccacaacttcggcattgattcctatgtgagtccctttgagatgaactttctgggctggatcttcgtgcaactggcctcgcagggcacagtacttctcctcttgagggttctgctacactgggaccttctgcgatggccaaggggtcattctactctccaaggcacagtcaaatcttctaaggatacagatgttgaaaaagaggaaaagagagtgtttgaaggaaggaccaatggagacattcttgtgttatacaaccttagtaaacattatcgacgctttttccagaatattattgctgtgcaagatattagtttgggcataccaaaaggagagtgctttggacttctaggggtgaatggagctgggaagagcacgactttcaaaatgctgaatggtgaagtttctctaacttcaggacatgctatcatcaggactcccatgggagacgccgtggacctgtcttctgctggcacggcaggcgtgctcattggctactgtccccagcaggatgccctggacgagcttctgactggttgggaacatctctattattactgtagcttacgcgggattccaaggcagtgcatccctgaggttgctggagacctcatcaggcgcttacacctcgaagcccacgcggacaaacctgtggccacctacagtgggggaaccaagcggaaactctctacagccctggccctggtggggaaacctgacattcttttattggatgagcccagctctgggatggatccctgctctaagcggtacctgtggcaaacaataatgaaggaggttcgggaaggctgtgctgcggtgctgacctcccacagcatggaggagtgtgaggctctttgcacaagactggccataatggttaacggcagcttcaaatgtcttggttctcctcagcacatcaaaaataggtttggtgatggttatacagtcaaagtttggctctgtaaggaagcaaatcaacattgcactgtttctgaccacttgaagctttattttccaggaattcagttcaagggacagcacctgaatttattagaatatcatgtgccaaaaagatggggatgcctagctgacttgttcaaagttatagagaacaataaaaccttcttgaatattaagcattattccattaaccaaaccactttggagcaggtatttattaattttgcttctgagcagcagcaaactctacaatctactcttgatccatccactgacagtcaccacacacatcacttgcccatctgagcactaaagaagtttccataaggaataaaaccttgtcttccattacaattaacagtcaaggataaaacaagcacgcgcacaatcaaggagctggaacacactctccaggccgtcaaattattctcttgttcattttctattttgaatctccttgttagttaataaccaccaaatggaaaggtcattctttctgcagacttttggggagctcctccaaaacatttgttctctttaccatgccagatggacaccagcttctttgtgacaaaggcatgaatgatttgacagtgtccaaactgagacattctggagctggaaagcctgtcacactagagtgtgtgtgacatgtccactctaaacatgtcacttttctgttaagaaaactgagccccctccccacaggttaaaaaactttagtaacttgtttgtatagaaaatagtaacaaggactattttctattgttgtcatctatttactagatacatgtttttaatgattttaatgtaagcttttattaatactgatgacattatatggtatgatatgaaaaaatcaccaattttttacatataaaagatacctttttaaaaaaataggttttaagagctcttttagtatacactttagcaaaattaattaaattgaactagttactctgtatcaattacagtagttctaccagaatctcccaggttataatttatgagggtagagaaataaaatgtagatgcattttctttttcttcatttggatgaataattactgttttttgttattctaagtcagtgtttttcaaagcgtagtggtccccatattagctgcattgccatcttctgggagcttgcaagaaatgtacattctcaggatccactccagacctattgaatctcaaattctggggcttaaacaagcacattccaagttaagaaccaatgacctaagggaatgtctggttacctcctagttatacaagcaaaatctgcatagtatgtagtcttttttatttatttattttttttttttgaggcggagtctcgctctgtcacccaggctggagtgcagtggcgcgatgtcggctcactgcaagctccgcctcctgggttcacgccattctcctgcctcagcctccccagcagctgggactacaggcacacatcgccacacccggctaatttttagtatttttagtagagacggggtttcaccgtgttagccaggatggtctctatctcctgaccttgtgatccgcccccctccacctcccaaagtgctgggattacaggcgtgagccaccgtgtccggccgtagtttattttaaaatatatttttaaaagctttgtaaaaattatgtcattctcagaattgttgtcttcaaagcattgtcagatgtagagtgctcagatgtggctcttaaagactatatacatctgaatttttcatcctatagttagtaagatgcataaaatcaatccactactgaaatagtttccagtcagacatttctgagttcagacatttctcaacattcttttaacaacatttttctgaatcctcaatagaaaatcacattaatcttattttaaaatttggcctttttcaacactaacgttgagtaccggtagcttgtgatcaaaggcatatacttccttatgagatttctttactaaagcaagatttcattaaatctctatttcctaaatatcattctatacaaaagatattttttaaacggtaaggattaagacaatcactgatagctttgttgtgagcaattttgattcccatgtatcacatgaattacacttccttaaataaattacagtttatggctgtatgatttattctctaattctaacatagtctagttgtcaaaaggaaatatgtaatctttttatgattgttgaatcaataaataccaatttgtgaaacatgaatgtgtttaaactgcagtgaataaatgagatgtgctttaatttaacccg

SEQ ID NO: 110033 - DNA, 4275 bp, Homo sapiens
  Payload ID: 1601
  Gene Symbol: ABCA13
  Gene Name: ATP-binding cassette, sub-family A (ABC1), member 13
  ENST ID: ENST00000453246
  CDS Start-End: 1-3577
gattcaatggaataatatgtaccaggctctggaacaagggggcatgacatttggctgggtttgctggatgattctttttgattcaagcctttattttttgtgtggatggtacttgagcaacttgattcctggaacatttggtttacggaaaccatggtatttcccctttactgcctcatattggaagagtgtgggtttcttggtggagaaaaggcaatactttctaagttctagtctgttcttcttcaatgagaactttgacaataaagggtcatcactgcaaaacagggaaggagagcttgaaggaagtgccccgggagtcaccctggtgtctgtgaccaaggaatatgagggccacaaggctgtggtccaagacctcagcctgaccttctacagagaccaaatcaccgccctgctggggacaaacggtgccgggaaaaccactatcatatccatgttgacggggctccaccctcccacttctggaaccatcatcatcaatggcaagaacctacagacagacctgtcgagggtcagaatggagcttggtgtgtgtccgcagcaggacatcctgttggacaacctcaccgtccgggaacatttgctgctctttgcttccataaaggcgcctcagtggaccaagaaggagctgcatcagcaagtcaatcaaactcttcaggatgtggacttaactcagcatcagcacaaacagacccgagctctgtctggaggcctgaagaggaagctctcccttggcattgctttcatgggcatgtcgaggaccgtggttctggatgagcccaccagtggggtggacccttgctcccggcatagcctgtgggacattctgctcaagtaccgagaaggtcgtacgatcatcttcacaacccaccacctggatgaagctgaagcgctgagtgaccgcgtggccgtcctccagcatgggaggctcaggtgctgcggtcctcccttctgcctgaaggaggcatatggccaggggctccgcctgacactcacgaggcagccttctgttctggaggcccatgatctgaaagacatggcttgtgttacatccctgataaagatctatattccacaagcatttctcaaagacagcagtggaagtgagctgacctacaccattccaaaggacacagacaaggcctgcttgaaagggctcttccaggccctggatgagaacctgcatcagctgcacctgacgggctatgggatctcagacaccaccttagaagaggtgtttttgatgcttttgcaagattccaacaagaaatctcacattgccctggggactgagtcagagctgcagaaccacaggcctacaggacatctgtctggctactgtggctccctagcacggcccgcaactgtgcagggcgtccagctgctccgcgcacaagtggccgcgatcctggcccggaggctccgccgcacgctgcgcgccgggaagagcaccctcgccgacctgctgctgccagtcctcttcgtggccttggccatgggcttgttcatggtgagacccctggccaccgagtaccctcccctcagactcacacctggacattaccagcgggccgagacctactttttcagcagtgggggcgacaacttggacctcacccgtgtgcttctgcggaagtttagagatcaagatttgccctgtgcagatttaaacccacgccagaagaattcttcatgctggcgcacagatcccttttctcacccagaattccaggattcatgtggctgcctgaagtgtccaaatagaagtgctagtgctccctacctgaccaaccacctgggccacacactgttgaatctctcaggcttcaatatggaggagtacttgctggcaccatctgaaaaaccaaggcttggaggttggtcttttggattaaaaatccccagtgaagctggaggtgcaaatggaaacatatcaaaacccccaactctggcaaaggtgtggtataatcagaagggttttcattccctaccttcctacttaaatcatctaaacaaccttattttgtggcagcacctaccccctactgtggactggagacaatacggaataacactctacagccacccatatggaggggccttgctgaacgaggacaagatcctggagagcatccgtcagtgtggagtggccctctgcatcgtgctgggattctccatcctgtctgcatccatcggcagctctgtggtgagggacagggtgattggagccaaaaggttgcagcacataagtggccttggctacaggatgtactggttcacaaacttcctatatgacatgctcttttacttggtttccgtctgcctgtgtgttgccgttattgtcgccttccagttaacagcttttactttccgcaagaacttggcagccacggccctcctgctgtcacttttcggatatgcaactcttccatggatgtacctgatgtccagaatcttttccagttcggacgtggctttcatttcctatgtctcactaaacttcatctttggcctttgtaccatgctcataaccattatgccccggttgctagccatcatctccaaagctaagaatttacagaatatctatgatgtcctcaagtgggtctttactatttttcctcaattctgtcttggtcaaggactggtagaactctgctataatcagatcaaatatgacctgacccacaacttcggcattgattcctatgtgagtccctttgagatgaactttctgggctggatcttcgtgcaactggcctcgcagggcacagtacttctcctcttgagggttctgctacactgggaccttctgcgatggccaaggggtcattctactctccaaggcacagtcaaatcttctaaggatacagatgttgaaaaagaggaaaagagagtgtttgaaggaaggaccaatggagacattcttgtgttatacaaccttagtaaacattatcgacgctttttccagaatattattgctgtgcaagatattagtttgggcataccaaaaggagagtgctttggacttctaggggtgaatggagctgggaagagcacgactttcaaaatgctgaatggtgaagtttctctaacttcaggacatgctatcatcaggactcccatgggagacgccgtggacctgtcttctgctggcacggcaggcgtgctcattggctactgtccccagcaggatgccctggacgagcttctgactggttgggaacatctctattattactgtagcttacgcgggattccaaggcagtgcatccctgaggttgctggagacctcatcaggcgcttacacctcgaagcccacgcggacaaacctgtggccacctacagtgggggaaccaagcggaaactctctacagccctggccctggtggggaaacctgacattcttttattggatgagcccagctctgggatggatccctgctctaagcggtacctgtggcaaacaataatgaaggaggttcgggaaggctgtgctgcggtgctgacctcccacaggttttggtatcaggatgatgctggcctcataaaatgagttacagaggattccctctttttctattgattggaatagtttcagaaggaatggtaccagctcctctttgtacctctagtagaatttggctgtgaattcgtctggtcctggactttttttggaaaatatataaagcatatttggaaaatttatgacatgtatctcttggacttcatgctaagcaactataacaaagaaacctcaacttacagtggcccagacaagacacattttttcctctcgctaaattcatgtcagtgggctgtgcatcatcaggccaaccaaggccttgggttctttccaccgtgccaccatcaccatcatcatggttgatgttgactcatcagcaccgtatctacatcctagctcaagggaagtggagaaaaacaaaatccagcatggaggagtgtgaggctctttgcacaagactggccataatggttaacggcagcttcaaatgtcttggttctcctcagcacatcaaaaataggtttggtgatggttatacagtcaaagtttggctctgtaaggaagcaaatcaacattgcactgtttctgaccacttgaagctttattttccaggaattcagttcaagggacagcacctgaatttattagaatatcatgtgccaaaaagatggggatgcctagctgacttgttcaaagttatagagaacaataaaaccttcttgaatatt

SEQ ID NO: 110034 - DNA, 3528 bp, Homo sapiens
  Payload ID: 1601
  Gene Symbol: ABCA13
  Gene Name: ATP-binding cassette, sub-family A (ABC1), member 13
  Uniprot ID: Q86UQ4
  ENST ID: ENST00000417403
  CDS Start-End: 27-980
ctgactgagagcagggagcagcaggcatggggcatgccgggtgccagttcaaagccctgctgtggaagaattggctctgcagactcaggaacccggtccttttccttgctgaattcttctggccttgtatcctgtttgtaattctgacagttcttcgttttcaagaacctcccagatacagagacatttgttatttgcagccccgagatctacccagctgtggtgttatcccctttgttcaaagccttctttgtaacactggatcaaggtgtaggaacttcagctatgaagggtcaatggagcatcattttcgtttgtctaggttccaaactgcagctgaccccaagaaagtcaacaacctggcctttttaaaagagatacaagacctggcagaggaaattcatggaatgatggacaaggcaaaaaacttaaaaagactttgggtagaacgatccaacactccagattcttcttatggttccagtttttttacaatggatctcaataagaccgaggaggtaatattgaaactggaaagcctccatcagcagcctcatatctgggattttctacttttactgccgagactacacacaagccatgatcatgtggaagatggcatggatgttgcagtgaaccttctccagaccattttgaattccttaatatccctagaagatttagattggcttccactcaaccaaactttttcccaggtttctgaacttgtactgaatgtgaccatttcgacactgacatttctgcagcaacatggagtagcagtcaccgagccagtttaccacctgtccatgcagaatatagtgtgggatccacagaaagtccagtatgatctcaaatcccagtttggctttgatgatcttcacacggaacagatcctgaactcttcagctgaactgaaggaggtacacatgcttgactgcttctcacaccgctgggcctttcctggagactggatctagagcatgctgctggggcaggattcccacagacacttccttggagaagatggtgtgttcagtcttgtctagcacatcagaggatgaagctgagaaatggggccacgttggaggctgccaccctaagtggtcagaagccaaaaactatcttgtccatgcagtcagctggctgcgagtctaccaacaggtgtttgttcagtggcaacagggtagcctgcttcagaagacactcacaggcatgggccatagtctggaggctctcaggaatcagtttgaagaagagagcaagccctggaaggtggtggaagctctgcacactgcactgctcctgctgaatgacagcttgtcagcagatggcccaaaagataatcatacatttccaaagatgttctttctggttcctgcccacgtccctgcagtacgggtggctgaggtgtgggagctcttcacccaggctctagcagatagcgtggattttggcaagattacagcatctgtggaaattgcaaagcttgctgcaaaacctgccccagtggccggcactgaagagatttcttcagcttgatggagctctcagaaatgcgatagctcagaatttacattttgtccaagaagtcctcatttgcctggagacatcagctaatgattttaaatggtttgaacttaaccaattgaaactggaaaaggatgtgttcttttgggagctgaaacagatgttggcgaagaatgctgtctgcccgaatggtcgtttctctgagaaggaggtctttttgccgcctggaaactccagcatatggggtggtctccagggactgttgtgctattgtaactcctctgagacgagtgttttaaacaagctacttggttcagtagaggatgctgatcgtattttgcaagaggtcattacttggcacaaaaatatgtcagttttaatacctgaagaatatttggactggcaggaacttgagatgcagctgtcagaagcaagcctttcctgtactcggctcttcctgctgctgggagctgatccctctcctgagaatgatgtcttttctagtgactgtaagcaccagcttgtctccacagtgatatttcatacacttgaaaaaacacaatttttcctggaacaagcatattattggaaagccttcaaaaagtttatcaggaagacttgcgaagtggcccaatatgtaaatatgcaagagagtttccagaacagactattggcttttcctgaggaatctccttgttttgaagaaaacatggattggaaaatgatcagtgataattattttcaatttttgaataacttactcaagtctccaacagcttccatatccagggctttaaatttcacaaagcaccttctaatgatggaaaagaagttgcacacccttgaggatgaacaaatgaactttcttttatcatttgtggaattttttgagaaattattgttgcctaatctttttgactcctccattgttcccagtttccacagcctcccatctctcacagaggatattctgaatataagttctctgtggacaaatcatttaaaaagtttaaagagagacccatctgccactgatgctcagaaactcttggaatttggcaacgaagtgatttggaaaatgcagactctcggaagtcactggataaggaaggaaccaaaaaatcttttgagattcatagaattaatactttttgaaattaatcccaaattactagaattatgggcctatggcatttcaaaaggaaaaagagctaaattggaaaacttctttacacttttaaatttttctgttccagaaaatgagattctgagtacaagttttaacttttcccagttgttccattcagattggcctaaatcaccagctatgaacatagattttgtacgtttaagtgaggctataataactagtctccatgaatttggatttttggagcaggaacagatctcagaagctctgaacacagtctacgctatcaggaatgcatctgatcttttctcagccctttctgaaccacaaaaacaagaagttgataaaattttgactcacatacacctaaatgtcttccaggacaaggattcagctttacttctgcaaatttattcttcattttaccgatatatttatgaattattgaatattcagagtagaggctcttcgttgactttccttacacaaatctcaaaacacattttggatatcataaaacaatttaatttccaaaacatcagtaaagcatttgcatttttatttaagacagcagaggttcttgggggaatttctaatgtatcttactgtcagcaattgctttcaatttttaactttttggagcttcaggcccaatccttcatgtctacagagggccaagaactggaagtgatccacactactttgacaggcctcaaacagctgctcataattgatgaagattttcgtatttctttatttcaatatatgagccaattcttcaacagttcagtagaagacctattggataataaatgcttgatttcggacaataaacacatttcttccgt

SEQ ID NO: 110035 - DNA, 17184 bp, Homo sapiens
  Payload ID: 1601
  Gene Symbol: ABCA13
  Gene Name: ATP-binding cassette, sub-family A (ABC1), member 13
  ENST ID: ENST00000435803
  CDS Start-End: 25-15201
gactgagagcagggagcagcaggcatggggcatgccgggtgccagttcaaagccctgctgtggaagaattggctctgcagactcaggaacccggtccttttccttgctgaattcttctggccttgtatcctgtttgtaattctgacagttcttcgttttcaagaacctcccagatacagagacatttgttatttgcagccccgagatctacccagctgtggtgttatcccctttgttcaaagccttctttgtaacactggatcaaggtgtaggaacttcagctatgaagggtcaatggagcatcattttcgtttgtctaggttccaaactgcagctgaccccaagaaagtcaacaacctggcctttttaaaagagatacaagacctggcagaggaaattcatggaatgatggacaaggcaaaaaacttaaaaagactttgggtagaacgatccaacactccagattcttcttatggttccagtttttttacaatggatctcaataagaccgaggaggtaatattgaaactggaaagcctccatcagcagcctcatatctgggattttctacttttactgccgagactacacacaagccatgatcatgtggaagatggcatggatgttgcagtgaaccttctccagaccattttgaattccttaatatccctagaagatttagattggcttccactcaaccaaactttttcccaggtttctgaacttgtactgaatgtgaccatttcgacactgacatttctgcagcaacatggagtagcagtcaccgagccagtttaccacctgtccatgcagaatatagtgtgggatccacagaaagtccagtatgatctcaaatcccagtttggctttgatgatcttcacacggaacagatcctgaactcttcagctgaactgaaggagattcccacagacacttccttggagaagatggtgtgttcagtcttgtctagcacatcagaggatgaagctgagaaatggggccacgttggaggctgccaccctaagtggtcagaagccaaaaactatcttgtccatgcagtcagctggctgcgagtctaccaacaggtgtttgttcagtggcaacagggtagcctgcttcagaagacactcacaggcatgggccatagtctggaggctctcaggaatcagtttgaagaagagagcaagccctggaaggtggtggaagctctgcacactgcactgctcctgctgaatgacagcttgtcagcagatggcccaaaagataatcatacatttccaaagatattacagcatctgtggaaattgcaaagcttgctgcaaaacctgccccagtggccggcactgaagagatttcttcagcttgatggagctctcagaaatgcgatagctcagaatttacattttgtccaagaagtcctcatttgcctggagacatcagctaatgattttaaatggtttgaacttaaccaattgaaactggaaaaggatgtgttcttttgggagctgaaacagatgttggcgaagaatgctgtctgcccgaatggtcgtttctctgagaaggaggtctttttgccgcctggaaactccagcatatggggtggtctccagggactgttgtgctattgtaactcctctgagacgagtgttttaaacaagctacttggttcagtagaggatgctgatcgtattttgcaagaggtcattacttggcacaaaaatatgtcagttttaatacctgaagaatatttggactggcaggaacttgagatgcagctgtcagaagcaagcctttcctgtactcggctcttcctgctgctgggagctgatccctctcctgagaatgatgtcttttctagtgactgtaagcaccagcttgtctccacagtgatatttcatacacttgaaaaaacacaatttttcctggaacaagcatattattggaaagccttcaaaaagtttatcaggaagacttgcgaagtggcccaatatgtaaatatgcaagagagtttccagaacagactattggcttttcctgaggaatctccttgttttgaagaaaacatggattggaaaatgatcagtgataattattttcaatttttgaataacttactcaagtctccaacagcttccatatccagggctttaaatttcacaaagcaccttctaatgatggaaaagaagttgcacacccttgaggatgaacaaatgaactttcttttatcatttgtggaattttttgagaaattattgttgcctaatctttttgactcctccattgttcccagtttccacagcctcccatctctcacagaggatattctgaatataagttctctgtggacaaatcatttaaaaagtttaaagagagacccatctgccactgatgctcagaaactcttggaatttggcaacgaagtgatttggaaaatgcagactctcggaagtcactggataaggaaggaaccaaaaaatcttttgagattcatagaattaatactttttgaaattaatcccaaattactagaattatgggcctatggcatttcaaaaggaaaaagagctaaattggaaaacttctttacacttttaaatttttctgttccagaaaatgagattctgagtacaagttttaacttttcccagttgttccattcagattggcctaaatcaccagctatgaacatagattttgtacgtttaagtgaggctataataactagtctccatgaatttggatttttggagcaggaacagatctcagaagctctgaacacagtctacgctatcaggaatgcatctgatcttttctcagccctttctgaaccacaaaaacaagaagttgataaaattttgactcacatacacctaaatgtcttccaggacaaggattcagctttacttctgcaaatttattcttcattttaccgatatatttatgaattattgaatattcagagtagaggctcttcgttgactttccttacacaaatctcaaaacacattttggatatcataaaacaatttaatttccaaaacatcagtaaagcatttgcatttttatttaagacagcagaggttcttgggggaatttctaatgtatcttactgtcagcaattgctttcaatttttaactttttggagcttcaggcccaatccttcatgtctacagagggccaagaactggaagtgatccacactactttgacaggcctcaaacagctgctcataattgatgaagattttcgtatttctttatttcaatatatgagccaattcttcaacagttcagtagaagacctattggataataaatgcttgatttcggacaataaacacatttcttccgtaaattattcaacaagtgaggagtcttcatttgtttttccattggcacaaattttttcaaacctctcagcaaatgtcagtgtgttcaacaagtttatgtccattcactgtaccgtttcatggcttcaaatgtggactgaaatctgggaaaccatatctcaattatttaagtttgacatgaatgttttcacatctcttcatcatggtttcactcagcttttggatgaattggaagatgatgtgaaagtctctaaaagctgccagggtatacttcccacccataatgttgctagactcatattaaatttgtttaaaaatgtaactcaagccaatgacttccataattgggaggacttcctggatctcagggattttttggtagctttaggtaatgcattagtttcagtaaaaaaacttaacttggagcaagtggagaaatcccttttcaccatggaagctgccctgcatcagttgaagacatttccattcaacgaaagtacaagcagagagtttttaaattctctgcttgaagttttcattgagtttagcagtacctcagaatatatagtcagaaatctagattcaataaatgactttctttcaaataatctcacaaattatggagaaaaatttgaaaatatcatcactgagctaagagaagcaatagtatttcttagaaatgtatcacatgatcgagatttgttttcctgtgctgatattttccaaaatgttactgagtgtattttagaagatggctttttatatgtaaatacctcacagaggatgttacgtattctagacacgttaaattccacattttcctctgagaacacaattagcagtctgaaaggatgcattgtatggttagatgtcataaaccatttgtatttgttgtctaactccagtttttcacaaggtcatcttcaaaatattttggggaatttcagagatatagaaaacaaaatgaactctatattaaaaattgtaacttgggtgttaaatataaaaaaacctctttgttcatcaaatggctcacatataaattgtgtcaatatttacttgaaagatgtaactgactttctaaatattgtacttactacagtctttgaaaaagagaagaaacctaaatttgagattttattagctcttttaaatgattccacaaagcaagtaaggatgagtatcaacaacttaacaacagactttgattttgcatctcagtccaattggagatattttactgaattaattctaagaccaatagaaatgtcagatgaaattcctaatcagtttcaaaatatttggcttcatttaataacactggggaaggaatttcagaagcttgtaaaaggtatttactttaacatcctggaaaataattcctcttctaaaactgaaaacttgttaaacatatttgccaccagtccaaaagaaaaggatgtaaacagtgtaggcaattccatttatcacttagctagttaccttgccttcagcttatctcatgacctccaaaattcaccaaaaataataatttcacctgaaataatgaaagctacaggtcttggtattcaactgataagggatgtgttcaactccttaatgcctgtagttcatcacactagtccacaaaatgcaggttatatgcaagctttgaagaaggtaacttctgtcatgcgtacccttaagaaggcagacatagaccttttagtggatcagcttgaacaagttagtgtaaacctaatggatttctttaagaatatcagtagtgtgggaactggcaatttagtggtcaatttgcttgttggcttgatggaaaaatttgcagacagctcacattcttggaatgttaatcatctgctgcagctctcacgcctgtttcctaaagatgttgtggatgctgtgatagatgtgtactatgtgcttcctcatgctgtaaggctcctgcagggagtacctggtaaaaacatcactgaaggcctcaaggatgtctacagcttcacactccttcatggcataaccatttcaaatatcaccaaggaagacttcgcaattgtgataaaaattcttttggatacaattgaattagtatcagataagccagatattatttcagaggctttagcttgttttcctgtggtttggtgctggaatcacacaaattctggatttcggcagaattcaaagatagacccctgcaatgtccatgggctcatgtcttcttccttttatggcaaagtggccagtatacttgatcatttccacctgtctccccaaggtgaagattcaccatgttcaaatgaaagctcccgaatggaaataactaggaaagtggtctgcataattcatgaattagtggactggaattctattcttctggagctctctgaagtcttccatgttaacatttctcttgtgaaaactgtgcagaaattttggcataagatattaccgtttgtcccaccttcaataaatcaaactagggatagcatctctgaactctgtcctagtggttccataaagcaagttgctttgcaaatcatagaaaaacttaaaaatgtcaactttacaaaagttacatcaggtgaaaatattcttgacaaactaagtagtttaaacaagatccttaacattaatgaagacacagagacatctgttcaaaatattatttcctcaaatttggaaaggacagtacaattgatttctgaagactggagcctagaaaaaagtacgcataatctactctctttattcatgatgctccagaatgcaaatgtcacaggtagcagtttagaagcattatcaagttttattgaaaaaagtgaaacaccttacaactttgaagaactatggcccaagtttcaacaaatcatgaaagacctaacccaagattttagaatcagacacctgctttctgaaatgaacaaaggaatcaaaagtataaattcaatggctcttcaaaagataactttgcagtttgcccatttcctggaaatcctggattcaccgtcattgaagacattagaaattattgaagattttctattggtcacaaaaaactggcttcaggaatatgcaaatgaggattactccagaatgatagaaacattattcattcctgtgaccaatgagagttcaactgaagatatagctttgttagccaaagctattgctactttttggggctctttaaaaaatatatctagagcaggcaattttgatgttgcctttcttacccatctgctaaatcaagaacagctgactaatttctcagttgttcagctgctttttgaaaacatcctaattaatttgatcaataacttagctgggaattctcaggaagcagcttggaacttaaatgatactgaccttcaaataatgaatttcattaaccttatcttgaaccatatgcagtcagaaactagtaggaaaacagttctctctctgagaagcatagtagatttcacagaacagtttttgaaaacattcttctccctttttctaaaggaagattctgagaacaaaatatctcttctgctgaaatatttccacaaagatgttattgcagagatgagttttgtcccaaaagataaaattctagaaattctgaaactggatcaatttcttaccctgatgatacaagacagattgatgaacattttttcaagtttaaaggagactatatatcacctaatgaaaagttcatttatattagacaatggagaattttattttgatactcatcaaggactgaagttcatgcaagatttatttaatgcccttctcagggaaacttcaatgaaaaataagactgaaaataatatagactttttcacagtggtgagtcagttgtttttccatgtgaataagtctgaggacctcttcaaactcaatcaagatcttgggtcagctcttcaccttgtaagagaatgttcaacagagatggcaagacttctggatacaattttacactctcctaataaggacttctatgctttgtatcctaccctccaagaagttatacttgctaatctaacggatttgcttttctttataaataattcattccctctaagaaacagagcaacattagaaattactaagagattagttggtgctatttcaagagcaagtgaagaaagtcacgtcctgaaacccctcttagaaatgtctgggactctggtcatgctgttgaatgacagtgctgacctgagagatcttgccacatcaatggactccattgtgaaacttcttaagctggtcaagaaagtttcggggaagatgtccacagtttttaaaactcattttatctccaataccaaggacagtgtgaaattctttgacactctgtattccatcatgcaacaaagtgttcaaaatcttgtgaaagaaatagctactttaaaaaaaatagatcatttcacatttgaaaagataaatgatttgttggtgccatttcttgacttggcctttgaaatgattggggtagaaccttatatatcatcaaactctgatattttcagtatgtcacctagcatactctcatatatgaaccaatctaaggacttttctgatattttggaagaaattgctgaatttttaacatctgtgaaaatgaacttggaagatatgaggagtcttgcggtagcatttaacaatgagactcaaacattttctatggattctgtcaacttacgggaagaaattctgggttgcttagttcctataaataacatcaccaaccaaatggacttcttataccctaatccaatttccactcatagtggccctcaagatataaaatgggaaataattcatgaagtgatcccttttttggataaaatattatcacaaaacagcacagaaataggatctttcttgaaaatggtgatctgtctcaccttagaagctctttggaaaaacttaaagaaagataattggaatgtttctaatgtgttgatgacatttactcagcatccaaataaccttttgaaaaccatagaaacagttttagaggcctccagtggaattaaaagtgactatgaaggtgatttgaataaaagtttatattttgacacacctttgagtcagaatataactcatcatcaacttgaaaaagcaatccataatgttttaagtagaatagctctctggaggaaaggacttctgtttaacaactctgaatggataacttccacaagaactttgtttcagccactttttgagattttcattaaagcaaccaccggaaagaatgtcacatcagaaaaagaagagagaaccaagaaagagatgattgactttccttatagtttcaaaccatttttctgtttggagaaatacctgggaggattatttgtattgactaaatactggcaacaaatcccactaacagatcaaagtgttgttgagatttgtgaagttttccagcagactgtgaagccctcagaagccatggagatgctgcagaaagtgaagatgatggtcgtacgtgtgctcaccatcgttgcagaaaacccttcctggaccaaggacattttgtgtgctactctgagttgcaagcaaaatgggataaggcatctcattttatctgctatacaaggggtcactttggcgcaggaccacttccaggaaattgaaaagatatggtcctcgccgaatcagctaaattgtgaaagtcttagcaagaatctttctagcaccttggagagcttcaagagcagcttggaaaatgccactggccaggactgcacaagccagccgaggctggagacggtgcagcagcacttgtacatgttggccaaaagcctcgaggaaacttggtcatcagggaatcccatcatgacttttctcagcaatttcacagtaactgaggatgtaaaaataaaagatttgatgaagaatatcaccaagttgactgaggagcttcgctcttccatccaaatctcgaatgagactatccatagcattctagaagcaaatatttcccactccaaggttctcttcagtgccctcaccgtagctctgtctggaaagtgtgatcaggaaatccttcatctcctgctgacatttcccaaaggggaaaaatcttggatcgcagcggaggaactctgtagcctgccagggtcaaaagtgtattctctgattgtgttgctgagtcgaaacttggatgtgcgagctttcatttacaagactctgatgccttctgaagcaaatggcttgctcaactccttgctggatatagtttccagcctcagcgccttgcttgccaaagcccagcacgtctttgagtatcttcctgagtttcttcacacatttaaaatcactgccttgctagaaaccctggactttcaacaggtttcacaaaatgtccaggccagaagttcagcttttggttctttccagtttgtgatgaagatggtttgcaaggaccaagcatcattccttagcgattctaatatgtttattaatttgcccagagttaaggaactcttggaagatgacaaagaaaaattcaacattcctgaagattcaacaccgttttgcttgaagctttatcaggaaattctacaattgccaaatggtgctttggtgtggaccttcctaaaacccatattgcatggaaaaatactatacacaccaaacactccagaaattaacaaggtcattcaaaaggctaattacaccttttatattgtggacaaactaaaaactttatcagaaacactgctggaaatgtccagccttttccagagaagtggaagtggccagatgttcaaccagctgcaggaggccctgagaaacaaatttgtaagaaactttgtagaaaaccagttgcacattgatgtagacaaacttactgaaaaactccagacatacggagggctgctggatgagatgtttaaccatgcaggcgctggacgcttccgtttcttgggcagcatcttggtcaatctctcttcctgcgtggcactgaaccgtttccaggctctgcagtctgtcgacatcctggagactaaagcacatgaactcttgcagcagaacagcttcttggccagtatcattttcagcaattccttattcgacaagaacttcagatcagagtctgtcaaactgccaccccatgtctcatacacaatccggaccaatgtgttatacagcgtgcgaacagatgtggtaaaaaacccttcttggaagttccaccctcagaatctaccagctgatgggttcaaatataactacgtctttgccccactgcaagacatgatcgaaagagccatcattttggtgcagactgggcaggaagccctggaaccagcagcacagactcaggcggccccttacccctgccataccagcgacctattcctgaacaacgttggtttcttttttccactgataatgatgctgacgtggatggtgtctgtggccagcatggtcagaaagttggtgtatgagcaggagatacagatagaagagtatatgcggatgatgggagtgcatccagtgatccatttcctggcctggttcctggagaacatggctgtgttgaccataagcagtgctactctggccatcgttctgaaaacaagtggcatctttgcacacagcaatacctttattgttttcctctttctcttggattttgggatgtcagtcgtcatgctgagctacctcttgagtgcatttttcagccaagctaatacagcggccctttgtaccagcctggtgtacatgatcagctttctgccctacatagttctattggttctacataaccaattaagttttgttaatcagacatttctgtgccttctttcgacaaccgcctttggacaaggggtattttttattacattcctggaaggacaagagacagggattcaatggaataatatgtaccaggctctggaacaagggggcatgacatttggctgggtttgctggatgattctttttgattcaagcctttattttttgtgtggatggtacttgagcaacttgattcctggaacatttggtttacggaaaccatggtatttcccctttactgcctcatattggaagagtgtgggtttcttggtggagaaaaggcaatactttctaagttctagtctgttcttcttcaatgagaactttgacaataaagggtcatcactgcaaaacagggaaggagagcttgaaggaagtgccccgggagtcaccctggtgtctgtgaccaaggaatatgagggccacaaggctgtggtccaagacctcagcctgaccttctacagagaccaaatcaccgccctgctggggacaaacggtgccgggaaaaccactatcatatccatgttgacggggctccaccctcccacttctggaaccatcatcatcaatggcaagaacctacagacagacctgtcgagggtcagaatggagcttggtgtgtgtccgcagcaggacatcctgttggacaacctcaccgtccgggaacatttgctgctctttgcttccataaaggcgcctcagtggaccaagaaggagctgcatcagcaagtcaatcaaactcttcaggatgtggacttaactcagcatcagcacaaacagacccgagctctgtctggaggcctgaagaggaagctctcccttggcattgctttcatgggcatgtcgaggaccgtggttctggatgagcccaccagtggggtggacccttgctcccggcatagcctgtgggacattctgctcaagtaccgagaaggtcgtacgatcatcttcacaacccaccacctggatgaagctgaagcgctgagtgaccgcgtggccgtcctccagcatgggaggctcaggtgctgcggtcctcccttctgcctgaaggaggcatatggccaggggctccgcctgacactcacgaggcagccttctgttctggaggcccatgatctgaaagacatggcttgtgttacatccctgataaagatctatattccacaagcatttctcaaagacagcagtggaagtgagctgacctacaccattccaaaggacacagacaaggcctgcttgaaagggctcttccaggccctggatgagaacctgcatcagctgcacctgacgggctatgggatctcagacaccaccttagaagaggtgtttttgatgcttttgcaagattccaacaagaaatctcacattgccctggggactgagtcagagctgcagaaccacaggcctacaggacatctgtctggctactgtggctccctagcacggcccgcaactgtgcagggcgtccagctgctccgcgcacaagtggccgcgatcctggcccggaggctccgccgcacgctgcgcgccgggaagagcaccctcgccgacctgctgctgccagtcctcttcgtggccttggccatgggcttgttcatggtgagacccctggccaccgagtaccctcccctcagactcacacctggacattaccagcgggccgagacctactttttcagcagtgggggcgacaacttggacctcacccgtgtgcttctgcggaagtttagagatcaagatttgccctgtgcagatttaaacccacgccagaagaattcttcatgctggcgcacagatcccttttctcacccagaattccaggattcatgtggctgcctgaagtgtccaaatagaagtgctagtgctccctacctgaccaaccacctgggccacacactgttgaatctctcaggcttcaatatggaggagtacttgctggcaccatctgaaaaaccaaggcttggaggttggtcttttggattaaaaatccccagtgaagctggaggtgcaaatggaaacatatcaaaacccccaactctggcaaaggtgtggtataatcagaagggttttcattccctaccttcctacttaaatcatctaaacaaccttattttgtggcagcacctaccccctactgtggactggagacaatacggaataacactctacagccacccatatggaggggccttgctgaacgaggacaagatcctggagagcatccgtcagtgtggagtggccctctgcatcgtgctgggattctccatcctgtctgcatccatcggcagctctgtggtgagggacagggtgattggagccaaaaggttgcagcacataagtggccttggctacaggatgtactggttcacaaacttcctatatgacatgctcttttacttggtttccgtctgcctgtgtgttgccgttattgtcgccttccagttaacagcttttactttccgcaagaacttggcagccacggccctcctgctgtcacttttcggatatgcaactcttccatggatgtacctgatgtccagaatcttttccagttcggacgtggctttcatttcctatgtctcactaaacttcatctttggcctttgtaccatgctcataaccattatgccccggttgctagccatcatctccaaagctaagaatttacagaatatctatgatgtcctcaagtgggtctttactatttttcctcaattctgtcttggtcaaggactggtagaactctgctataatcagatcaaatatgacctgacccacaacttcggcattgattcctatgtgagtccctttgagatgaactttctgggctggatcttcgtgcaactggcctcgcagggcacagtacttctcctcttgagggttctgctacactgggaccttctgcgatggccaaggggtcattctactctccaaggcacagtcaaatcttctaaggatacagatgttgaaaaagaggaaaagagagtgtttgaaggaaggaccaatggagacattcttgtgttatacaaccttagtaaacattatcgacgctttttccagaatattattgctgtgcaagatattagtttgggcataccaaaaggagagtgctttggacttctaggggtgaatggagctgggaagagcacgactttcaaaatgctgaatggtgaagtttctctaacttcaggacatgctatcatcaggactcccatgggagacgccgtggacctgtcttctgctggcacggcaggcgtgctcattggctactgtccccagcaggatgccctggacgagcttctgactggttgggaacatctctattattactgtagcttacgcgggattccaaggcagtgcatccctgaggttgctggagacctcatcaggcgcttacacctcgaagcccacgcggacaaacctgtggccacctacagtgggggaaccaagcggaaactctctacagccctggccctggtggggaaacctgacattcttttattggatgagcccagctctgggatggatccctgctctaagcggtacctgtggcaaacaataatgaaggaggttcgggaaggctgtgctgcggtgctgacctcccacagcatggaggagtgtgaggctctttgcacaagactggccataatggttaacggcagcttcaaatgtcttggttctcctcagcacatcaaaaataggtttggtgatggttatacagtcaaagtttggctctgtaaggaagcaaatcaacattgcactgtttctgaccacttgaagctttattttccaggaattcagttcaagggacagcacctgaatttattagaatatcatgtgccaaaaagatggggatgcctagctgacttgttcaaagttatagagaacaataaaaccttcttgaatattaagcattattccattaaccaaaccactttggagcaggtatttattaattttgcttctgagcagcagcaaactctacaatctactcttgatccatccactgacagtcaccacacacatcacttgcccatctgagcactaaagaagtttccataaggaataaaaccttgtcttccattacaattaacagtcaaggataaaacaagcacgcgcacaatcaaggagctggaacacactctccaggccgtcaaattattctcttgttcattttctattttgaatctccttgttagttaataaccaccaaatggaaaggtcattctttctgcagacttttggggagctcctccaaaacatttgttctctttaccatgccagatggacaccagcttctttgtgacaaaggcatgaatgatttgacagtgtccaaactgagacattctggagctggaaagcctgtcacactagagtgtgtgtgacatgtccactctaaacatgtcacttttctgttaagaaaactgagccccctccccacaggttaaaaaactttagtaacttgtttgtatagaaaatagtaacaaggactattttctattgttgtcatctatttactagatacatgtttttaatgattttaatgtaagcttttattaatactgatgacattatatggtatgatatgaaaaaatcaccaattttttacatataaaagatacctttttaaaaaaataggttttaagagctcttttagtatacactttagcaaaattaattaaattgaactagttactctgtatcaattacagtagttctaccagaatctcccaggttataatttatgagggtagagaaataaaatgtagatgcattttctttttcttcatttggatgaataattactgttttttgttattctaagtcagtgtttttcaaagcgtagtggtccccatattagctgcattgccatcttctgggagcttgcaagaaatgtacattctcaggatccactccagacctattgaatctcaaattctggggcttaaacaagcacattccaagttaagaaccaatgacctaagggaatgtctggttacctcctagttatacaagcaaaatctgcatagtatgtagtcttttttatttatttattttttttttttgaggcggagtctcgctctgtcacccaggctggagtgcagtggcgcgatgtcggctcactgcaagctccgcctcctgggttcacgccattctcctgcctcagcctccccagcagctgggactacaggcacacatcgccacacccggctaatttttagtatttttagtagagacggggtttcaccgtgttagccaggatggtctctatctcctgaccttgtgatccgcccccctccacctcccaaagtgctgggattacaggcgtgagccaccgtgtccggccgtagtttattttaaaatatatttttaaaagctttgtaaaaattatgtcattctcagaattgttgtcttcaaagcattgtcagatgtagagtgctcagatgtggctcttaaagactatatacatctgaatttttcatcctatagttagtaagatgcataaaatcaatccactactgaaatagtttccagtcagacatttctgagttcagacatttctcaacattcttttaacaacatttttctgaatcctcaatagaaaatcacattaatcttattttaaaatttggcctttttcaacactaacgttgagtaccggtagcttgtgatcaaaggcatatacttccttatgagatttctttactaaagcaagatttcattaaatctctatttcctaaatatcattctatacaaaagatattttttaaacggtaaggattaagacaatcactgatagctttgttgtgagcaattttgattcccatgtatcacatgaattacacttccttaaataaattacagtttatggctgtatgatttattctctaattctaacatagtctagttgtcaaaaggaaatatgtaatctttttatgattgttgaatcaataaataccaatttgtgaaacatgaatgtgtttaaactgcagtgaataaatgagatgtgctttaatttaaccc

SEQ ID NO: 110036 - DNA, 7870 bp, Homo sapiens
  Payload ID: 1601
  Gene Symbol: ABCA13
  Gene Name: ATP-binding cassette, sub-family A (ABC1), member 13
  ENST ID: ENST00000544596
  CDS Start-End: 1-7099
ataccctaatccaatttccactcatagtggccctcaagatataaaatgggaaataattcatgaagtgatcccttttttggataaaatattatcacaaaacagcacagaaataggatctttcttgaaaatggtgatctgtctcaccttagaagctctttggaaaaacttaaagaaagataattggaatgtttctaatgtgttgatgacatttactcagcatccaaataaccttttgaaaaccatagaaacagttttagaggcctccagtggaattaaaagtgactatgaaggtgatttgaataaaagtttatattttgacacacctttgagtcagaatataactcatcatcaacttgaaaaagcaatccataatgttttaagtagaatagctctctggaggaaaggacttctgtttaacaactctgaatggataacttccacaagaactttgtttcagccactttttgagattttcattaaagcaaccaccggaaagaatgtcacatcagaaaaagaagagagaaccaagaaagagatgattgactttccttatagtttcaaaccatttttctgtttggagaaatacctgggaggattatttgtattgactaaatactggcaacaaatcccactaacagatcaaagtgttgttgagatttgtgaagttttccagcagactgtgaagccctcagaagccatggagatgctgcagaaagtgaagatgatggtcgtacgtgtgctcaccatcgttgcagaaaacccttcctggaccaaggacattttgtgtgctactctgagttgcaagcaaaatgggataaggcatctcattttatctgctatacaaggggtcactttggcgcaggaccacttccaggaaattgaaaagatatggtcctcgccgaatcagctaaattgtgaaagtcttagcaagaatctttctagcaccttggagagcttcaagagcagcttggaaaatgccactggccaggactgcacaagccagccgaggctggagacggtgcagcagcacttgtacatgttggccaaaagcctcgaggaaacttggtcatcagggaatcccatcatgacttttctcagcaatttcacagtaactgaggatgtaaaaataaaagatttgatgaagaatatcaccaagttgactgaggagcttcgctcttccatccaaatctcgaatgagactatccatagcattctagaagcaaatatttcccactccaaggttctcttcagtgccctcaccgtagctctgtctggaaagtgtgatcaggaaatccttcatctcctgctgacatttcccaaaggggaaaaatcttggatcgcagcggaggaactctgtagcctgccagggtcaaaagtgtattctctgattgtgttgctgagtcgaaacttggatgtgcgagctttcatttacaagactctgatgccttctgaagcaaatggcttgctcaactccttgctggatatagtttccagcctcagcgccttgcttgccaaagcccagcacgtctttgagtatcttcctgagtttcttcacacatttaaaatcactgccttgctagaaaccctggactttcaacaggtttcacaaaatgtccaggccagaagttcagcttttggttctttccagtttgtgatgaagatggtttgcaaggaccaagcatcattccttagcgattctaatatgtttattaatttgcccagagttaaggaactcttggaagatgacaaagaaaaattcaacattcctgaagattcaacaccgttttgcttgaagctttatcaggaaattctacaattgccaaatggtgctttggtgtggaccttcctaaaacccatattgcatggaaaaatactatacacaccaaacactccagaaattaacaaggtcattcaaaaggctaattacaccttttatattgtggacaaactaaaaactttatcagaaacactgctggaaatgtccagccttttccagagaagtggaagtggccagatgttcaaccagctgcaggaggccctgagaaacaaatttgtaagaaactttgtagaaaaccagttgcacattgatgtagacaaacttactgaaaaactccagacatacggagggctgctggatgagatgtttaaccatgcaggcgctggacgcttccgtttcttgggcagcatcttggtcaatctctcttcctgcgtggcactgaaccgtttccaggctctgcagtctgtcgacatcctggagactaaagcacatgaactcttgcagcagaacagcttcttggccagtatcattttcagcaattccttattcgacaagaacttcagatcagagtctgtcaaactgccaccccatgtctcatacacaatccggaccaatgtgttatacagcgtgcgaacagatgtggtaaaaaacccttcttggaagttccaccctcagaatctaccagctgatgggttcaaatataactacgtctttgccccactgcaagacatgatcgaaagagccatcattttggtgcagactgggcaggaagccctggaaccagcagcacagactcaggcggccccttacccctgccataccagcgacctattcctgaacaacgttggtttcttttttccactgataatgatgctgacgtggatggtgtctgtggccagcatggtcagaaagttggtgtatgagcaggagatacagatagaagagtatatgcggatgatgggagtgcatccagtgatccatttcctggcctggttcctggagaacatggctgtgttgaccataagcagtgctactctggccatcgttctgaaaacaagtggcatctttgcacacagcaatacctttattgttttcctctttctcttggattttgggatgtcagtcgtcatgctgagctacctcttgagtgcatttttcagccaagctaatacagcggccctttgtaccagcctggtgtacatgatcagctttctgccctacatagttctattggttctacataaccaattaagttttgttaatcagacatttctgtgccttctttcgacaaccgcctttggacaaggggtattttttattacattcctggaaggacaagagacagggattcaatggaataatatgtaccaggctctggaacaagggggcatgacatttggctgggtttgctggatgattctttttgattcaagcctttattttttgtgtggatggtacttgagcaacttgattcctggaacatttggtttacggaaaccatggtatttcccctttactgcctcatattggaagagtgtgggtttcttggtggagaaaaggcaatactttctaagttctagtctgttcttcttcaatgagaactttgacaataaagggtcatcactgcaaaacagggaaggagagcttgaaggaagtgccccgggagtcaccctggtgtctgtgaccaaggaatatgagggccacaaggctgtggtccaagacctcagcctgaccttctacagagaccaaatcaccgccctgctggggacaaacggtgccgggaaaaccactatcatatccatgttgacggggctccaccctcccacttctggaaccatcatcatcaatggcaagaacctacagacagacctgtcgagggtcagaatggagcttggtgtgtgtccgcagcaggacatcctgttggacaacctcaccgtccgggaacatttgctgctctttgcttccataaaggcgcctcagtggaccaagaaggagctgcatcagcaagtcaatcaaactcttcaggatgtggacttaactcagcatcagcacaaacagacccgagctctgtctggaggcctgaagaggaagctctcccttggcattgctttcatgggcatgtcgaggaccgtggttctggatgagcccaccagtggggtggacccttgctcccggcatagcctgtgggacattctgctcaagtaccgagaaggtcgtacgatcatcttcacaacccaccacctggatgaagctgaagcgctgagtgaccgcgtggccgtcctccagcatgggaggctcaggtgctgcggtcctcccttctgcctgaaggaggcatatggccaggggctccgcctgacactcacgaggcagccttctgttctggaggcccatgatctgaaagacatggcttgtgttacatccctgataaagatctatattccacaagcatttctcaaagacagcagtggaagtgagctgacctacaccattccaaaggacacagacaaggcctgcttgaaagggctcttccaggccctggatgagaacctgcatcagctgcacctgacgggctatgggatctcagacaccaccttagaagaggtgtttttgatgcttttgcaagattccaacaagaaatctcacattgccctggggactgagtcagagctgcagaaccacaggcctacaggacatctgtctggctactgtggctccctagcacggcccgcaactgtgcagggcgtccagctgctccgcgcacaagtggccgcgatcctggcccggaggctccgccgcacgctgcgcgccgggaagagcaccctcgccgacctgctgctgccagtcctcttcgtggccttggccatgggcttgttcatggtgagacccctggccaccgagtaccctcccctcagactcacacctggacattaccagcgggccgagacctactttttcagcagcagtgggggcgacaacttggacctcacccgtgtgcttctgcggaagtttagagatcaagatttgccctgtgcagatttaaacccacgccagaagaattcttcatgctggcgcacagatcccttttctcacccagaattccaggattcatgtggctgcctgaagtgtccaaatagaagtgctagtgctccctacctgaccaaccacctgggccacacactgttgaatctctcaggcttcaatatggaggagtacttgctggcaccatctgaaaaaccaaggcttggaggttggtcttttggattaaaaatccccagtgaagctggaggtgcaaatggaaacatatcaaaacccccaactctggcaaaggtgtggtataatcagaagggttttcattccctaccttcctacttaaatcatctaaacaaccttattttgtggcagcacctaccccctactgtggactggagacaatacggaataacactctacagccacccatatggaggggccttgctgaacgaggacaagatcctggagagcatccgtcagtgtggagtggccctctgcatcgtgctgggattctccatcctgtctgcatccatcggcagctctgtggtgagggacagggtgattggagccaaaaggttgcagcacataagtggccttggctacaggatgtactggttcacaaacttcctatatgacatgctcttttacttggtttccgtctgcctgtgtgttgccgttattgtcgccttccagttaacagcttttactttccgcaagaacttggcagccacggccctcctgctgtcacttttcggatatgcaactcttccatggatgtacctgatgtccagaatcttttccagttcggacgtggctttcatttcctatgtctcactaaacttcatctttggcctttgtaccatgctcataaccattatgccccggttgctagccatcatctccaaagctaagaatttacagaatatctatgatgtcctcaagtgggtctttactatttttcctcaattctgtcttggtcaaggactggtagaactctgctataatcagatcaaatatgacctgacccacaacttcggcattgattcctatgtgagtccctttgagatgaactttctgggctggatcttcgtgcaactggcctcgcagggcacagtacttctcctcttgagggttctgctacactgggaccttctgcgatggccaaggggtcattctactctccaaggcacagtcaaatcttctaaggatacagatgttgaaaaagaggaaaagagagtgtttgaaggaaggaccaatggagacattcttgtgttatacaaccttagtaaacattatcgacgctttttccagaatattattgctgtgcaagatattagtttgggcataccaaaaggagagtgctttggacttctaggggtgaatggagctgggaagagcacgactttcaaaatgctgaatggtgaagtttctctaacttcaggacatgctatcatcaggactcccatgggagacgccgtggacctgtcttctgctggcacggcaggcgtgctcattggctactgtccccagcaggatgccctggacgagcttctgactggttgggaacatctctattattactgtagcttacgcgggattccaaggcagtgcatccctgaggttgctggagacctcatcaggcgcttacacctcgaagcccacgcggacaaacctgtggccacctacagtgggggaaccaagcggaaactctctacagccctggccctggtggggaaacctgacattcttttattggatgagcccagctctgggatggatccctgctctaagcggtacctgtggcaaacaataatgaaggaggttcgggaaggctgtgctgcggtgctgacctcccacagcatggaggagtgtgaggctctttgcacaagactggccataatggttaacggcagcttcaaatgtcttggttctcctcagcacatcaaaaataggtttggtgatggttatacagtcaaagtttggctctgtaaggaagcaaatcaacattgcactgtttctgaccacttgaagctttattttccaggaattcagttcaagggacagcacctgaatttattagaatatcatgtgccaaaaagatggggatgcctagctgacttgttcaaagttatagagaacaataaaaccttcttgaatattaagcattattccattaaccaaaccactttggagcaggtatttattaattttgcttctgagcagcagcaaactctacaatctactcttgatccatccactgacagtcaccacacacatcacttgcccatctgagcactaaagaagtttccataaggaataaaaccttgtcttccattacaattaacagtcaaggataaaacaagcacgcgcacaatcaaggagctggaacacactctccaggccgtcaaattattctcttgttcattttctattttgaatctccttgttagttaataaccaccaaatggaaaggtcattctttctgcagacttttggggagctcctccaaaacatttgttctctttaccatgccagatggacaccagcttctttgtgacaaaggcatgaatgatttgacagtgtccaaactgagacattctggagctggaaagcctgtcacactagagtgtgtgtgacatgtccactctaaacatgtcacttttctgttaagaaaactgagccccctccccacaggttaaaaaactttagtaacttgtttgtatagaaaatagtaacaaggactattttctattgttgtcatctatttactagatacatgtttttaatgattttaatgtaagcttttattaatactgatgacattatatggtatgatatgaaaaaatcaccaattttttacatataaaagatacctttttaaaaaaataggttttaagagctcttttagtatacactttagcaaaattaattaaattgaactagttactctgtatcaattacagtagttctaccagaatctcccaggttataatttatgagggtagagaaataaaatgtagatgcattttctttttcttcatttggatgaataattactgtttt

SEQ ID NO: 110037 - DNA, 8154 bp, Homo sapiens
  Payload ID: 1602
  Gene Symbol: ABCA2
  Gene Name: ATP-binding cassette, sub-family A (ABC1), member 2
  ENST ID: ENST00000265662
  CDS Start-End: 149-7459
ggggcggagccagcgcggatcgggtcccggacgcccgagcgccccgcccccgcgcgggcgatgcccagcggcgcggcgggctgcggggcccggcggggcgcgcagaggagcgggccgcggcgctgaggcggcggagcgtggccccgccatgggcttcctgcaccagctgcagctgctgctctggaagaacgtgacgctcaaacgccggagcccgtgggtcctggccttcgagatcttcatccccctggtgctgttctttatcctgctggggctgcgacagaagaagcccaccatctccgtgaaggaagtcgccttctacacagcggcgcccctgacgtctgccggcatcctgcctgtcatgcaatcgctgtgcccggacggccagcgagacgagttcggcttcctgcagtacgccaactccacggtcacgcagctgcttgagcgcctggaccgcgtggtggaggaaggcaacctgtttgacccagcgcggcccagcctgggctcagagctcgaggccctacgccagcatctggaggccctcagtgcgggcccgggcacctcggggagccacctggacagatccacagtgtcttccttctctctggactcggtggccagaaacccgcaggagctctggcgtttcctgacgcaaaacttgtcgctgcccaatagcacggcccaagcactcttggccgcccgtgtggacccgcccgaggtctaccacctgctctttggtccctcatctgccctggattcacagtctggcctccacaagggtcaggagccctggagccgcctagggggcaatcccctgttccggatggaggagctgctgctggctcctgccctcctggagcagctcacctgcacgccgggctcgggggagctgggccggatcctcactgtgcctgagagtcagaagggagccctgcagggctaccgggatgctgtctgcagtgggcaggctgctgcgcgtgccaggcgcttctctgggctgtctgctgagctccggaaccagctggacgtggccaaggtctcccagcagctgggcctggatgcccccaacggctcggactcctcgccacaggcgccacccccacggaggctgcaggcgcttctgggggacctgctggatgcccagaaggttctgcaggatgtggatgtcctgtcggccctggccctgctactgccccagggtgcctgcactggccggacccccggacccccagccagtggtgcgggtggggcggccaatggcactggggcaggggcagtcatgggccccaacgccaccgctgaggagggcgcaccctctgctgcagcactggccaccccggacacgctgcagggccagtgctcagccttcgtacagctctgggccggcctgcagcccatcttgtgtggcaacaaccgcaccattgaacccgaggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggccaacgagacttttgcttttgtgggcaacgtgactcactatgcccaggtctggctcaacatctcggcggagatccgcagcttcctggagcagggcaggctgcagcaacacctgcgctggctgcagcagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcgtggacatcttcaagggcttccccgacgaggagagcattgtcaactacaccctcaaccaggcctaccaggacaacgtcactgtttttgccagtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccaggacatgatggagcgcgccatcatcgacacttttgtggggcacgatgtggtggagccaggcagctacgtgcagatgttcccctacccctgctacacacgcgatgacttcctgtttgtcattgagcacatgatgccgctgtgcatggtgatctcctgggtctactccgtggccatgaccatccagcacatcgtggcggagaaggagcaccggctcaaggaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcacctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatccttgacctcatcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgtggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcctgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaacaaaatgtc

SEQ ID NO: 110038 - DNA, 8063 bp, Homo sapiens
  Payload ID: 1602
  Gene Symbol: ABCA2
  Gene Name: ATP-binding cassette, sub-family A (ABC1), member 2
  Uniprot ID: Q9BZC7
  ENST ID: ENST00000341511
  CDS Start-End: 51-7361
cgcgcagaggagcgggccgcggcgctgaggcggcggagcgtggccccgccatgggcttcctgcaccagctgcagctgctgctctggaagaacgtgacgctcaaacgccggagcccgtgggtcctggccttcgagatcttcatccccctggtgctgttctttatcctgctggggctgcgacagaagaagcccaccatctccgtgaaggaagtctccttctacacagcggcgcccctgacgtctgccggcatcctgcctgtcatgcaatcgctgtgcccggacggccagcgagacgagttcggcttcctgcagtacgccaactccacggtcacgcagctgcttgagcgcctggaccgcgtggtggaggaaggcaacctgtttgacccagcgcggcccagcctgggctcagagctcgaggccctacgccagcatctggaggccctcagtgcgggcccgggcacctcggggagccacctggacagatccacagtgtcttccttctctctggactcggtggccagaaacccgcaggagctctggcgtttcctgacgcaaaacttgtcgctgcccaatagcacggcccaagcactcttggccgcccgtgtggacccgcccgaggtctaccacctgctctttggtccctcatctgccctggattcacagtctggcctccacaagggtcaggagccctggagccgcctagggggcaatcccctgttccggatggaggagctgctgctggctcctgccctcctggagcagctcacctgcacgccgggctcgggggagctgggccggatcctcactgtgcctgagagtcagaagggagccctgcagggctaccgggatgctgtctgcagtgggcaggctgctgcgcgtgccaggcgcttctctgggctgtctgctgagctccggaaccagctggacgtggccaaggtctcccagcagctgggcctggatgcccccaacggctcggactcctcgccacaggcgccacccccacggaggctgcaggcgcttctgggggacctgctggatgcccagaaggttctgcaggatgtggatgtcctgtcggccctggccctgctactgccccagggtgcctgcactggccggacccccggacccccagccagtggtgcgggtggggcggccaatggcactggggcaggggcagtcatgggccccaacgccaccgctgaggagggcgcaccctctgctgcagcactggccaccccggacacgctgcagggccagtgctcagccttcgtacagctctgggccggcctgcagcccatcttgtgtggcaacaaccgcaccattgaacccgaggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggccaacgagacttttgcttttgtgggcaacgtgactcactatgcccaggtctggctcaacatctcggcggagatccgcagcttcctggagcagggcaggctgcagcaacacctgcgctggctgcagcagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcgtggacatcttcaagggcttccccgacgaggagagcattgtcaactacaccctcaaccaggcctaccaggacaacgtcactgtttttgccagtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccaggacatgatggagcgcgccatcatcgacacttttgtggggcacgatgtggtggagccaggcagctacgtgcagatgttcccctacccctgctacacacgcgatgacttcctgtttgtcattgagcacatgatgccgctgtgcatggtgatctcctgggtctactccgtggccatgaccatccagcacatcgtggcggagaaggagcaccggctcaaggaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcacctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatccttgacctcatcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgtggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcctgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaacaaaatgtctgcgggt

SEQ ID NO: 110039 - DNA, 8151 bp, Homo sapiens
  Payload ID: 1602
  Gene Symbol: ABCA2
  Gene Name: ATP-binding cassette, sub-family A (ABC1), member 2
  Uniprot ID: Q9BZC7
  ENST ID: ENST00000371605
  CDS Start-End: 149-7456
ggggcggagccagcgcggatcgggtcccggacgcccgagcgccccgcccccgcgcgggcgatgcccagcggcgcggcgggctgcggggcccggcggggcgcgcagaggagcgggccgcggcgctgaggcggcggagcgtggccccgccatgggcttcctgcaccagctgcagctgctgctctggaagaacgtgacgctcaaacgccggagcccgtgggtcctggccttcgagatcttcatccccctggtgctgttctttatcctgctggggctgcgacagaagaagcccaccatctccgtgaaggaagccttctacacagcggcgcccctgacgtctgccggcatcctgcctgtcatgcaatcgctgtgcccggacggccagcgagacgagttcggcttcctgcagtacgccaactccacggtcacgcagctgcttgagcgcctggaccgcgtggtggaggaaggcaacctgtttgacccagcgcggcccagcctgggctcagagctcgaggccctacgccagcatctggaggccctcagtgcgggcccgggcacctcggggagccacctggacagatccacagtgtcttccttctctctggactcggtggccagaaacccgcaggagctctggcgtttcctgacgcaaaacttgtcgctgcccaatagcacggcccaagcactcttggccgcccgtgtggacccgcccgaggtctaccacctgctctttggtccctcatctgccctggattcacagtctggcctccacaagggtcaggagccctggagccgcctagggggcaatcccctgttccggatggaggagctgctgctggctcctgccctcctggagcagctcacctgcacgccgggctcgggggagctgggccggatcctcactgtgcctgagagtcagaagggagccctgcagggctaccgggatgctgtctgcagtgggcaggctgctgcgcgtgccaggcgcttctctgggctgtctgctgagctccggaaccagctggacgtggccaaggtctcccagcagctgggcctggatgcccccaacggctcggactcctcgccacaggcgccacccccacggaggctgcaggcgcttctgggggacctgctggatgcccagaaggttctgcaggatgtggatgtcctgtcggccctggccctgctactgccccagggtgcctgcactggccggacccccggacccccagccagtggtgcgggtggggcggccaatggcactggggcaggggcagtcatgggccccaacgccaccgctgaggagggcgcaccctctgctgcagcactggccaccccggacacgctgcagggccagtgctcagccttcgtacagctctgggccggcctgcagcccatcttgtgtggcaacaaccgcaccattgaacccgaggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggccaacgagacttttgcttttgtgggcaacgtgactcactatgcccaggtctggctcaacatctcggcggagatccgcagcttcctggagcagggcaggctgcagcaacacctgcgctggctgcagcagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcgtggacatcttcaagggcttccccgacgaggagagcattgtcaactacaccctcaaccaggcctaccaggacaacgtcactgtttttgccagtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccaggacatgatggagcgcgccatcatcgacacttttgtggggcacgatgtggtggagccaggcagctacgtgcagatgttcccctacccctgctacacacgcgatgacttcctgtttgtcattgagcacatgatgccgctgtgcatggtgatctcctgggtctactccgtggccatgaccatccagcacatcgtggcggagaaggagcaccggctcaaggaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcacctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatccttgacctcatcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgtggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcctgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaacaaaatgtc

SEQ ID NO: 110040 - DNA, 8031 bp, Homo sapiens
  Payload ID: 1602
  Gene Symbol: ABCA2
  Gene Name: ATP-binding cassette, sub-family A (ABC1), member 2
  ENST ID: ENST00000487109
  CDS Start-End: 44-3013
cctgatcccgaactccctgtgcagagaccagactcgcccgaatatggggagaaaaacgagccgcgtgcagcaggggccgcctcggtcccctgcctgctccgctcacggcgagcgttcctggggcctcgagtttccccccttccgctggctgctcggaatcgcgggacggacccacctggccgccctgcctcccttccagtgggtcctggccttcgagatcttcatccccctggtgctgttctttatcctgctggggctgcgacagaagaagcccaccatctccgtgaaggaagccttctacacagcggcgcccctgacgtctgccggcatcctgcctgtcatgcaatcgctgtgcccggacggccagcgagacgagttcggcttcctgcagtacgccaactccacggtcacgcagctgcttgagcgcctggaccgcgtggtggaggaaggcaacctgtttgacccagcgcggcccagcctgggctcagagctcgaggccctacgccagcatctggaggccctcagtgcgggcccgggcacctcggggagccacctggacagatccacagtgtcttccttctctctggactcggtggccagaaacccgcaggagctctggcgtttcctgacgcaaaacttgtcgctgcccaatagcacggcccaagcactcttggccgcccgtgtggacccgcccgaggtctaccacctgctctttggtccctcatctgccctggattcacagtctggcctccacaagggtcaggagccctggagccgcctagggggcaatcccctgttccggatggaggagctgctgctggctcctgccctcctggagcagctcacctgcacgccgggctcgggggagctgggccggatcctcactgtgcctgagagtcagaagggagccctgcagggctaccgggatgctgtctgcagtgggcaggctgctgcgcgtgccaggcgcttctctgggctgtctgctgagctccggaaccagctggacgtggccaaggtctcccagcagctgggcctggatgcccccaacggctcggactcctcgccacaggcgccacccccacggaggctgcaggcgcttctgggggacctgctggatgcccagaaggttctgcaggatgtggatgtcctgtcggccctggccctgctactgccccagggtgcctgcactggccggacccccggacccccagccagtggtgcgggtggggcggccaatggcactggggcaggggcagtcatgggccccaacgccaccgctgaggagggcgcaccctctgctgcagcactggccaccccggacacgctgcagggccagtgctcagccttcgtacagctctgggccggcctgcagcccatcttgtgtggcaacaaccgcaccattgaacccgaggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggccaacgagacttttgcttttgtgggcaacgtgactcactatgcccaggtctggctcaacatctcggcggagatccgcagcttcctggagcagggcaggctgcagcaacacctgcgctggctgcagcagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcgtggacatcttcaagggcttccccgacgaggagagcattgtcaactacaccctcaaccaggcctaccaggacaacgtcactgtttttgccagtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccaggacatgatggagcgcgccatcatcgacacttttgtggggcacgatgtggtggagccaggcagctacgtgcagatgttcccctacccctgctacacacgcgatgacttcctgtttgtcattgagcacatgatgccgctgtgcatggtgatctcctgggtctactccgtggccatgaccatccagcacatcgtggcggagaaggagcaccggctcaaggaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcacctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtaagcggaagcggaggggggagcggcctcaggtgggaccggggctgcctggtgaccactgcccgccacctgcccgcaggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatccttgacctcatcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgtggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcctgcgggaagccatcagcttgggccagctggcaggtggcaggaatggagaagctgaccctgctg

SEQ ID NO: 110041 - DNA, 3327 bp, Homo sapiens
  Payload ID: 1602
  Gene Symbol: ABCA2
  Gene Name: ATP-binding cassette, sub-family A (ABC1), member 2
  ENST ID: ENST00000488535
  CDS Start-End: 1-3201
ttctacttcctctacggcttcgtctggatccaggacatgatggagcgcgccatcatcgacacttttgtggggcacgatgtggtggagccaggcagctacgtgcagatgttcccctacccctgctacacacgcgatgacttcctgtttgtcattgagcacatgatgccgctgtgcatggtgatctcctgggtctactccgtggccatgaccatccagcacatcgtggcggagaaggagcaccggctcaaggaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccgcctcactgcctgcctagcctcaccgcccctcccacctgcctgcccaggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcc

SEQ ID NO: 110042 - DNA, 6295 bp, Homo sapiens
  Payload ID: 1602
  Gene Symbol: ABCA2
  Gene Name: ATP-binding cassette, sub-family A (ABC1), member 2
  ENST ID: ENST00000479446
  CDS Start-End: 1-4325
gcggccgcttctacttcctctacggcttcgtctggatccaggacatgatggagcgcgccatcatcgacacttttgtggggcacgatgtggtggagccaggcagctacgtgcagatgttcccctacccctgctacacacgcgatgacttcctgtttgtcattgagcacatgatgccgctgtgcatggtgatctcctgggtctactccgtggccatgaccatccagcacatcgtggcggagaaggagcaccggctcaaggaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcacctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtgggctctgggcatgtagggtggggcctgggtggggtaggccagggccaggggggtggggccccagcagtggaggtggagcctgggtgggcagggccctgagctctgggggtggggcctgcatggggtggggctgtggggcacgtggccccctgggctctggaggtggggcagggtctgggtggggtggggccagaggggcagggtgggggcaggatgccccgctgagtgggcaggctcctggccaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatccttgacctcatcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgtggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcctgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaac

SEQ ID NO: 110043 - DNA, 586 bp, Homo sapiens
  Payload ID: 1602
  Gene Symbol: ABCA2
  Gene Name: ATP-binding cassette, sub-family A (ABC1), member 2
  ENST ID: ENST00000470535
  CDS Start-End: 1-134
agggcgcaccctctgctgcagcactggccaccccggacacgctgcagggccagtgctcagccttcgtacagctctgggccggcctgcagcccatcttgtgtggcaacaaccggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggccaacgagacttttgcttttgtgggcaacgtgactcactatgcccaggtctggctcaacatctcggcggagatccgcagcttcctggagcagggcaggctgcagcaacacctgcgctggctgcagcagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcgtggacatcttcaagggcttccccgac

SEQ ID NO: 110044 - DNA, 666 bp, Homo sapiens
  Payload ID: 1602
  Gene Symbol: ABCA2
  Gene Name: ATP-binding cassette, sub-family A (ABC1), member 2
  ENST ID: ENST00000490486
  CDS Start-End: 1-588
atcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacaga

SEQ ID NO: 110045 - DNA, 8146 bp, Homo sapiens
  Payload ID: 1602
  Gene Symbol: ABCA2
  Gene Name: ATP-binding cassette, sub-family A (ABC1), member 2
  ENST ID: ENST00000614293
  CDS Start-End: 51-7451
agaaccgcctgatcccgaactccctgtgcagagaccagactcgcccgaatatggggagaaaaacgagccgcgtgcagcaggggccgcctcggtcccctgcctgctccgctcacggcgagcgttcctggggcctcgagtttccccccttccgctggctgctcggaatcgcgggacggacccacctggccgccctgcctcccttccagtgggtcctggccttcgagatcttcatccccctggtgctgttctttatcctgctggggctgcgacagaagaagcccaccatctccgtgaaggaagtcgccttctacacagcggcgcccctgacgtctgccggcatcctgcctgtcatgcaatcgctgtgcccggacggccagcgagacgagttcggcttcctgcagtacgccaactccacggtcacgcagctgcttgagcgcctggaccgcgtggtggaggaaggcaacctgtttgacccagcgcggcccagcctgggctcagagctcgaggccctacgccagcatctggaggccctcagtgcgggcccgggcacctcggggagccacctggacagatccacagtgtcttccttctctctggactcggtggccagaaacccgcaggagctctggcgtttcctgacgcaaaacttgtcgctgcccaatagcacggcccaagcactcttggccgcccgtgtggacccgcccgaggtctaccacctgctctttggtccctcatctgccctggattcacagtctggcctccacaagggtcaggagccctggagccgcctagggggcaatcccctgttccggatggaggagctgctgctggctcctgccctcctggagcagctcacctgcacgccgggctcgggggagctgggccggatcctcactgtgcctgagagtcagaagggagccctgcagggctaccgggatgctgtctgcagtgggcaggctgctgcgcgtgccaggcgcttctctgggctgtctgctgagctccggaaccagctggacgtggccaaggtctcccagcagctgggcctggatgcccccaacggctcggactcctcgccacaggcgccacccccacggaggctgcaggcgcttctgggggacctgctggatgcccagaaggttctgcaggatgtggatgtcctgtcggccctggccctgctactgccccagggtgcctgcactggccggacccccggacccccagccagtggtgcgggtggggcggccaatggcactggggcaggggcagtcatgggccccaacgccaccgctgaggagggcgcaccctctgctgcagcactggccaccccggacacgctgcagggccagtgctcagccttcgtacagctctgggccggcctgcagcccatcttgtgtggcaacaaccgcaccattgaacccgaggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggccaacgagacttttgcttttgtgggcaacgtgactcactatgcccaggtctggctcaacatctcggcggagatccgcagcttcctggagcagggcaggctgcagcaacacctgcgctggctgcagcagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcgtggacatcttcaagggcttccccgacgaggagagcattgtcaactacaccctcaaccaggcctaccaggacaacgtcactgtttttgccagtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccaggacatgatggagcgcgccatcatcgacacttttgtggggcacgatgtggtggagccaggcagctacgtgcagatgttcccctacccctgctacacacgcgatgacttcctgtttgtcattgagcacatgatgccgctgtgcatggtgatctcctgggtctactccgtggccatgaccatccagcacatcgtggcggagaaggagcaccggctcaaggaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcacctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatccttgacctcatcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgtggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcctgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaacaaaatgtc

SEQ ID NO: 110046 - DNA, 371 bp, Homo sapiens
  Payload ID: 1602
  Gene Symbol: ABCA2
  Gene Name: ATP-binding cassette, sub-family A (ABC1), member 2
  ENST ID: ENST00000625103
  CDS Start-End: 7-371
ccgaatatggggagaaaaacgagccgcgtgcagcaggggccgcctcggtcccctgcctgctccgctcacggcgagcgttcctggggcctcgagtttccccccttccgctggctgctcggaatcgcgggacggacccacctggccgccctgcctcccttccagtgggtcctggccttcgagatcttcatccccctggtgctgttctttatcctgctggggctgcgacagaagaagcccaccatctccgtgaaggaagtctccttctacacagcggcgcccctgacgtctgccggcatcctgcctgtcatgcaatcgctgtgcccggacggccagcgagacgagttcggcttcctgcagtacgccaactccac

SEQ ID NO: 110047 - DNA, 6609 bp, Homo sapiens
  Payload ID: 1603
  Gene Symbol: ABCA3
  Gene Name: ATP-binding cassette, sub-family A (ABC1), member 3
  Uniprot ID: Q99758
  ENST ID: ENST00000301732
  CDS Start-End: 702-5816
gtccgccagtagcgggttgcaggcgcaccctcccctccagggcggccacgcagctgtcagtgccgccgccactgcgaggctggagcggagcccgggtggccgagggaggggaccccgcgagagggccgcgcgccggccgccgccgccccggcgcccaggctcggtgctggagagtcatgcctgtgagccctgggcacctcctgatgtcctgcgaggtcacggtgttcccaaacctcagggttgccctgccccactccagaggctctcaggccccaccccggagccctctgtgcggagccgcctcctcctggccagttccccagtagtcctgaagggagacctgctgtgtggagcctcttctgggacccagccatgagtgtggagctgagcaactgaacctgaaactcttccactgtgagtcaaggaggcttttccgcacatgaaggacgctgagcgggaaggactcctctctgcctgcagttgtagcgagtggaccagcaccaggggctctctagactgcccctcctccatcgccttccctgcctctccaggacagagcagccacgtctgcacacctcgccctctttacactcagttttcagagcacgtttctcctatttcctgcgggttgcagcgcctacttgaacttactcagaccacctacttctctagcagcactgggcgtccctttcagcaagacgatggctgtgctcaggcagctggcgctcctcctctggaagaactacaccctgcagaagcggaaggtcctggtgacggtcctggaactcttcctgccattgctgttttctgggatcctcatctggctccgcttgaagattcagtcggaaaatgtgcccaacgccaccatctacccgggccagtccatccaggagctgcctctgttcttcaccttccctccgccaggagacacctgggagcttgcctacatcccttctcacagtgacgctgccaagaccgtcactgagacagtgcgcagggcacttgtgatcaacatgcgagtgcgcggctttccctccgagaaggactttgaggactacattaggtacgacaactgctcgtccagcgtgctggccgccgtggtcttcgagcaccccttcaaccacagcaaggagcccctgccgctggcggtgaaatatcacctacggttcagttacacacggagaaattacatgtggacccaaacaggctcctttttcctgaaagagacagaaggctggcacactacttcccttttcccgcttttcccaaacccaggaccaagggaacctacatcccctgatggcggagaacctgggtacatccgggaaggcttcctggccgtgcagcatgctgtggaccgggccatcatggagtaccatgccgatgccgccacacgccagctgttccagagactgacggtgaccatcaagaggttcccgtacccgccgttcatcgcagaccccttcctcgtggccatccagtaccagctgcccctgctgctgctgctcagcttcacctacaccgcgctcaccattgcccgtgctgtcgtgcaggagaaggaaaggaggctgaaggagtacatgcgcatgatggggctcagcagctggctgcactggagtgcctggttcctcttgttcttcctcttcctcctcatcgccgcctccttcatgaccctgctcttctgtgtcaaggtgaagccaaatgtagccgtgctgtcccgcagcgacccctccctggtgctcgccttcctgctgtgcttcgccatctctaccatctccttcagcttcatggtcagcaccttcttcagcaaagccaacatggcagcagccttcggaggcttcctctacttcttcacctacatcccctacttcttcgtggcccctcggtacaactggatgactctgagccagaagctctgctcctgcctcctgtctaatgtcgccatggcaatgggagcccagctcattgggaaatttgaggcgaaaggcatgggcatccagtggcgagacctcctgagtcccgtcaacgtggacgacgacttctgcttcgggcaggtgctggggatgctgctgctggactctgtgctctatggcctggtgacctggtacatggaggccgtcttcccagggcagttcggcgtgcctcagccctggtacttcttcatcatgccctcctattggtgtgggaagccaagggcggttgcagggaaggaggaagaagacagtgaccccgagaaagcactcagaaacgagtactttgaagccgagccagaggacctggtggcggggatcaagatcaagcacctgtccaaggtgttcagggtgggaaataaggacagggcggccgtcagagacctgaacctcaacctgtacgagggacagatcaccgtcctgctgggccacaacggtgccgggaagaccaccaccctctccatgctcacaggtctctttccccccaccagtggacgggcatacatcagcgggtatgaaatttcccaggacatggttcagatccggaagagcctgggcctgtgcccgcagcacgacatcctgtttgacaacttgacagtcgcagagcacctttatttctacgcccagctgaagggcctgtcacgtcagaagtgccctgaagaagtcaagcagatgctgcacatcatcggcctggaggacaagtggaactcacggagccgcttcctgagcgggggcatgaggcgcaagctctccatcggcatcgccctcatcgcaggctccaaggtgctgatactggacgagcccacctcgggcatggacgccatctccaggagggccatctgggatcttcttcagcggcagaaaagtgaccgcaccatcgtgctgaccacccacttcatggacgaggctgacctgctgggagaccgcatcgccatcatggccaagggggagctgcagtgctgcgggtcctcgctgttcctcaagcagaaatacggtgccggctatcacatgacgctggtgaaggagccgcactgcaacccggaagacatctcccagctggtccaccaccacgtgcccaacgccacgctggagagcagcgctggggccgagctgtctttcatccttcccagagagagcacgcacaggtttgaaggtctctttgctaaactggagaagaagcagaaagagctgggcattgccagctttggggcatccatcaccaccatggaggaagtcttccttcgggtcgggaagctggtggacagcagtatggacatccaggccatccagctccctgccctgcagtaccagcacgagaggcgcgccagcgactgggctgtggacagcaacctctgtggggccatggacccctccgacggcattggagccctcatcgaggaggagcgcaccgctgtcaagctcaacactgggctcgccctgcactgccagcaattctgggccatgttcctgaagaaggccgcatacagctggcgcgagtggaaaatggtggcggcacaggtcctggtgcctctgacctgcgtcaccctggccctcctggccatcaactactcctcggagctcttcgacgaccccatgctgaggctgaccttgggcgagtacggcagaaccgtcgtgcccttctcagttcccgggacctcccagctgggtcagcagctgtcagagcatctgaaagacgcactgcaggctgagggacaggagccccgcgaggtgctcggtgacctggaggagttcttgatcttcagggcttctgtggaggggggcggctttaatgagcggtgccttgtggcagcgtccttcagagatgtgggagagcgcacggtcgtcaacgccttgttcaacaaccaggcgtaccactctccagccactgccctggccgtcgtggacaaccttctgttcaagctgctgtgcgggcctcacgcctccattgtggtctccaacttcccccagccccggagcgccctgcaggctgccaaggaccagtttaacgagggccggaagggattcgacattgccctcaacctgctcttcgccatggcattcttggccagcacgttctccatcctggcggtcagcgagagggccgtgcaggccaagcatgtgcagtttgtgagtggagtccacgtggccagtttctggctctctgctctgctgtgggacctcatctccttcctcatccccagtctgctgctgctggtggtgtttaaggccttcgacgtgcgtgccttcacgcgggacggccacatggctgacaccctgctgctgctcctgctctacggctgggccatcatccccctcatgtacctgatgaacttcttcttcttgggggcggccactgcctacacgaggctgaccatcttcaacatcctgtcaggcatcgccaccttcctgatggtcaccatcatgcgcatcccagctgtaaaactggaagaactttccaaaaccctggatcacgtgttcctggtgctgcccaaccactgtctggggatggcagtcagcagtttctacgagaactacgagacgcggaggtactgcacctcctccgaggtcgccgcccactactgcaagaaatataacatccagtaccaggagaacttctatgcctggagcgccccgggggtcggccggtttgtggcctccatggccgcctcagggtgcgcctacctcatcctgctcttcctcatcgagaccaacctgcttcagagactcaggggcatcctctgcgccctccggaggaggcggacactgacagaattatacacccggatgcctgtgcttcctgaggaccaagatgtagcggacgagaggacccgcatcctggcccccagtccggactccctgctccacacacctctgattatcaaggagctctccaaggtgtacgagcagcgggtgcccctcctggccgtggacaggctctccctcgcggtgcagaaaggggagtgcttcggcctgctgggcttcaatggagccgggaagaccacgactttcaaaatgctgaccggggaggagagcctcacttctggggatgcctttgtcgggggtcacagaatcagctctgatgtcggaaaggtgcggcagcggatcggctactgcccgcagtttgatgccttgctggaccacatgacaggccgggagatgctggtcatgtacgctcggctccggggcatccctgagcgccacatcggggcctgcgtggagaacactctgcggggcctgctgctggagccacatgccaacaagctggtcaggacgtacagtggtggtaacaagcggaagctgagcaccggcatcgccctgatcggagagcctgctgtcatcttcctggacgagccgtccactggcatggaccccgtggcccggcgcctgctttgggacaccgtggcacgagcccgagagtctggcaaggccatcatcatcacctcccacagcatggaggagtgtgaggccctgtgcacccggctggccatcatggtgcaggggcagttcaagtgcctgggcagcccccagcacctcaagagcaagttcggcagcggctactccctgcgggccaaggtgcagagtgaagggcaacaggaggcgctggaggagttcaaggccttcgtggacctgacctttccaggcagcgtcctggaagatgagcaccaaggcatggtccattaccacctgccgggccgtgacctcagctgggcgaaggttttcggtattctggagaaagccaaggaaaagtacggcgtggacgactactccgtgagccagatctcgctggaacaggtcttcctgagcttcgcccacctgcagccgcccaccgcagaggaggggcgatgaggggtggcggctgtctcgccatcaggcagggacaggacgggcaagcagggcccatcttacatcctctctctccaagtttatctcatcctttatttttaatcacttttttctatgatggatatgaaaaattcaaggcagtatgcacagaatggacgagtgcagcccagccctcatgcccaggatcagcatgcgcatctccatgtctgcatactctggagttcactttcccagagctggggcaggccgggcagtctgcgggcaagctccggggtctctgggtggagagctgacccaggaagggctgcagctgagctgggggttgaatttctccaggcactccctggagagaggacccagtgacttgtccaagtttacacacgacactaatctcccctggggaggaagcgggaagccagccaggttgaactgtagcgaggcccccaggccgccaggaatggaccatgcagatcactgtcagtggagggaagctgctgactgtgattaggtgctggggtcttagcgtccagcgcagcccgggggcatcctggaggctctgctccttagggcatggtagtcaccgcgaagccgggcaccgtcccacagcatctcctagaagcagccggcacaggagggaaggtggccaggctcgaagcagtctctgtttccagcactgcaccctcaggaagtcgcccgccccaggacacgcagggaccaccctaagggctgggtggctgtctcaaggacacattgaatacgttgtgaccatccagaaaataaatgctgaggggacaca

SEQ ID NO: 110048 - DNA, 6446 bp, Homo sapiens
  Payload ID: 1603
  Gene Symbol: ABCA3
  Gene Name: ATP-binding cassette, sub-family A (ABC1), member 3
  ENST ID: ENST00000382381
  CDS Start-End: 713-5653
gcggccgctgcgtccgccagtagcgggttgcaggcgcaccctcccctccagggcggccacgcagctgtcagtgccgccgccactgcgaggctggagcggagcccgggtggccgagggaggggaccccgcgagagggccgcgcgccggccgccgccgccccggcgcccaggctcggtgctggagagtcatgcctgtgagccctgggcacctcctgatgtcctgcgaggtcacggtgttcccaaacctcagggttgccctgccccactccagaggctctcaggccccaccccggagccctctgtgcggagccgcctcctcctggccagttccccagtagtcctgaagggagacctgctgtgtggagcctcttctgggacccagccatgagtgtggagctgagcaactgaacctgaaactcttccactgtgagtcaaggaggcttttccgcacatgaaggacgctgagcgggaaggactcctctctgcctgcagttgtagcgagtggaccagcaccaggggctctctagactgcccctcctccatcgccttccctgcctctccaggacagagcagccacgtctgcacacctcgccctctttacactcagttttcagagcacgtttctcctatttcctgcgggttgcagcgcctacttgaacttactcagaccacctacttctctagcagcactgggcgtccctttcagcaagacgatggctgtgctcaggcagctggcgctcctcctctggaagaactacaccctgcagaagcggaaggtcctggtgacggtcctggaactcttcctgccattgctgttttctgggatcctcatctggctccgcttgaagattcagtcggaaaatgtgcccaacgccaccatctacccgggccagtccatccaggagctgcctctgttcttcaccttccctccgccaggagacacctgggagcttgcctacatcccttctcacagtgacgctgccaagaccgtcactgagacagtgcgcagggcacttgtgatcaacatgcgagtgcgcggctttccctccgagaaggactttgaggactacattaggtacgacaactgctcgtccagcgtgctggccgccgtggtcttcgagcaccccttcaaccacagcaaggagcccctgccgctggcggtgaaatatcacctacggttcagttacacacggagaaattacatgtggacccaaacaggctcctttttcctgaaagagacagaaggctggcacactacttcccttttcccgcttttcccaaacccaggaccaagggaacctacatcccctgatggcggagaacctgggtacatccgggaaggcttcctggccgtgcagcatgctgtggaccgggccatcatggagtaccatgccgatgccgccacacgccagctgttccagagactgacggtgaccatcaagaggttcccgtacccgccgttcatcgcagaccccttcctcgtggccatccagtaccagctgcccctgctgctgctgctcagcttcacctacaccgcgctcaccattgcccgtgctgtcgtgcaggagaaggaaaggaggctgaaggagtacatgcgcatgatggggctcagcagctggctgcactggagtgcctggttcctcttgttcttcctcttcctcctcatcgccgcctccttcatgaccctgctcttctgtgtcaaggtgaagccaaatgtagccgtgctgtcccgcagcgacccctccctggtgctcgccttcctgctgtgcttcgccatctctaccatctccttcagcttcatggtcagcaccttcttcagcaaaggcatgggcatccagtggcgagacctcctgagtcccgtcaacgtggacgacgacttctgcttcgggcaggtgctggggatgctgctgctggactctgtgctctatggcctggtgacctggtacatggaggccgtcttcccagggcagttcggcgtgcctcagccctggtacttcttcatcatgccctcctattggtgtgggaagccaagggcggttgcagggaaggaggaagaagacagtgaccccgagaaagcactcagaaacgagtactttgaagccgagccagaggacctggtggcggggatcaagatcaagcacctgtccaaggtgttcagggtgggaaataaggacagggcggccgtcagagacctgaacctcaacctgtacgagggacagatcaccgtcctgctgggccacaacggtgccgggaagaccaccaccctctccatgctcacaggtctctttccccccaccagtggacgggcatacatcagcgggtatgaaatttcccaggacatggttcagatccggaagagcctgggcctgtgcccgcagcacgacatcctgtttgacaacttgacagtcgcagagcacctttatttctacgcccagctgaagggcctgtcacgtcagaagtgccctgaagaagtcaagcagatgctgcacatcatcggcctggaggacaagtggaactcacggagccgcttcctgagcgggggcatgaggcgcaagctctccatcggcatcgccctcatcgcaggctccaaggtgctgatactggacgagcccacctcgggcatggacgccatctccaggagggccatctgggatcttcttcagcggcagaaaagtgaccgcaccatcgtgctgaccacccacttcatggacgaggctgacctgctgggagaccgcatcgccatcatggccaagggggagctgcagtgctgcgggtcctcgctgttcctcaagcagaaatacggtgccggctatcacatgacgctggtgaaggagccgcactgcaacccggaagacatctcccagctggtccaccaccacgtgcccaacgccacgctggagagcagcgctggggccgagctgtctttcatccttcccagagagagcacgcacaggtttgaaggtctctttgctaaactggagaagaagcagaaagagctgggcattgccagctttggggcatccatcaccaccatggaggaagtcttccttcgggtcgggaagctggtggacagcagtatggacatccaggccatccagctccctgccctgcagtaccagcacgagaggcgcgccagcgactgggctgtggacagcaacctctgtggggccatggacccctccgacggcattggagccctcatcgaggaggagcgcaccgctgtcaagctcaacactgggctcgccctgcactgccagcaattctgggccatgttcctgaagaaggccgcatacagctggcgcgagtggaaaatggtggcggcacaggtcctggtgcctctgacctgcgtcaccctggccctcctggccatcaactactcctcggagctcttcgacgaccccatgctgaggctgaccttgggcgagtacggcagaaccgtcgtgcccttctcagttcccgggacctcccagctgggtcagcagctgtcagagcatctgaaagacgcactgcaggctgagggacaggagccccgcgaggtgctcggtgacctggaggagttcttgatcttcagggcttctgtggaggggggcggctttaatgagcggtgccttgtggcagcgtccttcagagatgtgggagagcgcacggtcgtcaacgccttgttcaacaaccaggcgtaccactctccagccactgccctggccgtcgtggacaaccttctgttcaagctgctgtgcgggcctcacgcctccattgtggtctccaacttcccccagccccggagcgccctgcaggctgccaaggaccagtttaacgagggccggaagggattcgacattgccctcaacctgctcttcgccatggcattcttggccagcacgttctccatcctggcggtcagcgagagggccgtgcaggccaagcatgtgcagtttgtgagtggagtccacgtggccagtttctggctctctgctctgctgtgggacctcatctccttcctcatccccagtctgctgctgctggtggtgtttaaggccttcgacgtgcgtgccttcacgcgggacggccacatggctgacaccctgctgctgctcctgctctacggctgggccatcatccccctcatgtacctgatgaacttcttcttcttgggggcggccactgcctacacgaggctgaccatcttcaacatcctgtcaggcatcgccaccttcctgatggtcaccatcatgcgcatcccagctgtaaaactggaagaactttccaaaaccctggatcacgtgttcctggtgctgcccaaccactgtctggggatggcagtcagcagtttctacgagaactacgagacgcggaggtactgcacctcctccgaggtcgccgcccactactgcaagaaatataacatccagtaccaggagaacttctatgcctggagcgccccgggggtcggccggtttgtggcctccatggccgcctcagggtgcgcctacctcatcctgctcttcctcatcgagaccaacctgcttcagagactcaggggcatcctctgcgccctccggaggaggcggacactgacagaattatacacccggatgcctgtgcttcctgaggaccaagatgtagcggacgagaggacccgcatcctggcccccagtccggactccctgctccacacacctctgattatcaaggagctctccaaggtgtacgagcagcgggtgcccctcctggccgtggacaggctctccctcgcggtgcagaaaggggagtgcttcggcctgctgggcttcaatggagccgggaagaccacgactttcaaaatgctgaccggggaggagagcctcacttctggggatgcctttgtcgggggtcacagaatcagctctgatgtcggaaaggtgcggcagcggatcggctactgcccgcagtttgatgccttgctggaccacatgacaggccgggagatgctggtcatgtacgctcggctccggggcatccctgagcgccacatcggggcctgcgtggagaacactctgcggggcctgctgctggagccacatgccaacaagctggtcaggacgtacagtggtggtaacaagcggaagctgagcaccggcatcgccctgatcggagagcctgctgtcatcttcctggacgagccgtccactggcatggaccccgtggcccggcgcctgctttgggacaccgtggcacgagcccgagagtctggcaaggccatcatcatcacctcccacagcatggaggagtgtgaggccctgtgcacccggctggccatcatggtgcaggggcagttcaagtgcctgggcagcccccagcacctcaagagcaagttcggcagcggctactccctgcgggccaaggtgcagagtgaagggcaacaggaggcgctggaggagttcaaggccttcgtggacctgacctttccaggcagcgtcctggaagatgagcaccaaggcatggtccattaccacctgccgggccgtgacctcagctgggcgaaggttttcggtattctggagaaagccaaggaaaagtacggcgtggacgactactccgtgagccagatctcgctggaacaggtcttcctgagcttcgcccacctgcagccgcccaccgcagaggaggggcgatgaggggtggcggctgtctcgccatcaggcagggacaggacgggcaagcagggcccatcttacatcctctctctccaagtttatctcatcctttatttttaatcacttttttctatgatggatatgaaaaattcaaggcagtatgcacagaatggacgagtgcagcccagccctcatgcccaggatcagcatgcgcatctccatgtctgcatactctggagttcactttcccagagctggggcaggccgggcagtctgcgggcaagctccggggtctctgggtggagagctgacccaggaagggctgcagctgagctgggggttgaatttctccaggcactccctggagagaggacccagtgacttgtccaagtttacacacgacactaatctcccctggggaggaagcgggaagccagccaggttgaactgtagcgaggcccccaggccgccaggaatggaccatgcagatcactgtcagtggagggaagctgctgactgtgattaggtgctggggtcttagcgtccagcgcagcccgggggcatcctggaggctctgctccttagggcatggtagtcaccgcgaagccgggcaccgtcccacagcatctcctagaagcagccggcacaggagggaaggtggccaggctcgaagcagtctctgtttccagcactgcaccctcaggaagtcgcccgccccaggacacgcagggaccaccctaagggctgggtggctgtctcaaggacacattgaatacgttgtgaccatccagaaaataaatgctgaggggacaca

SEQ ID NO: 110049 - DNA, 1205 bp, Homo sapiens
  Payload ID: 1603
  Gene Symbol: ABCA3
  Gene Name: ATP-binding cassette, sub-family A (ABC1), member 3
  Uniprot ID: Q99758
  ENST ID: ENST00000567910
  CDS Start-End: 409-1038
ggagccgcctcctcctggccagttccccagtagtcctgaagggagacctgctgtgtggagcctcttctgggacccagccatgagtgtggagctgagcaactgaacctgaaactcttccactgtgagtcaaggaggcttttccgcacatgaaggacgctgagcgggaaggactcctctctgcctgcagttgtagcgagtggaccagcaccaggggctctctagactgcccctcctccatcgccttccctgcctctccaggacagagcagccacgtctgcacacctcgccctctttacactcagttttcagagcacgtttctcctatttcctgcgggttgcagcgcctacttgaacttactcagaccacctacttctctagcagcactgggcgtccctttcagcaagacgatggctgtgctcaggcagctggcgctcctcctctggaagaactacaccctgcagaagcggaaggtcctggtgacggtcctggaactcttcctgccattgctgttttctgggatcctcatctggctccgcttgaagattcagtcggaaaatgtgcccaacgccaccatctacccgggccagtccatccaggagctgcctctgttcttcaccttccctccgccaggagacacctgggagcttgcctacatcccttctcacagtgacgctgccaagaccgtcactgagacagtgcgcagggcacttgtgatcaacatgcgagtgcgcggctttccctccgagaaggactttgaggactacattaggtacgacaactgctcgtccagcgtgctggccgccgtggtcttcgagcaccccttcaaccacagcaaggagcccctgccgctggcggtgaaatatcacctacggttcagttacacacggagaaattacatgtggacccaaacaggctcctttttcctgaaagagacagaaggctggcacactacttcccttttcccgcttttcccaaacccaggaccaagggaacctacatcccctgatggcggagaacctggtgagaagctcggttagggttcgtgttaccagcccgggctgttgactagtgacagtcatatgggggcagccccactttgcaaaagtatttcttgaagaaatacttttcaggacatttggcttggttccaagtctttgctgttgtgaatagtgccgcaataaacatacgtgtgcatgtgtcctta

SEQ ID NO: 110050 - DNA, 7309 bp, Homo sapiens
  Payload ID: 1604
  Gene Symbol: ABCA4
  Gene Name: ATP-binding cassette, sub-family A (ABC1), member 4
  Uniprot ID: P78363
  ENST ID: ENST00000370225
  CDS Start-End: 88-6909
gccagaggcgctcttaacggcgtttatgtcctttgctgtctgaggggcctcagctctgaccaatctggtcttcgtgtggtcattagcatgggcttcgtgagacagatacagcttttgctctggaagaactggaccctgcggaaaaggcaaaagattcgctttgtggtggaactcgtgtggcctttatctttatttctggtcttgatctggttaaggaatgccaacccactctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactcagtggtctaccttctgatcaactctcaagtccgtccagagcagttcgctcatggagtcccggacctggcgctgaaggacatcgcctgcagcgaggccctcctggagcgcttcatcatcttcagccagagacgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggtatcaatctgagatcttggggaggaatattatctgatatgtcaccaagaattcaagagtttatccatcggccgagtatgcaggacttgctgtgggtgaccaggcccctcatgcagaatggtggtccagagacctttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgcagcacgaaggatactgaagaatgccaactcaacttttgaagaactggaacacgttaggaagttggtcaaagcctgggaagaagtagggccccagatctggtacttctttgacaacagcacacagatgaacatgatcagagataccctggggaacccaacagtaaaagactttttgaataggcagcttggtgaagaaggtattactgctgaagccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacaggtattgggattctggtcccagagctgatcccgtggaagatttccggtacatctggggcgggtttgcctatctgcaggacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagaccttgaaaaatcagggtgtctccaatgcagtgatttggtgtacctggttcctggacagcttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctctacctgccacacatcctgtgcttcgcctggcaggaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtctatggcttactcgcttggtaccttgatcaggtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttctttgaacgtgagcatccagggtgggttcctggggtatgcgtgaagaatctggtaaagatttttgagccctgtggccggccagctgtggaccgtctgaacatcaccttctacgagaaccagatcaccgcattcctgggccacaatggagctgggaaaaccaccaccttgtccatcctgacgggtctgttgccaccaacctctgggactgtgctcgttgggggaagggacattgaaaccagcctggatgcagtccggcagagccttggcatgtgtccacagcacaacatcctgttccaccacctcacggtggctgagcacatgctgttctatgcccagctgaaaggaaagtcccaggaggaggcccagctggagatggaagccatgttggaggacacaggcctccaccacaagcggaatgaagaggctcaggacctatcaggtggcatgcagagaaagctgtcggttgccattgcctttgtgggagatgccaaggtggtgattctggacgaacccacctctggggtggacccttactcgagacgctcaatctgggatctgctcctgaagtatcgctcaggcagaaccatcatcatgtccactcaccacatggacgaggccgacctccttggggaccgcattgccatcattgcccagggaaggctctactgctcaggcaccccactcttcctgaagaactgctttggcacaggcttgtacttaaccttggtgcgcaagatgaaaaacatccagagccaaaggaaaggcagtgaggggacctgcagctgctcgtctaagggtttctccaccacgtgtccagcccacgtcgatgacctaactccagaacaagtcctggatggggatgtaaatgagctgatggatgtagttctccaccatgttccagaggcaaagctggtggagtgcattggtcaagaacttatcttccttcttccaaataagaacttcaagcacagagcatatgccagccttttcagagagctggaggagacgctggctgaccttggtctcagcagttttggaatttctgacactcccctggaagagatttttctgaaggtcacggaggattctgattcaggacctctgtttgcgggtggcgctcagcagaaaagagaaaacgtcaacccccgacacccctgcttgggtcccagagagaaggctggacagacaccccaggactccaatgtctgctccccaggggcgccggctgctcacccagagggccagcctcccccagagccagagtgcccaggcccgcagctcaacacggggacacagctggtcctccagcatgtgcaggcgctgctggtcaagagattccaacacaccatccgcagccacaaggacttcctggcgcagatcgtgctcccggctacctttgtgtttttggctctgatgctttctattgttatccctccttttggcgaataccccgctttgacccttcacccctggatatatgggcagcagtacaccttcttcagcatggatgaaccaggcagtgagcagttcacggtacttgcagacgtcctcctgaataagccaggctttggcaaccgctgcctgaaggaagggtggcttccggagtacccctgtggcaactcaacaccctggaagactccttctgtgtccccaaacatcacccagctgttccagaagcagaaatggacacaggtcaacccttcaccatcctgcaggtgcagcaccagggagaagctcaccatgctgccagagtgccccgagggtgccgggggcctcccgcccccccagagaacacagcgcagcacggaaattctacaagacctgacggacaggaacatctccgacttcttggtaaaaacgtatcctgctcttataagaagcagcttaaagagcaaattctgggtcaatgaacagaggtatggaggaatttccattggaggaaagctcccagtcgtccccatcacgggggaagcacttgttgggtttttaagcgaccttggccggatcatgaatgtgagcgggggccctatcactagagaggcctctaaagaaatacctgatttccttaaacatctagaaactgaagacaacattaaggtgtggtttaataacaaaggctggcatgccctggtcagctttctcaatgtggcccacaacgccatcttacgggccagcctgcctaaggacaggagccccgaggagtatggaatcaccgtcattagccaacccctgaacctgaccaaggagcagctctcagagattacagtgctgaccacttcagtggatgctgtggttgccatctgcgtgattttctccatgtccttcgtcccagccagctttgtcctttatttgatccaggagcgggtgaacaaatccaagcacctccagtttatcagtggagtgagccccaccacctactgggtgaccaacttcctctgggacatcatgaattattccgtgagtgctgggctggtggtgggcatcttcatcgggtttcagaagaaagcctacacttctccagaaaaccttcctgcccttgtggcactgctcctgctgtatggatgggcggtcattcccatgatgtacccagcatccttcctgtttgatgtccccagcacagcctatgtggctttatcttgtgctaatctgttcatcggcatcaacagcagtgctattaccttcatcttggaattatttgagaataaccggacgctgctcaggttcaacgccgtgctgaggaagctgctcattgtcttcccccacttctgcctgggccggggcctcattgaccttgcactgagccaggctgtgacagatgtctatgcccggtttggtgaggagcactctgcaaatccgttccactgggacctgattgggaagaacctgtttgccatggtggtggaaggggtggtgtacttcctcctgaccctgctggtccagcgccacttcttcctctcccaatggattgccgagcccactaaggagcccattgttgatgaagatgatgatgtggctgaagaaagacaaagaattattactggtggaaataaaactgacatcttaaggctacatgaactaaccaagatttatccaggcacctccagcccagcagtggacaggctgtgtgtcggagttcgccctggagagtgctttggcctcctgggagtgaatggtgccggcaaaacaaccacattcaagatgctcactggggacaccacagtgacctcaggggatgccaccgtagcaggcaagagtattttaaccaatatttctgaagtccatcaaaatatgggctactgtcctcagtttgatgcaattgatgagctgctcacaggacgagaacatctttacctttatgcccggcttcgaggtgtaccagcagaagaaatcgaaaaggttgcaaactggagtattaagagcctgggcctgactgtctacgccgactgcctggctggcacgtacagtgggggcaacaagcggaaactctccacagccatcgcactcattggctgcccaccgctggtgctgctggatgagcccaccacagggatggacccccaggcacgccgcatgctgtggaacgtcatcgtgagcatcatcagagaagggagggctgtggtcctcacatcccacagcatggaagaatgtgaggcactgtgtacccggctggccatcatggtaaagggcgcctttcgatgtatgggcaccattcagcatctcaagtccaaatttggagatggctatatcgtcacaatgaagatcaaatccccgaaggacgacctgcttcctgacctgaaccctgtggagcagttcttccaggggaacttcccaggcagtgtgcagagggagaggcactacaacatgctccagttccaggtctcctcctcctccctggcgaggatcttccagctcctcctctcccacaaggacagcctgctcatcgaggagtactcagtcacacagaccacactggaccaggtgtttgtaaattttgctaaacagcagactgaaagtcatgacctccctctgcaccctcgagctgctggagccagtcgacaagcccaggactgatctttcacaccgctcgttcctgcagccagaaaggaactctgggcagctggaggcgcaggagcctgtgcccatatggtcatccaaatggactggccagcgtaaatgaccccactgcagcagaaaacaaacacacgaggagcatgcagcgaattcagaaagaggtctttcagaaggaaaccgaaactgacttgctcacctggaacacctgatggtgaaaccaaacaaatacaaaatccttctccagaccccagaactagaaaccccgggccatcccactagcagctttggcctccatattgctctcatttcaagcagatctgcttttctgcatgtttgtctgtgtgtctgcgttgtgtgtgattttcatggaaaaataaaatgcaaatgcactcatcacaaa

SEQ ID NO: 110051 - DNA, 3740 bp, Homo sapiens
  Payload ID: 1604
  Gene Symbol: ABCA4
  Gene Name: ATP-binding cassette, sub-family A (ABC1), member 4
  ENST ID: ENST00000536513
  CDS Start-End: 141-3338
actggaggaaaacatgttctgggccggagtggtattccctgacatgtatccctggaccagctctctaccaccccacgtgtccagcccacgtcgatgacctaactccagaacaagtcctggatggggatgtaaatgagctgatggatgtagttctccaccatgttccagaggcaaagctggtggagtgcattggtcaagaacttatcttccttcttccaaataagaacttcaagcacagagcatatgccagccttttcagagagctggaggagacgctggctgaccttggtctcagcagttttggaatttctgacactcccctggaagagatttttctgaaggtcacggaggattctgattcaggacctctgtttgcgggtggcgctcagcagaaaagagaaaacgtcaacccccgacacccctgcttgggtcccagagagaaggctggacagacaccccaggactccaatgtctgctccccaggggcgccggctgctcacccagagggccagcctcccccagagccagagtgcccaggcccgcagctcaacacggggacacagctggtcctccagcatgtgcaggcgctgctggtcaagagattccaacacaccatccgcagccacaaggacttcctggcgcagatcgtgctcccggctacctttgtgtttttggctctgatgctttctattgttatccctccttttggcgaataccccgctttgacccttcacccctggatatatgggcagcagtacaccttcttcagcatggatgaaccaggcagtgagcagttcacggtacttgcagacgtcctcctgaataagccaggctttggcaaccgctgcctgaaggaagggtggcttccggagtacccctgtggcaactcaacaccctggaagactccttctgtgtccccaaacatcacccagctgttccagaagcagaaatggacacaggtcaacccttcaccatcctgcaggtgcagcaccagggagaagctcaccatgctgccagagtgccccgagggtgccgggggcctcccgcccccccagagaacacagcgcagcacggaaattctacaagacctgacggacaggaacatctccgacttcttggtaaaaacgtatcctgctcttataagaagcagcttaaagagcaaattctgggtcaatgaacagaggtatggaggaatttccattggaggaaagctcccagtcgtccccatcacgggggaagcacttgttgggtttttaagcgaccttggccggatcatgaatgtgagcgggggccctatcactagagaggcctctaaagaaatacctgatttccttaaacatctagaaactgaagacaacattaaggtgtggtttaataacaaaggctggcatgccctggtcagctttctcaatgtggcccacaacgccatcttacgggccagcctgcctaaggacaggagccccgaggagtatggaatcaccgtcattagccaacccctgaacctgaccaaggagcagctctcagagattacagtgctgaccacttcagtggatgctgtggttgccatctgcgtgattttctccatgtccttcgtcccagccagctttgtcctttatttgatccaggagcgggtgaacaaatccaagcacctccagtttatcagtggagtgagccccaccacctactgggtgaccaacttcctctgggacatcatgaattattccgtgagtgctgggctggtggtgggcatcttcatcgggtttcagaagaaagcctacacttctccagaaaaccttcctgcccttgtggcactgctcctgctgtatggatgggcggtcattcccatgatgtacccagcatccttcctgtttgatgtccccagcacagcctatgtggctttatcttgtgctaatctgttcatcggcatcaacagcagtgctattaccttcatcttggaattatttgagaataaccggacgctgctcaggttcaacgccgtgctgaggaagctgctcattgtcttcccccacttctgcctgggccggggcctcattgaccttgcactgagccaggctgtgacagatgtctatgcccggtttggtgaggagcactctgcaaatccgttccactgggacctgattgggaagaacctgtttgccatggtggtggaaggggtggtgtacttcctcctgaccctgctggtccagcgccacttcttcctctcccaatggattgccgagcccactaaggagcccattgttgatgaagatgatgatgtggctgaagaaagacaaagaattattactggtggaaataaaactgacatcttaaggctacatgaactaaccaagatttatccaggcacctccagcccagcagtggacaggctgtgtgtcggagttcgccctggagagtgctttggcctcctgggagtgaatggtgccggcaaaacaaccacattcaagatgctcactggggacaccacagtgacctcaggggatgccaccgtagcaggcaagagtattttaaccaatatttctgaagtccatcaaaatatgggctactgtcctcagtttgatgcaattgatgagctgctcacaggacgagaacatctttacctttatgcccggcttcgaggtgtaccagcagaagaaatcgaaaaggttgcaaactggagtattaagagcctgggcctgactgtctacgccgactgcctggctggcacgtacagtgggggcaacaagcggaaactctccacagccatcgcactcattggctgcccaccgctggtgctgctggatgagcccaccacagggatggacccccaggcacgccgcatgctgtggaacgtcatcgtgagcatcatcagagaagggagggctgtggtcctcacatcccacagcatggaagaatgtgaggcactgtgtacccggctggccatcatggtaaagggcgcctttcgatgtatgggcaccattcagcatctcaagtccaaatttggagatggctatatcgtcacaatgaagatcaaatccccgaaggacgacctgcttcctgacctgaaccctgtggagcagttcttccaggggaacttcccaggcagtgtgcagagggagaggcactacaacatgctccagttccaggtctcctcctcctccctggcgaggatcttccagctcctcctctcccacaaggacagcctgctcatcgaggagtactcagtcacacagaccacactggaccaggtgtttgtaaattttgctaaacagcagactgaaagtcatgacctccctctgcaccctcgagctgctggagccagtcgacaagcccaggactgatctttcacaccgctcgttcctgcagccagaaaggaactctgggcagctggaggcgcaggagcctgtgcccatatggtcatccaaatggactggccagcgtaaatgaccccactgcagcagaaaacaaacacacgaggagcatgcagcgaattcagaaagaggtctttcagaaggaaaccgaaactgacttgctcacctggaacacctgatggtgaaaccaaacaaatacaaaatccttctccagaccccagaactagaaaccccgggccatcccactagcagctttggcctccatattgctctcatttcaagcagatctgcttttctgcatgtttgtctgtgtgtctgcgttgtgtgtgattttcatggaaaaataaaatgcaaatgcactcatcacaaact

SEQ ID NO: 110052 - DNA, 8220 bp, Homo sapiens
  Payload ID: 1605
  Gene Symbol: ABCA5
  Gene Name: ATP-binding cassette, sub-family A (ABC1), member 5
  Uniprot ID: Q8WWZ7
  ENST ID: ENST00000392676
  CDS Start-End: 66-4994
aacagactgagcgcgtccaggcctgacagctctgcggctcgggccctgaggtttattcagaaaacatgtccactgcaattagggaggtaggagtttggagacagaccagaacacttctactgaagaattacttaattaaatgcagaaccaaaaagagtagtgttcaggaaattctttttccactattttttttattttggttaatattaattagcatgatgcatccaaataagaaatatgaagaagtgcctaatatagaactcaatcctatggacaagtttactctttctaatctaattcttggatatactccagtgactaatattacaagcagcatcatgcagaaagtgtctactgatcatctacctgatgtcataattactgaagaatatacaaatgaaaaagaaatgttaacatccagtctctctaagccgagcaactttgtaggtgtggttttcaaagactccatgtcctatgaacttcgtttttttcctgatatgattccagtatcttctatttatatggattcaagagctggctgttcaaaatcatgtgaggctgctcagtactggtcctcaggtttcacagttttacaagcatccatagatgctgccattatacagttgaagaccaatgtttctctttggaaggagctggagtcaactaaagctgttattatgggagaaactgctgttgtagaaatagatacctttccccgaggagtaattttaatatacctagttatagcattttcaccttttggatactttttggcaattcatatcgtagcagaaaaagaaaaaaaaataaaagaatttttaaagataatgggacttcatgatactgccttttggctttcctgggttcttctatatacaagtttaatttttcttatgtcccttcttatggcagtcattgcgacagcttctttgttatttcctcaaagtagcagcattgtgatatttctgctttttttcctttatggattatcatctgtattttttgctttaatgctgacacctctttttaaaaaatcaaaacatgtgggaatagttgaattttttgttactgtggcttttggatttattggccttatgataatcctcatagaaagttttcccaaatcgttagtgtggcttttcagtcctttctgtcactgtacttttgtgattggtattgcacaggtcatgcatttagaagattttaatgaaggtgcttcattttcaaatttgactgcaggcccatatcctctaattattacaattatcatgctcacacttaatagtatattctatgtcctcttggctgtctatcttgatcaagtcattccaggggaatttggcttacggagatcatctttatattttctgaagccttcatattggtcaaagagcaaaagaaattatgaggagttatcagagggcaatgttaatggaaatattagttttagtgaaattattgagccagtttcttcagaatttgtaggaaaagaagccataagaattagtggtattcagaagacatacagaaagaagggtgaaaatgtggaggctttgagaaatttgtcatttgacatatatgagggtcagattactgccttacttggccacagtggaacaggaaagagtacattgatgaatattctttgtggactctgcccaccttctgatgggtttgcatctatatatggacacagagtctcagaaatagatgaaatgtttgaagcaagaaaaatgattggcatttgtccacagttagatatacactttgatgttttgacagtagaagaaaatttatcaattttggcttcaatcaaagggataccagccaacaatataatacaagaagtgcagaaggttttactagatttagacatgcagactatcaaagataaccaagctaaaaaattaagtggtggtcaaaaaagaaagctgtcattaggaattgctgttcttgggaacccaaagatactgctgctagatgaaccaacagctggaatggacccctgttctcgacatattgtatggaatcttttaaaatacagaaaagccaatcgggtgacagtgttcagtactcatttcatggatgaagctgacattcttgcagataggaaagctgtgatatcacaaggaatgctgaaatgtgttggttcttcaatgttcctcaaaagtaaatgggggatcggctaccgcctgagcatgtacatagacaaatattgtgccacagaatctctttcttcactggttaaacaacatatacctggagctactttattacaacagaatgaccaacaacttgtgtatagcttgcctttcaaggacatggacaaattttcaggtttgttttctgccctagacagtcattcaaatttgggtgtcatttcttatggtgtttccatgacgactttggaagacgtatttttaaagctagaagttgaagcagaaattgaccaagcagattatagtgtatttactcagcagccactggaggaagaaatggattcaaaatcttttgatgaaatggaacagagcttacttattctttctgaaaccaaggctgctctagtgagcaccatgagcctttggaaacaacagatgtatacaatagcaaagtttcatttctttaccttgaaacgtgaaagtaaatcagtgagatcagtgttgcttctgcttttaatttttttcacagttcagatttttatgtttttggttcatcactcttttaaaaatgctgtggttcccatcaaacttgttccagacttatattttctaaaacctggagacaaaccacataaatacaaaacaagtctgcttcttcaaaattctgctgactcagatatcagtgatcttattagctttttcacaagccagaacataatggtgacgatgattaatgacagtgactatgtatccgtggctccccatagtgcggctttaaatgtgatgcattcagaaaaggactatgtttttgcagctgttttcaacagtactatggtttattctttacctatattagtgaatatcattagtaactactatctttatcatttaaatgtgactgaaaccatccagatctggagtaccccattctttcaagaaattactgatatagtttttaaaattgagctgtattttcaagcagctttgcttggaatcattgttactgcaatgccaccttactttgccatggaaaatgcagagaatcataagatcaaagcttatactcaacttaaactttcaggtcttttgccatctgcatattggattggacaagctgttgttgatatccccttattttttatcattcttattttgatgctaggaagcttattggcatttcattatggattatatttttatactgtaaagttccttgctgtggttttttgccttattggttatgttccatcagttattctgttcacttatattgcttctttcacctttaagaaaattttaaataccaaagaattttggtcatttatctattctgtggcagcgttggcttgtattgcaatcactgaaataactttctttatgggatacacaattgcaactattcttcattatgccttttgtatcatcattccaatctatccacttctaggttgcctgatttctttcataaagatttcttggaagaatgtacgaaaaaatgtggacacctataatccatgggataggctttcagtagctgttatatcgccttacctgcagtgtgtactgtggattttcctcttacaatactatgagaaaaaatatggaggcagatcaataagaaaagatccctttttcagaaacctttcaacgaagtctaaaaataggaagcttccagaaccaccagacaatgaggatgaagatgaagatgtcaaagctgaaagactaaaggtcaaagagctgatgggttgccagtgttgtgaggagaaaccatccattatggtcagcaatttgcataaagaatatgatgacaagaaagattttcttctttcaagaaaagtaaagaaagtggcaactaaatacatctctttctgtgtgaaaaaaggagagatcttaggactattgggtccaaatggtgctggcaaaagcacaattattaatattctggttggtgatattgaaccaacttcaggccaggtatttttaggagattattcttcagagacaagtgaagatgatgattcactgaagtgtatgggttactgtcctcagataaaccctttgtggccagatactacattgcaggaacattttgaaatttatggagctgtcaaaggaatgagtgcaagtgacatgaaagaagtcataagtcgaataacacatgcacttgatttaaaagaacatcttcagaagactgtaaagaaactacctgcaggaatcaaacgaaagttgtgttttgctctaagtatgctagggaatcctcagattactttgctagatgaaccatctacaggtatggatcccaaagccaaacagcacatgtggcgagcaattcgaactgcatttaaaaacagaaagcgggctgctattctgaccactcactatatggaggaggcagaggctgtctgtgatcgagtagctatcatggtgtctgggcagttaagatgtatcggaacagtacaacatctaaagagtaaatttggaaaaggctactttttggaaattaaattgaaggactggatagaaaacctagaagtagaccgccttcaaagagaaattcagtatattttcccaaatgcaagccgtcaggaaagtttttcttctattttggcttataaaattcctaaggaagatgttcagtccctttcacaatctttttttaagctggaagaagctaaacatgcttttgccattgaagaatatagcttttctcaagcaacattggaacaggtttttgtagaactcactaaagaacaagaggaggaagataatagttgtggaactttaaacagcacactttggtgggaacgaacacaagaagatagagtagtattttgaatttgtattgttcggtctgcttactgggacttctttctttttcacttaattttaactttggtttaaaaagttttttattggaatggtaactggagaaccaagaacgcacttgaaatttttctaagctccttaattgaaatgctgtggttgtgtgttttgcttttctttaaataaaacgtatgtataattaagtgaagctgcatgtttgtattgaagtatattgaactatatagtttgtatgtcatctttttcaccattcagaaacagtgcttctgaatttgtgatttaaaggaattgtaatagaatagttttatttttaagttatctttaagtttatgccatcttcttaaataagtacgtaatgttccaatctaaataaaaaactaattcataactaatgcatagaaaagatacataaagcaatgtgaaagtttcttgcttctcctttttaatttctaaaaaagccactttgaatggaagttgtcatccgtaaaagctgaagtgtaagcactaggaaatctcaatatagagatttgaggaaagttatatccactaggtggcagtcattgatcataataagtgaaatgagcccttgttctagtacatgattttaggcttaggtaattaggtatgtgaaattacatttctttaatttaaagtaaaattcagaaggttttagttattataattaaaggaagactgtgtgtagaatcttacgtaatagtctgattctttgactctgtggctagaatgacagttatctatggaggtggtagaattaagccataccttttccttcatcactcttggaacatataaattttttgtcatcttccttgcaaagggcacatttaattttgttcttgaataaaatattttattgggtatttgtttttattggtaaactttagtgaatctcttctataaaattgtaagtagatcagtgtgtagatttatttagtaacttacctcattgactttggaacatggtaggatatgaataaactctttcaagggttaaattaagaattgtaagtgcagtgcgcctatttctttttaataagaaccagaatttcatttttgatagagttaaaggcatggctaatattttcttagaaatacttccttgtacaacccatgtattggctcaaggtataaaatagtgtaaataatgctagttgacattacatttcaaccaaatgaaagtattaacttcataaaacaaatatattgagagtgtgattattgtattagacaacaacaacagcaatgacagaaggatttggtactgaattactttaaataagcaaaacctttcagtggcattattcattctttaatgtaggcaaaatttaatgaacttttagctttattgtgtaataagacatctgtgattttaggctctagcagtggatttaaaagtgttctttctcggtacaaagtacgtggctgatattttcccccattgctgggggcagttgctatacactttcctaaagtatatataatgttcacataaatacccagggacctcttttttgggatgtgcttttgtaattatgtgtaaccttgaatacttaagtttagtaaaagcaacaaaattatatctatagtttactaaggcagtcacgaaaaagcatagttttttttagaacctgaccatcctaagaaagttatgtcatctgaagatagagcatgactaatgaagaaaattacctgcttttgcacgtagatttggtaactttcactttacatttgtgaatgtgtaattggtgcaaagtaaattttttttcctgcaaagtgaaagttgagtagtcacaatcatgttatttattttgttcatttagttactttgcttttaatgtatatgaatacatgctcttgtaaacaattttaaaagacattcaaatttttttttagtttttatatactcagaatatattttggttgttaaattaaattatgttccctttttcacagtaacaaaatctgactcaggagaaatataacttaattcttaggaaaacaagggtaagtgagctggaaagcaaaggaggcaaaaagtgaaatatatttatttacagtgtacagttcatgtttatgaacatactaattttaaaatgtcttaaattactgatctcaaaacttttttctatgtcagtacagataaataaataaatatacatattaggcaaaagcaacatcaccaaccttatatttcccattcatggtcaaattttcaaaggaaagtaaaagctgagctttactgagtgagtgtttactgactaataaggcaagaaaaaacatgatgagtgtactttacatcttacttttgtgggctcttaatttttttttctagtttgttttcagtaaagacagtgggttttctttaaaataatttttttcttttaaatttgcacaaattatcttaggtcagtattttggttttaatcattaaaacatttttagagtaatgtaatttaacaaatattttaagtgattatgtttccagaaatggattctttggagagaactcggatgactatcagttttggccctgtaagatcgtggagatctgtaagatagatacttatataacttacataaaatatatataatatattacttatataacttatataactagctattattttatataactaactataatatgacaaatcctttgctagtagtactaacaacgttttataggagcacaattaattttacttaggataagtgttgttattattgtttttattgttgttctgttagttactcaaaacttcattctaattgtgccctgagtttgttaaaataccatactgtatttttgtgtaacatgtaaataggcattaatttttgagaaatagaaatgtttatccttaatgtatttttaatttgctaacattgattttttattttctttcctgaaatagcttatttcctaaaatgaaagaatttattctcagatgaataatttttatatcagctattcttatcaggtaaaagtttaattattttttatttataatatatgtaagcaattctcaatgctgctctttaagaaaaataaatatgattatattaataataagctttaagagttgaaaatttaagacaagtcattttgtatactgaagtgaattctttgttatttagtgctgataattgaataatgagtagctcatattaaaaatgatgcaaaaacctggcactaaaa

SEQ ID NO: 110053 - DNA, 1948 bp, Homo sapiens
  Payload ID: 1605
  Gene Symbol: ABCA5
  Gene Name: ATP-binding cassette, sub-family A (ABC1), member 5
  ENST ID: ENST00000586811
  CDS Start-End: 228-1948
aattgctaaataggaaaactcagaaggctaggtttcagcaagacagtgatgtactctgtctctatgtcatcccatggaggggtgtgccagtgcgagggtatctgctaggcactgcggattctattccagtgcagagtaccttctctgtcccacgggaaattactgatatagtttttaaaattgagctgtattttcaagcagctttgcttggaatcattgttactgcaatgccaccttactttgccatggaaaatgcagagaatcataagatcaaagcttatactcaacttaaactttcaggtcttttgccatctgcatattggattggacaagctgttgttgatatccccttattttttatcattcttattttgatgctaggaagcttattggcatttcattatggattatatttttatactgtaaagttccttgctgtggttttttgccttattggttatgttccatcagttattctgttcacttatattgcttctttcacctttaagaaaattttaaataccaaagaattttggtcatttatctattctgtggcagcgttggcttgtattgcaatcactgaaataactttctttatgggatacacaattgcaactattcttcattatgccttttgtatcatcattccaatctatccacttctaggttgcctgatttctttcataaagatttcttggaagaatgtacgaaaaaatgtggacacctataatccatgggataggctttcagtagctgttatatcgccttacctgcagtgtgtactgtggattttcctcttacaatactatgagaaaaaatatggaggcagatcaataagaaaagatccctttttcagaaacctttcaacgaagtctaaaaataggaagcttccagaaccaccagacaatgaggatgaagatgaagatgtcaaagctgaaagactaaaggtcaaagagctgatgggttgccagtgttgtgaggagaaaccatccattatggtcagcaatttgcataaagaatatgatgacaagaaagattttcttctttcaagaaaagtaaagaaagtggcaactaaatacatctctttctgtgtgaaaaaaggagagatcttaggactattgggtccaaatggtgctggcaaaagcacaattattaatattctggttggtgatattgaaccaacttcaggccaggtatttttaggagattattcttcagagacaagtgaagatgatgattcactgaagtgtatgggttactgtcctcagataaaccctttgtggccagatactacattgcaggaacattttgaaatttatggagctgtcaaaggaatgagtgcaagtgacatgaaagaagtcataagtcgaataacacatgcacttgatttaaaagaacatcttcagaagactgtaaagaaactacctgcaggaatcaaacgaaagttgtgttttgctctaagtatgctagggaatcctcagattactttgctagatgaaccatctacaggtatggatcccaaagccaaacagcacatgtggcgagcaattcgaactgcatttaaaaacagaaagcgggctgctattctgaccactcactatatggaggaggcagaggctgtctgtgatcgagtagctatcatggtgtctgggcagttaagatgtatcggaacagtacaacatctaaagagtaaatttggaaaaggctactttttggaaattaaattgaaggactggatagaaaacctagaagtagaccgccttcaaagagaaattcagtatattttcccaaatgcaagccgtcaggaaagtttttcttctattttggcttataaaattcctaaggaagatgttcagtccctttcacaatctttttttaagctggaagaagctaaacatgcttttgccattgaagaatatagcttttctcaagcaacattggaacaggt

SEQ ID NO: 110054 - DNA, 3263 bp, Homo sapiens
  Payload ID: 1605
  Gene Symbol: ABCA5
  Gene Name: ATP-binding cassette, sub-family A (ABC1), member 5
  ENST ID: ENST00000591234
  CDS Start-End: 1-192
atgttcctcaaaagtaaatgggggatcggctaccgcctgagcatgtacatagacaaatattgtgccacagaatctctttcttcactggttaaacaacatatacctggagctactttattacaacagaatgaccaacaacttgtgtatagcttgcctttcaaggacatggacaaattttcaggaattgcttgatagacaaaaggatgttattgatgtttgttttctgccctagacagtcattcaaatttgggtgtcatttcttatggtgtttccatgacgactttggaagacgtatttttaaagctagaagttgaagcagaaattgaccaagcagattatagtgtatttactcagcagccactggaggaagaaatggattcaaaatcttttgatgaaatggaacagagcttacttattctttctgaaaccaaggctgctctagtgagcaccatgagcctttggaaacaacagatgtatacaatagcaaagtttcatttctttaccttgaaacgtgaaagtaaatcagtgagatcagtgttgcttctgcttttaatttttttcacagttcagatttttatgtttttggttcatcactcttttaaaaatgctgtggttcccatcaaacttgttccagacttatattttctaaaacctggagacaaaccacataaatacaaaacaagtctgcttcttcaaaattctgctgactcagatatcagtgatcttattagctttttcacaagccagaacataatggtgacgatgattaatgacagtgactatgtatccgtggctccccatagtgcggctttaaatgtgatgcattcagaaaaggactatgtttttgcagctgttttcaacagtactatggtttattctttacctatattagtgaatatcattagtaactactatctttatcatttaaatgtgactgaaaccatccagatctggagtaccccattctttcaagaaattactgatatagtttttaaaattgagctgtattttcaagcagctttgcttggaatcattgttactgcaatgccaccttactttgccatggaaaatgcagagaatcataagatcaaagcttatactcaacttaaactttcaggtcttttgccatctgcatattggattggacaagctgttgttgatatccccttattttttatcattcttattttgatgctaggaagcttattggcatttcattatggattatatttttatactgtaaagttccttgctgtggttttttgccttattggttatgttccatcagttattctgttcacttatattgcttctttcacctttaagaaaattttaaataccaaagaattttggtcatttatctattctgtggcagcgttggcttgtattgcaatcactgaaataactttctttatgggatacacaattgcaactattcttcattatgccttttgtatcatcattccaatctatccacttctaggttgcctgatttctttcataaagatttcttggaagaatgtacgaaaaaatgtggacacctataatccatgggataggctttcagtagctgttatatcgccttacctgcagtgtgtactgtggattttcctcttacaatactatgagaaaaaatatggaggcagatcaataagaaaagatccctttttcagaaacctttcaacgaagtctaaaaataggaagcttccagaaccaccagacaatgaggatgaagatgaagatgtcaaagctgaaagactaaaggtcaaagagctgatgggttgccagtgttgtgaggagaaaccatccattatggtcagcaatttgcataaagaatatgatgacaagaaagattttcttctttcaagaaaagtaaagaaagtggcaactaaatacatctctttctgtgtgaaaaaaggagagatcttaggactattgggtccaaatggtgctggcaaaagcacaattattaatattctggttggtgatattgaaccaacttcaggccaggtatttttaggagattattcttcagagacaagtgaagatgatgattcactgaagtgtatgggttactgtcctcagataaaccctttgtggccagatactacattgcaggaacattttgaaatttatggagctgtcaaaggaatgagtgcaagtgacatgaaagaagtcataagtcgaataacacatgcacttgatttaaaagaacatcttcagaagactgtaaagaaactacctgcaggaatcaaacgaaagttgtgttttgctctaagtatgctagggaatcctcagattactttgctagatgaaccatctacaggtatggatcccaaagccaaacagcacatgtggcgagcaattcgaactgcatttaaaaacagaaagcgggctgctattctgaccactcactatatggaggaggcagaggctgtctgtgatcgagtagctatcatggtgtctgggcagttaagatgtatcggaacagtacaacatctaaagagtaaatttggaaaaggctactttttggaaattaaattgaaggactggatagaaaacctagaagtagaccgccttcaaagagaaattcagtatattttcccaaatgcaagccgtcaggaaagtttttcttctattttggcttataaaattcctaaggaagatgttcagtccctttcacaatctttttttaagctggaagaagctaaacatgcttttgccattgaagaatatagcttttctcaagcaacattggaacaggtttttgtagaactcactaaagaacaagaggaggaagataatagttgtggaactttaaacagcacactttggtgggaacgaacacaagaagatagagtagtattttgaatttgtattgttcggtctgcttactgggacttctttctttttcacttaattttaactttggtttaaaaagttttttattggaatggtaactggagaaccaagaacgcacttgaaatttttctaagctccttaattgaaatgctgtggttgtgtgttttgcttttctttaaataaaacgtatgtataattaagtgaagctgcatgtttgtattgaagtatattgaactatatagtttgtatgtcatctttttcaccattcagaaacagtgcttctgaatttgtgatttaaaggaattgtaatagaatagttttatttttaagttatctttaagtttatgccatcttcttaaataagtacgtaatgttccaatctaaataaaaaactaattcat

SEQ ID NO: 110055 - DNA, 616 bp, Homo sapiens
  Payload ID: 1605
  Gene Symbol: ABCA5
  Gene Name: ATP-binding cassette, sub-family A (ABC1), member 5
  ENST ID: ENST00000592568
  CDS Start-End: 235-616
gactgagcgcgtccaggcctgacagctctgcggctcgggccctgagagctgacagattgctgctccatgcattctgtccagtttcctaagagagacagcttggagtatgcttaatccatcttacctgggactgaaacagctgcttattttgccgttaaaaattacatgcagtttactgcgtggctccgggtttgtttgtttgtttttcctctttaataggtttattcagaaaacatgtccactgcaattagggaggtaggagtttggagacagaccagaacacttctactgaagaattacttaattaaatgcagaaccaaaaagagtagtgttcaggaaattctttttccactattttttttattttggttaatattaattagcatgatgcatccaaataagaaatatgaagaagtgcctaatatagaactcaatcctatggacaagtttactctttctaatctaattcttggatatactccagtgactaatattacaagcagcatcatgcagaaagtgtctactgatcatctacctgatgtcataattactgaagaatatacaaatgaaaaagaaatgttaacatccagtctctctaagccgagcaactttgtag

SEQ ID NO: 110056 - DNA, 1095 bp, Homo sapiens
  Payload ID: 1605
  Gene Symbol: ABCA5
  Gene Name: ATP-binding cassette, sub-family A (ABC1), member 5
  ENST ID: ENST00000589975
  CDS Start-End: 1-577
tgaacttcgtttttttcctgatatgattccagtatcttctatttatatggattcaagagctggctgttcaaaatcatgtgaggctgctcagtactggtcctcaggtttcacagttttacaagcatccatagatgctgccattatacagttgaagaccaatgtttctctttggaaggagctggagtcaactaaagctgttattatgggagaaactgctgttgtagaaatagatacctttccccgaggagtaattttaatatacctagttatagcattttcaccttttggatactttttggcaattcatatcgtagcagaaaaagaaaaaaaaataaaagaatttttaaagataatgggacttcatgatactgccttttggctttcctgggttcttctatatacaagtttaatttttcttatgtcccttcttatggcagtcattgcgacagcttctttgttatttcctcaaagtagcagcattgtgatatttctgctttttttcctttatggattatcatctgtaagtattttaacttgtgataggaataaagaactgtcaaaatgtttgataacatagcaaagtctttttcttcagtttacttatagtcaatttgccatgaaagacagattttactaattgataagtgacttaataaataaatgatgtggcatcactgtattcctgtatttttagtaatgttacaaaatagttttagatttagatttagcttttgtcatatgatgtatttcacatacaactcctctatctgttgtctttatataatgatgtatataattaagactgtcaagtattggactatttttgtttgtcttcatggaatccttactctttcaagttaatttatgctccaggatgatgatttttaaagatacatctttgcaaatgtaactctttagcagtcttgatattcatttgatatattggctgaatgagaggttttaatgaccagcctttgttttaagtggttccatcttccattctgattggtttatgtgcccaccctgtatcagttgttaaatgttttggctatcatttctgctctttaaaataataaattgcaaataactaacata

SEQ ID NO: 110057 - DNA, 4062 bp, Homo sapiens
  Payload ID: 1605
  Gene Symbol: ABCA5
  Gene Name: ATP-binding cassette, sub-family A (ABC1), member 5
  ENST ID: ENST00000586995
  CDS Start-End: 1-1296
gttgaattttttgttactgtggcttttggatttattggccttatgataatcctcatagaaagttttcccaaatcgttagtgtggcttttcagtcctttctgtcactgtacttttgtgattggtattgcacaggtcatgcatttagaagattttaatgaaggtgcttcattttcaaatttgactgcaggcccatatcctctaattattacaattatcatgctcacacttaatagtatattctatgtcctcttggctgtctatcttgatcaagtcattccaggggaatttggcttacggagatcatctttatattttctgaagccttcatattggtcaaagagcaaaagaaattatgaggagttatcagagggcaatgttaatggaaatattagttttagtgaaattattgagccagtttcttcagaatttgtaggaaaagaagccataagaattagtggtattcagaagacatacagaaagaagggtgaaaatgtggaggctttgagaaatttgtcatttgacatatatgagggtcagattactgccttacttggccacagtggaacaggaaagagtacattgatgaatattctttgtggactctgcccaccttctgatgggtttgcatctatatatggacacagagtctcagaaatagatgaaatgtttgaagcaagaaaaatgattggcatttgtccacagttagatatacactttgatgttttgacagtagaagaaaatttatcaattttggcttcaatcaaagggataccagccaacaatataatacaagaagtgcagaaggttttactagatttagacatgcagactatcaaagataaccaagctaaaaaattaagtggtggtcaaaaaagaaagctgtcattaggaattgctgttcttgggaacccaaagatactgctgctagatgaaccaacagctggaatggacccctgttctcgacatattgtatggaatcttttaaaatacagaaaagccaatcgggtgacagtgttcagtactcatttcatggatgaagctgacattcttgcagataggaaagctgtgatatcacaaggaatgctgaaatgtgttggttcttcaatgttcctcaaaagtaaatgggggatcggctaccgcctgagcatgtacatagacaaatattgtgccacagaatctctttcttcactggttaaacaacatatacctggagctactttattacaacagaatgaccaacaacttgtgtatagcttgcctttcaaggacatggacaaattttcaggaattgcttgatagacaaaaggatgttattgatgtttgttttctgccctagacagtcattcaaatttgggtgtcatttcttatggtgtttccatgacgactttggaagacgtatttttaaagctagaagttgaagcagaaattgaccaagcagattatagtgtatttactcagcagccactggaggaagaaatggattcaaaatcttttgatgaaatggaacagagcttacttattctttctgaaaccaaggctgctctagtgagcaccatgagcctttggaaacaacagatgtatacaatagcaaagtttcatttctttaccttgaaacgtgaaagtaaatcagtgagatcagtgttgcttctgcttttaatttttttcacagttcagatttttatgtttttggttcatcactcttttaaaaatgctgtggttcccatcaaacttgttccagacttatattttctaaaacctggagacaaaccacataaatacaaaacaagtctgcttcttcaaaattctgctggtgagagtgtgtgaagactcagatatcagtgatcttattagctttttcacaagccagaacataatggtgacgatgattaatgacagtgactatgtatccgtggctccccatagtgcggctttaaatgtgatgcattcagaaaaggactatgtttttgcagctgttttcaacagtactatggtttattctttacctatattagtgaatatcattagtaactactatctttatcatttaaatgtgactgaaaccatccagatctggagtaccccattctttcaagaaattactgatatagtttttaaaattgagctgtattttcaagcagctttgcttggaatcattgttactgcaatgccaccttactttgccatggaaaatgcagagaatcataagatcaaagcttatactcaacttaaactttcaggtcttttgccatctgcatattggattggacaagctgttgttgatatccccttattttttatcattcttattttgatgctaggaagcttattggcatttcattatggattatatttttatactgtaaagttccttgctgtggttttttgccttattggttatgttccatcagttattctgttcacttatattgcttctttcacctttaagaaaattttaaataccaaagaattttggtcatttatctattctgtggcagcgttggcttgtattgcaatcactgaaataactttctttatgggatacacaattgcaactattcttcattatgccttttgtatcatcattccaatctatccacttctaggttgcctgatttctttcataaagatttcttggaagaatgtacgaaaaaatgtggacacctataatccatgggataggctttcagtagctgttatatcgccttacctgcagtgtgtactgtggattttcctcttacaatactatgagaaaaaatatggaggcagatcaataagaaaagatccctttttcagaaacctttcaacgaagtctaaaaataggaagcttccagaaccaccagacaatgaggatgaagatgaagatgtcaaagctgaaagactaaaggtcaaagagctgatgggttgccagtgttgtgaggagaaaccatccattatggtcagcaatttgcataaagaatatgatgacaagaaagattttcttctttcaagaaaagtaaagaaagtggcaactaaatacatctctttctgtgtgaaaaaaggagagatcttaggactattgggtccaaatggtgctggcaaaagcacaattattaatattctggttggtgatattgaaccaacttcaggccaggtatttttaggagattattcttcagagacaagtgaagatgatgattcactgaagtgtatgggttactgtcctcagataaaccctttgtggccagatactacattgcaggaacattttgaaatttatggagctgtcaaaggaatgagtgcaagtgacatgaaagaagtcataagtcgaataacacatgcacttgatttaaaagaacatcttcagaagactgtaaagaaactacctgcaggaatcaaacgaaagttgtgttttgctctaagtatgctagggaatcctcagattactttgctagatgaaccatctacaggtatggatcccaaagccaaacagcacatgtgatgtatcggaacagtacaacatctaaagagtaaatttggaaaaggctactttttggaaattaaattgaaggactggatagaaaacctagaagtagaccgccttcaaagagaaattcagtatattttcccaaatgcaagccgtcaggaaagtttttcttctattttggcttataaaattcctaaggaagatgttcagtccctttcacaatctttttttaagctggaagaagctaaacatgcttttgccattgaagaatatagcttttctcaagcaacattggaacaggtttttgtagaactcactaaagaacaagaggaggaagataatagttgtggaactttaaacagcacactttggtgggaacgaacacaagaagatagagtagtattttgaatttgtattgttcggtctgcttactgggacttctttctttttcacttaattttaactttggtttaaaaagttttttattggaatggtaactggagaaccaagaacgcacttgaaatttttctaagctccttaattgaaatgctgtggttgtgtgttttgcttttctttaaataaaacgtatgtataattaa

SEQ ID NO: 110058 - DNA, 3017 bp, Homo sapiens
  Payload ID: 1605
  Gene Symbol: ABCA5
  Gene Name: ATP-binding cassette, sub-family A (ABC1), member 5
  ENST ID: ENST00000593153
  CDS Start-End: 266-3017
agctctgcctgcgccaggagcgcgcgggtgcgcgcggccgcgccctcgcacagatcccagctgggtcacccgcactgagtcaacagactgagcgcgtccaggcctgacagctctgcggctcgggccctgagagacagcgtctcgggctagagtgcagtggtgcgatcaaagttcactgcagccttgaacgtctggactctagggaccctgctgaatagctggggctacaggcgtgtgtcactgcgcccaggtttattcagaaaacatgtccactgcaattagggaggtaggagtttggagacagaccagaacacttctactgaagaattacttaattaaatgcagaaccaaaaagagtagtgttcaggaaattctttttccactattttttttattttggttaatattaattagcatgatgcatccaaataagaaatatgaagaagtgcctaatatagaactcaatcctatggacaagtttactctttctaatctaattcttggatatactccagtgactaatattacaagcagcatcatgcagaaagtgtctactgatcatctacctgatgtcataattactgaagaatatacaaatgaaaaagaaatgttaacatccagtctctctaagccgagcaactttgtaggtgtggttttcaaagactccatgtcctatgaacttcgtttttttcctgatatgattccagtatcttctatttatatggattcaagagctggctgttcaaaatcatgtgaggctgctcagtactggtcctcaggtttcacagttttacaagcatccatagatgctgccattatacagttgaagaccaatgtttctctttggaaggagctggagtcaactaaagctgttattatgggagaaactgctgttgtagaaatagatacctttccccgaggagtaattttaatatacctagttatagcattttcaccttttggatactttttggcaattcatatcgtagcagaaaaagaaaaaaaaataaaagaatttttaaagataatgggacttcatgatactgccttttggctttcctgggttcttctatatacaagtttaatttttcttatgtcccttcttatggcagtcattgcgacagcttctttgttatttcctcaaagtagcagcattgtgatatttctgctttttttcctttatggattatcatctgtattttttgctttaatgctgacacctctttttaaaaaatcaaaacatgtgggaatagttgaattttttgttactgtggcttttggatttattggccttatgataatcctcatagaaagttttcccaaatcgttagtgtggcttttcagtcctttctgtcactgtacttttgtgattggtattgcacaggtcatgcatttagaagattttaatgaaggtgcttcattttcaaatttgactgcaggcccatatcctctaattattacaattatcatgctcacacttaatagtatattctatgtcctcttggctgtctatcttgatcaagtcattccaggggaatttggcttacggagatcatctttatattttctgaagccttcatattggtcaaagagcaaaagaaattatgaggagttatcagagggcaatgttaatggaaatattagttttagtgaaattattgagccagtttcttcagaatttgtaggaaaagaagccataagaattagtggtattcagaagacatacagaaagaagggtgaaaatgtggaggctttgagaaatttgtcatttgacatatatgagggtcagattactgccttacttggccacagtggaacaggaaagagtacattgatgaatattctttgtggactctgcccaccttctgatgggtttgcatctatatatggacacagagtctcagaaatagatgaaatgtttgaagcaagaaaaatgattggcatttgtccacagttagatatacactttgatgttttgacagtagaagaaaatttatcaattttggcttcaatcaaagggataccagccaacaatataatacaagaagtgcagaaggttttactagatttagacatgcagactatcaaagataaccaagctaaaaaattaagtggtggtcaaaaaagaaagctgtcattaggaattgctgttcttgggaacccaaagatactgctgctagatgaaccaacagctggaatggacccctgttctcgacatattgtatggaatcttttaaaatacagaaaagccaatcgggtgacagtgttcagtactcatttcatggatgaagctgacattcttgcagataggaaagctgtgatatcacaaggaatgctgaaatgtgttggttcttcaatgttcctcaaaagtaaatgggggatcggctaccgcctgagcatgtacatagacaaatattgtgccacagaatctctttcttcactggttaaacaacatatacctggagctactttattacaacagaatgaccaacaacttgtgtatagcttgcctttcaaggacatggacaaattttcaggtttgttttctgccctagacagtcattcaaatttgggtgtcatttcttatggtgtttccatgacgactttggaagacgtatttttaaagctagaagttgaagcagaaattgaccaagcagattatagtgtatttactcagcagccactggaggaagaaatggattcaaaatcttttgatgaaatggaacagagcttacttattctttctgaaaccaaggctgctctagtgagcaccatgagcctttggaaacaacagatgtatacaatagcaaagtttcatttctttaccttgaaacgtgaaagtaaatcagtgagatcagtgttgcttctgcttttaatttttttcacagttcagatttttatgtttttggttcatcactcttttaaaaatgctgtggttcccatcaaacttgttccagacttatattttctaaaacctggagacaaaccacataaatacaaaacaagtctgcttcttc

SEQ ID NO: 110059 - DNA, 1695 bp, Homo sapiens
  Payload ID: 1605
  Gene Symbol: ABCA5
  Gene Name: ATP-binding cassette, sub-family A (ABC1), member 5
  ENST ID: ENST00000593253
  CDS Start-End: 946-1695
cacattctttgaactgtagttgtcattttagtttatttttcaaaaacttttgcagtacctttttggtctgtcttgtgtgtgccttgcagtgaacagtctggatttggacagtggtctgtctgttagttcagtttctcaagcctttgtcacactaataggattggatttatgtatgtccagcttgggaattattacaggaattaaaaacaactttttagagtgctttcctgagctctctttctatttgttcccccttctactttttgcttccctgtggctgctgtttctatcctccagccagagagctagtgtttattttctccattgtgttacacacttgtgcagctgcaaccaccatatccagggcccaatggtaggaggtagagaagaaaagcaaaagggattggcctcatcctcttacaacgatagttccattgaatagagagaaaggttttcctgcctcagagtgttggctgcactaggcttttgttactgtagtctggccctgttaccatgggattgcttgcatgtggggatacaggagaattcagaaaagaaaaaaagatttgctatttctacattctccctgagcattaagacttcccttgcccattcctcaattcaaagctaaggcttcttctggagctgcctctgtgggcggttcgggagataccaaaggagaaaaagtaccactgttgatatggtggtatttcaaattctggtctaccctatttcacatgccttgtttacttttcagagctgacagattgctgctccatgcattctgtccagtttcctaagagagacagcttggagtatgcttaatccatcttacctgggactgaaacagctgcttattttgccgttaaaaattacatgcagtttactgcgtggctccgggtttgtttgtttgtttttcctctttaataggtttattcagaaaacatgtccactgcaattagggaggtaggagtttggagacagaccagaacacttctactgaagaattacttaattaaatgcagaaccaaaaagagtagtgttcaggaaattctttttccactattttttttattttggttaatattaattagcatgatgcatccaaataagaaatatgaagaagtgcctaatatagaactcaatcctatggacaagtttactctttctaatctaattcttggatatactccagtgactaatattacaagcagcatcatgcagaaagtgtctactgatcatctacctgatgtcataattactgaagaatatacaaatgaaaaagaaatgttaacatccagtctctctaagccgagcaactttgtaggtgtggttttcaaagactccatgtcctatgaacttcgtttttttcctgatatgattccagtatcttctatttatatggattcaagagctggctgttcaaaatcatgtgaggctgctcagtactggtcctcaggtttcacagttttacaagcatccatagatgctgccattatacagttgaagaccaatgtttctctttggaaggagctggagtcaactaaagctgttattatgggagaaactgctgttgtagaaatagatacctttccccgaggagtaattttaatatacctagttatagcattttcaccttttggatactttttggcaattcatatcgtagcagaaaaagaaaaaaaaataaaagaa

SEQ ID NO: 110060 - DNA, 560 bp, Homo sapiens
  Payload ID: 1605
  Gene Symbol: ABCA5
  Gene Name: ATP-binding cassette, sub-family A (ABC1), member 5
  ENST ID: ENST00000588665
  CDS Start-End: 447-560
tttctaggagccccgccctcaggtgcgctctgcaggaggcggggcgcgacttcggcgccgccagctctgcctgcgccaggagcgcgcgggtgcgcgcggccgcgccctcgcacagatcccagctgggtcacccgcactgagtcaacagactgagcgcgtccaggcctgacagctctgcggctcgggccctgagagacagcgtctcgggctagagtgcagtggtgcgatcaaagttcactgcagccttgaacgtctggactctagggaccctgctgaatagctggggctacaggcgtgtgtcactgcgcccagctggaatgaaacctctgaagaatcgagatagctccaatagaggtccacaggcagaaaggatttcaaggatcttcaaagggtaaatgtaccctggaagagggatactggacctgtgataggtttattcagaaaacatgtccactgcaattagggaggtaggagtttggagacagaccagaacacttctactgaagaattacttaattaaatgcagaaccaaaaagagtagtgttcaggaaattcttttt

SEQ ID NO: 110061 - DNA, 804 bp, Homo sapiens
  Payload ID: 1605
  Gene Symbol: ABCA5
  Gene Name: ATP-binding cassette, sub-family A (ABC1), member 5
  ENST ID: ENST00000587607
  CDS Start-End: 55-804
cgcgtccaggcctgacagctctgcggctcgggccctgaggtttattcagaaaacatgtccactgcaattagggaggtaggagtttggagacagaccagaacacttctactgaagaattacttaattaaatgcagaaccaaaaagagtagtgttcaggaaattctttttccactattttttttattttggttaatattaattagcatgatgcatccaaataagaaatatgaagaagtgcctaatatagaactcaatcctatggacaagtttactctttctaatctaattcttggatatactccagtgactaatattacaagcagcatcatgcagaaagtgtctactgatcatctacctgatgtcataattactgaagaatatacaaatgaaaaagaaatgttaacatccagtctctctaagccgagcaactttgtaggtgtggttttcaaagactccatgtcctatgaacttcgtttttttcctgatatgattccagtatcttctatttatatggattcaagagctggctgttcaaaatcatgtgaggctgctcagtactggtcctcaggtttcacagttttacaagcatccatagatgctgccattatacagttgaagaccaatgtttctctttggaaggagctggagtcaactaaagctgttattatgggagaaactgctgttgtagaaatagatacctttccccgaggagtaattttaatatacctagttatagcattttcaccttttggatactttttggcaattcatatcgtagcagaaaaagaaaaaaaaataaaagaa

SEQ ID NO: 110062 - DNA, 6525 bp, Homo sapiens
  Payload ID: 1605
  Gene Symbol: ABCA5
  Gene Name: ATP-binding cassette, sub-family A (ABC1), member 5
  Uniprot ID: Q8WWZ7
  ENST ID: ENST00000588877
  CDS Start-End: 1011-5939
aaaatgttgatattttctcttagcaggctgtcaaccaggttaggttcaggtcataagtttctacccacattctttgaactgtagttgtcattttagtttatttttcaaaaacttttgcagtacctttttggtctgtcttgtgtgtgccttgcagtgaacagtctggatttggacagtggtctgtctgttagttcagtttctcaagcctttgtcacactaataggattggatttatgtatgtccagcttgggaattattacaggaattaaaaacaactttttagagtgctttcctgagctctctttctatttgttcccccttctactttttgcttccctgtggctgctgtttctatcctccagccagagagctagtgtttattttctccattgtgttacacacttgtgcagctgcaaccaccatatccagggcccaatggtaggaggtagagaagaaaagcaaaagggattggcctcatcctcttacaacgatagttccattgaatagagagaaaggttttcctgcctcagagtgttggctgcactaggcttttgttactgtagtctggccctgttaccatgggattgcttgcatgtggggatacaggagaattcagaaaagaaaaaaagatttgctatttctacattctccctgagcattaagacttcccttgcccattcctcaattcaaagctaaggcttcttctggagctgcctctgtgggcggttcgggagataccaaaggagaaaaagtaccactgttgatatggtggtatttcaaattctggtctaccctatttcacatgccttgtttacttttcagagctgacagattgctgctccatgcattctgtccagtttcctaagagagacagcttggagtatgcttaatccatcttacctgggactgaaacagctgcttattttgccgttaaaaattacatgcagtttactgcgtggctccgggtttgtttgtttgtttttcctctttaataggtttattcagaaaacatgtccactgcaattagggaggtaggagtttggagacagaccagaacacttctactgaagaattacttaattaaatgcagaaccaaaaagagtagtgttcaggaaattctttttccactattttttttattttggttaatattaattagcatgatgcatccaaataagaaatatgaagaagtgcctaatatagaactcaatcctatggacaagtttactctttctaatctaattcttggatatactccagtgactaatattacaagcagcatcatgcagaaagtgtctactgatcatctacctgatgtcataattactgaagaatatacaaatgaaaaagaaatgttaacatccagtctctctaagccgagcaactttgtaggtgtggttttcaaagactccatgtcctatgaacttcgtttttttcctgatatgattccagtatcttctatttatatggattcaagagctggctgttcaaaatcatgtgaggctgctcagtactggtcctcaggtttcacagttttacaagcatccatagatgctgccattatacagttgaagaccaatgtttctctttggaaggagctggagtcaactaaagctgttattatgggagaaactgctgttgtagaaatagatacctttccccgaggagtaattttaatatacctagttatagcattttcaccttttggatactttttggcaattcatatcgtagcagaaaaagaaaaaaaaataaaagaatttttaaagataatgggacttcatgatactgccttttggctttcctgggttcttctatatacaagtttaatttttcttatgtcccttcttatggcagtcattgcgacagcttctttgttatttcctcaaagtagcagcattgtgatatttctgctttttttcctttatggattatcatctgtattttttgctttaatgctgacacctctttttaaaaaatcaaaacatgtgggaatagttgaattttttgttactgtggcttttggatttattggccttatgataatcctcatagaaagttttcccaaatcgttagtgtggcttttcagtcctttctgtcactgtacttttgtgattggtattgcacaggtcatgcatttagaagattttaatgaaggtgcttcattttcaaatttgactgcaggcccatatcctctaattattacaattatcatgctcacacttaatagtatattctatgtcctcttggctgtctatcttgatcaagtcattccaggggaatttggcttacggagatcatctttatattttctgaagccttcatattggtcaaagagcaaaagaaattatgaggagttatcagagggcaatgttaatggaaatattagttttagtgaaattattgagccagtttcttcagaatttgtaggaaaagaagccataagaattagtggtattcagaagacatacagaaagaagggtgaaaatgtggaggctttgagaaatttgtcatttgacatatatgagggtcagattactgccttacttggccacagtggaacaggaaagagtacattgatgaatattctttgtggactctgcccaccttctgatgggtttgcatctatatatggacacagagtctcagaaatagatgaaatgtttgaagcaagaaaaatgattggcatttgtccacagttagatatacactttgatgttttgacagtagaagaaaatttatcaattttggcttcaatcaaagggataccagccaacaatataatacaagaagtgcagaaggttttactagatttagacatgcagactatcaaagataaccaagctaaaaaattaagtggtggtcaaaaaagaaagctgtcattaggaattgctgttcttgggaacccaaagatactgctgctagatgaaccaacagctggaatggacccctgttctcgacatattgtatggaatcttttaaaatacagaaaagccaatcgggtgacagtgttcagtactcatttcatggatgaagctgacattcttgcagataggaaagctgtgatatcacaaggaatgctgaaatgtgttggttcttcaatgttcctcaaaagtaaatgggggatcggctaccgcctgagcatgtacatagacaaatattgtgccacagaatctctttcttcactggttaaacaacatatacctggagctactttattacaacagaatgaccaacaacttgtgtatagcttgcctttcaaggacatggacaaattttcaggtttgttttctgccctagacagtcattcaaatttgggtgtcatttcttatggtgtttccatgacgactttggaagacgtatttttaaagctagaagttgaagcagaaattgaccaagcagattatagtgtatttactcagcagccactggaggaagaaatggattcaaaatcttttgatgaaatggaacagagcttacttattctttctgaaaccaaggctgctctagtgagcaccatgagcctttggaaacaacagatgtatacaatagcaaagtttcatttctttaccttgaaacgtgaaagtaaatcagtgagatcagtgttgcttctgcttttaatttttttcacagttcagatttttatgtttttggttcatcactcttttaaaaatgctgtggttcccatcaaacttgttccagacttatattttctaaaacctggagacaaaccacataaatacaaaacaagtctgcttcttcaaaattctgctgactcagatatcagtgatcttattagctttttcacaagccagaacataatggtgacgatgattaatgacagtgactatgtatccgtggctccccatagtgcggctttaaatgtgatgcattcagaaaaggactatgtttttgcagctgttttcaacagtactatggtttattctttacctatattagtgaatatcattagtaactactatctttatcatttaaatgtgactgaaaccatccagatctggagtaccccattctttcaagaaattactgatatagtttttaaaattgagctgtattttcaagcagctttgcttggaatcattgttactgcaatgccaccttactttgccatggaaaatgcagagaatcataagatcaaagcttatactcaacttaaactttcaggtcttttgccatctgcatattggattggacaagctgttgttgatatccccttattttttatcattcttattttgatgctaggaagcttattggcatttcattatggattatatttttatactgtaaagttccttgctgtggttttttgccttattggttatgttccatcagttattctgttcacttatattgcttctttcacctttaagaaaattttaaataccaaagaattttggtcatttatctattctgtggcagcgttggcttgtattgcaatcactgaaataactttctttatgggatacacaattgcaactattcttcattatgccttttgtatcatcattccaatctatccacttctaggttgcctgatttctttcataaagatttcttggaagaatgtacgaaaaaatgtggacacctataatccatgggataggctttcagtagctgttatatcgccttacctgcagtgtgtactgtggattttcctcttacaatactatgagaaaaaatatggaggcagatcaataagaaaagatccctttttcagaaacctttcaacgaagtctaaaaataggaagcttccagaaccaccagacaatgaggatgaagatgaagatgtcaaagctgaaagactaaaggtcaaagagctgatgggttgccagtgttgtgaggagaaaccatccattatggtcagcaatttgcataaagaatatgatgacaagaaagattttcttctttcaagaaaagtaaagaaagtggcaactaaatacatctctttctgtgtgaaaaaaggagagatcttaggactattgggtccaaatggtgctggcaaaagcacaattattaatattctggttggtgatattgaaccaacttcaggccaggtatttttaggagattattcttcagagacaagtgaagatgatgattcactgaagtgtatgggttactgtcctcagataaaccctttgtggccagatactacattgcaggaacattttgaaatttatggagctgtcaaaggaatgagtgcaagtgacatgaaagaagtcataagtcgaataacacatgcacttgatttaaaagaacatcttcagaagactgtaaagaaactacctgcaggaatcaaacgaaagttgtgttttgctctaagtatgctagggaatcctcagattactttgctagatgaaccatctacaggtatggatcccaaagccaaacagcacatgtggcgagcaattcgaactgcatttaaaaacagaaagcgggctgctattctgaccactcactatatggaggaggcagaggctgtctgtgatcgagtagctatcatggtgtctgggcagttaagatgtatcggaacagtacaacatctaaagagtaaatttggaaaaggctactttttggaaattaaattgaaggactggatagaaaacctagaagtagaccgccttcaaagagaaattcagtatattttcccaaatgcaagccgtcaggaaagtttttcttctattttggcttataaaattcctaaggaagatgttcagtccctttcacaatctttttttaagctggaagaagctaaacatgcttttgccattgaagaatatagcttttctcaagcaacattggaacaggtttttgtagaactcactaaagaacaagaggaggaagataatagttgtggaactttaaacagcacactttggtgggaacgaacacaagaagatagagtagtattttgaatttgtattgttcggtctgcttactgggacttctttctttttcacttaattttaactttggtttaaaaagttttttattggaatggtaactggagaaccaagaacgcacttgaaatttttctaagctccttaattgaaatgctgtggttgtgtgttttgcttttctttaaataaaacgtatgtataattaagtgaagctgcatgtttgtattgaagtatattgaactatatagtttgtatgtcatctttttcaccattcagaaacagtgcttctgaatttgtgatttaaaggaattgtaatagaatagttttatttttaagttatctttaagtttatgccatcttcttaaataagtacgtaatgttccaatctaaataaaaaactaattcataactaatgcatagaaaagatacataaagcaatgtgaaagtttcttgcttctcctttttaatttctaaaaaagccactttgaatggaagttgtcatccgtaaaagctgaagtgtaagcactaggaaatctcaatatagagatttgaggaaagttatatccactaggtggcagtcattgatcataataagtgaaat

SEQ ID NO: 110063 - DNA, 5300 bp, Homo sapiens
  Payload ID: 1606
  Gene Symbol: ABCA6
  Gene Name: ATP-binding cassette, sub-family A (ABC1), member 6
  Uniprot ID: Q8N139
  ENST ID: ENST00000284425
  CDS Start-End: 176-5029
ctgctggagtaggcacccatttaaagaaaaaatgaagaagcagcaataaagaagttgtaatcgttacctagacaaacagagaactggttttgacagtgtttctagagtgctttttattattttcctgacagttgtgttccaccatgattactttctccttcagcgaataggctaaatgaatatgaaacagaaaagcgtgtatcagcaaaccaaagcacttctgtgcaagaattttcttaagaaatggaggatgaaaagagagagcttattggaatggggcctctcaatacttctaggactgtgtattgctctgttttccagttccatgagaaatgtccagtttcctggaatggctcctcagaatctgggaagggtagataaatttaatagctcttctttaatggttgtgtatacaccaatatctaatttaacccagcagataatgaataaaacagcacttgctcctcttttgaaaggaacaagtgtcattggggcaccaaataaaacacacatggacgaaatacttctggaaaatttaccatatgctatgggaatcatctttaatgaaactttctcttataagttaatatttttccagggatataacagtccactttggaaagaagatttctcagctcattgctgggatggatatggtgagttttcatgtacattgaccaaatactggaatagaggatttgtggctttacaaacagctattaatactgccattatagaaatcacaaccaatcaccctgtgatggaggagttgatgtcagttactgctataactatgaagacattacctttcataactaaaaatcttcttcacaatgagatgtttattttattcttcttgcttcatttctccccacttgtatattttatatcactcaatgtaacaaaagagagaaaaaagtctaagaatttgatgaaaatgatgggtctccaagattcagcattctggctctcctggggtctaatctatgctggcttcatctttattatttccatattcgttacaattatcataacattcacccaaattatagtcatgactggcttcatggtcatatttatactcttttttttatatggcttatctttggtagctttggtgttcctgatgagtgtgctgttaaagaaagctgtcctcaccaatttggttgtgtttctccttaccctcttttggggatgtctgggattcactgtattttatgaacaacttccttcatctctggagtggattttgaatatttgtagcccttttgcctttactactggaatgattcagattatcaaactggattataacttgaatggtgtaatttttcctgacccttcaggagactcatatacaatgatagcaactttttctatgttgcttttggatggtctcatctacttgctattggcattatactttgacaaaattttaccctatggagatgagcgccattattctcctttatttttcttgaattcatcatcttgtttccaacaccaaaggactaatgctaaggttattgagaaagaaatcgatgctgagcatccctctgatgattattttgaaccagtagctcctgaattccaaggaaaagaagccatcagaatcagaaatgttaagaaggaatataaaggaaaatctggaaaagtggaagcattgaaaggcttgctctttgacatatatgaaggtcaaatcacggcaatcctgggtcacagtggagctggcaaatcttcactgctaaatattcttaatggattgtctgttccaacagaaggatcagttaccatctataataaaaatctctctgaaatgcaagacttggaggaaatcagaaagataactggcgtctgtcctcaattcaatgttcaatttgacatactcaccgtgaaggaaaacctcagcctgtttgctaaaataaaagggattcatctaaaggaagtggaacaagaggtacaacgaatattattggaattggacatgcaaaacattcaagataaccttgctaaacatttaagtgaaggacagaaaagaaagctgacttttgggattaccattttaggagatcctcaaattttgcttttagatgaaccaactactggattggatcccttttccagagatcaagtgtggagcctcctgagagagcgtagagcagatcatgtgatccttttcagtacccagtccatggatgaggctgacatcctggctgatagaaaagtgatcatgtccaatgggagactgaagtgtgcaggttcttctatgtttttgaaaagaaggtggggtcttggatatcacctaagtttacataggaatgaaatatgtaacccagaacaaataacatccttcattactcatcacatccccgatgctaaattaaaaacagaaaacaaagaaaagcttgtatatactttgccactggaaaggacaaatacatttccagatcttttcagtgatctggataagtgttctgaccagggagtgacaggttatgacatttccatgtcaactctaaatgaagtctttatgaaactggaaggacagtcaactatcgaacaagatttcgaacaagtggagatgataagagactcagaaagcctcaatgaaatggagctggctcactcttccttctctgaaatgcagacagctgtgagtgacatgggcctctggagaatgcaagtctttgccatggcacggctccgtttcttaaagttaaaacgtcaaactaaagtgttattgaccctattattggtatttggaatcgcaatattccctttgattgttgaaaatataatgtatgctatgttaaatgaaaagatcgattgggaatttaaaaacgaattgtattttctctctcctggacaacttccccaggaaccccgtaccagcctgttgatcatcaataacacagaatcaaatattgaagattttataaaatcactgaagcatcaaaatatacttttggaagtagatgactttgaaaacagaaatggtactgatggcctctcatacaatggagctatcatagtttctggtaaacaaaaggattatagattttcagttgtgtgtaataccaagagattgcactgttttccaattcttatgaatattatcagcaatgggctacttcaaatgtttaatcacacacaacatattcgaattgagtcaagcccatttcctcttagccacataggactctggactgggttgccggatggttcctttttcttatttttggttctatgtagcatttctccttatatcaccatgggcagcatcagtgattacaagaaaaatgctaagtcccagctatggatttcaggcctctacacttctgcttactggtgtgggcaggcactagtggacgtcagcttcttcattttaattctccttttaatgtatttaattttctacatagaaaacatgcagtaccttcttattacaagccaaattgtgtttgctttggttatagttactcctggttatgcagcttctcttgtcttcttcatatatatgatatcatttatttttcgcaaaaggagaaaaaacagtggcctttggtcattttacttcttttttgcctccaccatcatgttttccatcactttaatcaatcattttgacctaagtatattgattaccaccatggtattggttccttcatataccttgcttggatttaaaacttttttggaagtgagagaccaggagcactacagagaatttccagaggcaaattttgaattgagtgccactgattttctagtctgcttcataccctactttcagactttgctattcgtttttgttctaagatgcatggaactaaaatgtggaaagaaaagaatgcgaaaagatcctgttttcagaatttccccccaaagtagagatgctaagccaaatccagaagaacccatagatgaagatgaagatattcaaacagaaagaataagaacagccactgctctgaccacttcaatcttagatgagaaacctgttataattgccagctgtctacacaaagaatatgcaggccagaagaaaagttgcttttcaaagaggaagaagaaaatagcagcaagaaatatctctttctgtgttcaagaaggtgaaattttgggattgctaggacccaatggtgctggaaaaagttcatctattagaatgatatctgggatcacaaagccaactgctggagaggtggaactgaaaggctgcagttcagttttgggccacctggggtactgccctcaagagaacgtgctgtggcccatgctgacgttgagggaacacctggaggtgtatgctgccgtcaaggggctcaggaaagcggacgcgaggctcgccatcgcaagattagtgagtgctttcaaactgcatgagcagctgaatgttcctgtgcagaaattaacagcaggaatcacgagaaagttgtgttttgtgctgagcctcctgggaaactcacctgtcttgctcctggatgaaccatctacgggcatagaccccacagggcagcagcaaatgtggcaggcaatccaggcagtcgttaaaaacacagagagaggtgtcctcctgaccacccataacctggctgaggcggaagccttgtgtgaccgtgtggccatcatggtgtctggaaggcttagatgcattggctccatccaacacctgaaaaacaaacttggcaaggattacattctagagctaaaagtgaaggaaacgtctcaagtgactttggtccacactgagattctgaagcttttcccacaggctgcagggcaggaaaggtattcctctttgttaacctataagctgcccgtggcagacgtttaccctctatcacagacctttcacaaattagaagcagtgaagcataactttaacctggaagaatacagcctttctcagtgcacactggagaaggtattcttagagctttctaaagaacaggaagtaggaaattttgatgaagaaattgatacaacaatgagatggaaactcctccctcattcagatgaaccttaaaacctcaaacctagtaattttttgttgatctcctataaactcatgttttatgtaataattaatagtatgtttaattttaaagatcatttaaaattaacatcaggtatattttgtaaatttagttaacaaatacataaattttaaaattattcttcctctcaaacataggggtgatagcaaacctgtgataaaggcaatacaaaatattagtaaagtcacccaaagagtcaggcactgggtattgtggaaataaaactatataaacttagaa

SEQ ID NO: 110064 - DNA, 1511 bp, Homo sapiens
  Payload ID: 1606
  Gene Symbol: ABCA6
  Gene Name: ATP-binding cassette, sub-family A (ABC1), member 6
  Uniprot ID: Q8N139
  ENST ID: ENST00000590645
  CDS Start-End: 190-747
aggctgtgtaagagctgctggagtaggcacccatttaaagaaaaaatgaagaagcagcaataaagaagttgtaatcgttacctagacaaacagagaactggttttgacagtgtttctagagtgctttttattattttcctgacagttgtgttccaccatgattactttctccttcagcgaataggctaaatgaatatgaaacagaaaagcgtgtatcagcaaaccaaagcacttctgtgcaagaattttcttaagaaatggaggatgaaaagagagagcttattggaatggggcctctcaatacttctaggactgtgtattgctctgttttccagttccatgagaaatgtccagtttcctggaatggctcctcagaatctgggaagggtagataaatttaatagctcttctttaatggttgtgtatacaccaatatctaatttaacccagcagataatgaataaaacagcacttgctcctcttttgaaaggaacaagtgtcattggggcaccaaataaaacacacatggacgaaatacttctggaaaatttaccatatgctatgggaatcatctttaatgaaactttctcttataagttaatatttttccagggatataacagtccactttggaaagaagatttctcaggtgactttccatatcaaatatcattatggaatttttcatgttttcaacataaagaacagaggaggttgggcaacagagatgctttcaatgacacatgagaaaacagggaaagcccatttcattgctgaacttatttcaaggtcaatcgtatgttcctactacaggatgactgcaaaaattgtagagtcatccaacatatatgtgttgagcatgcagatgcatgtgtcaaaggacacatgagtaaccaagactgacaggccccagcctcaggtgagattccaggttagcagcaaagacagacattgaacaattaatgacaagtacaagaaaaagtgtttcatgggcacttagaccaggggttcctaatagtgggattagagaagtcctacctggggaaatgatgtttaaagggagaccagaatgaatagcaggtgtgaggtgctagaagcattgtgtttcagatagaagaaaggtaattgtgaagaccctgaggtgagaaaggacatctgttcctagatctggaagaagagcagtatagctgaacaaggaacatgaaaaggaatgtaatgggagagtgaagctgaagtcactcaagtgctacctcctgtggcatcttgtaaacctaggcaaggaatagccactgagtcactttaatcacggcaaaagtgtaattcggtttccaaaattaggggaacactccagatatagcccggggaatagattgccaagaggctatggagaatgtcaagaaacaaggagtccattatggctggagcagagtgtttgctttcatctcctttttattttctaagactttctaagcatgctgtggtctgcaagaataaaattgctttattaaaaa

SEQ ID NO: 110065 - DNA, 6816 bp, Homo sapiens
  Payload ID: 1607
  Gene Symbol: ABCA7
  Gene Name: ATP-binding cassette, sub-family A (ABC1), member 7
  Uniprot ID: Q8IZY2
  ENST ID: ENST00000263094
  CDS Start-End: 232-6672
gggcaagctcagcgcacttggcttaaggggcggcgcgctccctgcctgctgctgggcggagggaaggcggcaagagctgcggagcccctggaagagcttccaggaaccctgcgctgtgggataaaggaatgaggttcagaaaggggcagggagttgcccgcagccgcaccgcacgtcttcagcccgaccgttgtcctgacctctctgtcccgtcccctgcccagtctcaccatggccttctggacacagctgatgctgctgctctggaagaatttcatgtatcgccggagacagccggtccagctcctggtcgaattgctgtggcctctcttcctcttcttcatcctggtggctgttcgccactcccacccgcccctggagcaccatgaatgccacttcccaaacaagccactgccatcggcgggcaccgtgccctggctccagggtctcatctgtaatgtgaacaacacctgctttccgcagctgacaccgggcgaggagcccgggcgcctgagcaacttcaacgactccctggtctcccggctgctagccgatgcccgcactgtgctgggaggggccagtgcccacaggacgctggctggcctagggaagctgatcgccacgctgagggctgcacgcagcacggcccagcctcaaccaaccaagcagtctccactggaaccacccatgctggatgtcgcggagctgctgacgtcactgctgcgcacggaatccctggggttggcactgggccaagcccaggagcccttgcacagcttgttggaggccgctgaggacctggcccaggagctcctggcgctgcgcagcctggtggagcttcgggcactgctgcagagaccccgagggaccagcggccccctggagttgctgtcagaggccctctgcagtgtcaggggacctagcagcacagtgggcccctccctcaactggtacgaggctagtgacctgatggagctggtggggcaggagccagaatccgccctgccagacagcagcctgagccccgcctgctcggagctgattggagccctggacagccacccgctgtcccgcctgctctggagacgcctgaagcctctgatcctcgggaagctactctttgcaccagatacaccttttacccggaagctcatggcccaggtgaaccggaccttcgaggagctcaccctgctgagggatgtccgggaggtgtgggagatgctgggaccccggatcttcaccttcatgaacgacagttccaatgtggccatgctgcagcggctcctgcagatgcaggatgaaggaagaaggcagcccagacctggaggccgggaccacatggaggccctgcgatcctttctggaccctgggagcggtggctacagctggcaggacgcacacgctgatgtggggcacctggtgggcacgctgggccgagtgacggagtgcctgtccttggacaagctggaggcggcaccctcagaggcagccctggtgtcgcgggccctgcaactgctcgcggaacatcgattctgggccggcgtcgtcttcttgggacctgaggactcttcagaccccacagagcacccaaccccagacctgggccccggccacgtgcgcatcaaaatccgcatggacattgacgtggtcacgaggaccaataagatcagggacaggttttgggaccctggcccagccgcggaccccctgaccgacctgcgctacgtgtggggcggcttcgtgtacctgcaagacctggtggagcgtgcagccgtccgcgtgctcagcggcgccaacccccgggccggcctctacctgcagcagatgccctatccgtgctatgtggacgacgtgttcctgcgtgtgctgagccggtcgctgccgctcttcctgacgctggcctggatctactccgtgacactgacagtgaaggccgtggtgcgggagaaggagacgcggctgcgggacaccatgcgcgccatggggctcagccgcgcggtgctctggctaggctggttcctcagctgcctcgggcccttcctgctcagcgccgcactgctggttctggtgctcaagctgggagacatcctcccctacagccacccgggcgtggtcttcctgttcttggcagccttcgcggtggccacggtgacccagagcttcctgctcagcgccttcttctcccgcgccaacctggctgcggcctgcggcggcctggcctacttctccctctacctgccctacgtgctgtgtgtggcttggcgggaccggctgcccgcgggtggccgcgtggccgcgagcctgctgtcgcccgtggccttcggcttcggctgcgagagcctggctctgctggaggagcagggcgagggcgcgcagtggcacaacgtgggcacccggcctacggcagacgtcttcagcctggcccaggtctctggccttctgctgctggacgcggcgctctacggcctcgccacctggtacctggaagctgtgtgcccaggccagtacgggatccctgaaccatggaattttccttttcggaggagctactggtgcggacctcggccccccaagagtccagccccttgccccaccccgctggacccaaaggtgctggtagaagaggcaccgcccggcctgagtcctggcgtctccgttcgcagcctggagaagcgctttcctggaagcccgcagccagccctgcgggggctcagcctggacttctaccagggccacatcaccgccttcctgggccacaacggggccggcaagaccaccaccctgtccatcttgagtggcctcttcccacccagtggtggctctgccttcatcctgggccacgacgtccgctccagcatggccgccatccggccccacctgggcgtctgtcctcagtacaacgtgctgtttgacatgctgaccgtggacgagcacgtctggttctatgggcggctgaagggtctgagtgccgctgtagtgggccccgagcaggaccgtctgctgcaggatgtggggctggtctccaagcagagtgtgcagactcgccacctctctggtgggatgcaacggaagctgtccgtggccattgcctttgtgggcggctcccaagttgttatcctggacgagcctacggctggcgtggatcctgcttcccgccgcggtatttgggagctgctgctcaaataccgagaaggtcgcacgctgatcctctccacccaccacctggatgaggcagagctgctgggagaccgtgtggccgtggtggcaggtggccgcttgtgctgctgtggctccccactcttcctgcgccgtcacctgggctccggctactacctgacgctggtgaaggcccgcctgcccctgaccaccaatgagaaggctgacactgacatggagggcagtgtggacaccaggcaggaaaagaagaatggcagccagggcagcagagtcggcactcctcagctgctggccctggtacagcactgggtgcccggggcacggctggtggaggagctgccacacgagctggtgctggtgctgccctacacgggtgcccatgacggcagcttcgccacactcttccgagagctagacacgcggctggcggagctgaggctcactggctacgggatctccgacaccagcctcgaggagatcttcctgaaggtggtggaggagtgtgctgcggacacagatatggaggatggcagctgcgggcagcacctatgcacaggcattgctggcctagacgtaaccctacggctcaagatgccgccacaggagacagcgctggagaacggggaaccagctgggtcagccccagagactgaccagggctctgggccagacgccgtgggccgggtacagggctgggcactgacccgccagcagctccaggccctgcttctcaagcgctttctgcttgcccgccgcagccgccgcggcctgttcgcccagatcgtgctgcctgccctctttgtgggcctggccctcgtgttcagcctcatcgtgcctcctttcgggcactacccggctctgcggctcagtcccaccatgtacggtgctcaggtgtccttcttcagtgaggacgccccaggggaccctggacgtgcccggctgctcgaggcgctgctgcaggaggcaggactggaggagcccccagtgcagcatagctcccacaggttctcggcaccagaagttcctgctgaagtggccaaggtcttggccagtggcaactggaccccagagtctccatccccagcctgccagtgtagccggcccggtgcccggcgcctgctgcccgactgcccggctgcagctggtggtccccctccgccccaggcagtgaccggctctggggaagtggttcagaacctgacaggccggaacctgtctgacttcctggtcaagacctacccgcgcctggtgcgccagggcctgaagactaagaagtgggtgaatgaggtcagatacggaggcttctcgctggggggccgagacccaggcctgccctcgggccaagagttgggccgctcagtggaggagttgtgggcgctgctgagtcccctgcctggcggggccctcgaccgtgtcctgaaaaacctcacagcctgggctcacagcctggatgctcaggacagtctcaagatctggttcaacaacaaaggctggcactccatggtggcctttgtcaaccgagccagcaacgcaatcctccgtgctcacctgcccccaggcccggcccgccacgcccacagcatcaccacactcaaccaccccttgaacctcaccaaggagcagctgtctgagggtgcactgatggcctcctcggtggacgtcctcgtctccatctgtgtggtctttgccatgtcctttgtcccggccagcttcactcttgtcctcattgaggagcgagtcacccgagccaagcacctgcagctcatggggggcctgtcccccaccctctactggcttggcaactttctctgggacatgtgtaactacttggtgccagcatgcatcgtggtgctcatctttctggccttccagcagagggcatatgtggcccctgccaacctgcctgctctcctgctgttgctactactgtatggctggtcgatcacaccgctcatgtacccagcctccttcttcttctccgtgcccagcacagcctatgtggtgctcacctgcataaacctctttattggcatcaatggaagcatggccacctttgtgcttgagctcttctctgatcagaagctgcaggaggtgagccggatcttgaaacaggtcttccttatcttcccccacttctgcttgggccgggggctcattgacatggtgcggaaccaggccatggctgatgcctttgagcgcttgggagacaggcagttccagtcacccctgcgctgggaggtggtcggcaagaacctcttggccatggtgatacaggggcccctcttccttctcttcacactactgctgcagcaccgaagccaactcctgccacagcccagggtgaggtctctgccactcctgggagaggaggacgaggatgtagcccgtgaacgggagcgggtggtccaaggagccacccagggggatgtgttggtgctgaggaacttgaccaaggtataccgtgggcagaggatgccagctgttgaccgcttgtgcctggggattccccctggtgagtgttttgggctgctgggtgtgaatggagcagggaagacgtccacgtttcgcatggtgacgggggacacattggccagcaggggcgaggctgtgctggcaggccacagcgtggcccgggaacccagtgctgcgcacctcagcatgggatactgccctcaatccgatgccatctttgagctgctgacgggccgcgagcacctggagctgcttgcgcgcctgcgcggtgtcccggaggcccaggttgcccagaccgctggctcgggcctggcgcgtctgggactctcatggtacgcagaccggcctgcaggcacctacagcggagggaacaaacgcaagctggcgacggccctggcgctggttggggacccagccgtggtgtttctggacgagccgaccacaggcatggaccccagcgcgcggcgcttcctttggaacagccttttggccgtggtgcgggagggccgttcagtgatgctcacctcccatagcatggaggagtgtgaagcgctctgctcgcgcctggccatcatggtgaatgggcggttccgctgcctgggcagcccgcaacatctcaagggcagattcgcggcgggtcacacactgaccctgcgggtgcccgccgcaaggtcccagccggcagcggccttcgtggcggccgagttccctggggcggagctgcgcgaggcacatggaggccgcctgcgcttccagctgccgccgggagggcgctgcgccctggcgcgcgtctttggagagctggcggtgcacggcgcagagcacggcgtggaggacttttccgtgagccagacgatgctggaggaggtattcttgtacttctccaaggaccaggggaaggacgaggacaccgaagagcagaaggaggcaggagtgggagtggaccccgcgccaggcctgcagcaccccaaacgcgtcagccagttcctcgatgaccctagcactgccgagactgtgctctgagcctccctcccctgcggggccgcggggaggccctgggaatggcaagggcaaggtagagtgcctaggagccctggactcaggctggcagaggggctggtgccctggagaaaataaagagaaggctggagagaagccgtggtggtg

SEQ ID NO: 110066 - DNA, 6704 bp, Homo sapiens
  Payload ID: 1607
  Gene Symbol: ABCA7
  Gene Name: ATP-binding cassette, sub-family A (ABC1), member 7
  Uniprot ID: Q8IZY2
  ENST ID: ENST00000433129
  CDS Start-End: 117-6557
gtgggataaaggaatgaggttcagaaaggggcagggagttgcccgcagccgcaccgcacgtcttcagcccgaccgttgtcctgacctctctgtcccgtcccctgcccagtctcaccatggccttctggacacagctgatgctgctgctctggaagaatttcatgtatcgccggagacagccggtccagctcctggtcgaattgctgtggcctctcttcctcttcttcatcctggtggctgttcgccactcccacccgcccctggagcaccatgaatgccacttcccaaacaagccactgccatcggcgggcaccgtgccctggctccagggtctcatctgtaatgtgaacaacacctgctttccgcagctgacaccgggcgaggagcccgggcgcctgagcaacttcaacgactccctggtctcccggctgctagccgatgcccgcactgtgctgggaggggccagtgcccacaggacgctggctggcctagggaagctgatcgccacgctgagggctgcacgcagcacggcccagcctcaaccaaccaagcagtctccactggaaccacccatgctggatgtcgcggagctgctgacgtcactgctgcgcacggaatccctggggttggcactgggccaagcccaggagcccttgcacagcttgttggaggccgctgaggacctggcccaggagctcctggcgctgcgcagcctggtggagcttcgggcactgctgcagagaccccgagggaccagcggccccctggagttgctgtcagaggccctctgcagtgtcaggggacctagcagcacagtgggcccctccctcaactggtacgaggctagtgacctgatggagctggtggggcaggagccagaatccgccctgccagacagcagcctgagccccgcctgctcggagctgattggagccctggacagccacccgctgtcccgcctgctctggagacgcctgaagcctctgatcctcgggaagctactctttgcaccagatacaccttttacccggaagctcatggcccaggtgaaccggaccttcgaggagctcaccctgctgagggatgtccgggaggtgtgggagatgctgggaccccggatcttcaccttcatgaacgacagttccaatgtggccatgctgcagcggctcctgcagatgcaggatgaaggaagaaggcagcccagacctggaggccgggaccacatggaggccctgcgatcctttctggaccctgggagcggtggctacagctggcaggacgcacacgctgatgtggggcacctggtgggcacgctgggccgagtgacggagtgcctgtccttggacaagctggaggcggcaccctcagaggcagccctggtgtcgcgggccctgcaactgctcgcggaacatcgattctgggccggcgtcgtcttcttgggacctgaggactcttcagaccccacagagcacccaaccccagacctgggccccggccacgtgcgcatcaaaatccgcatggacattgacgtggtcacgaggaccaataagatcagggacaggttttgggaccctggcccagccgcggaccccctgaccgacctgcgctacgtgtggggcggcttcgtgtacctgcaagacctggtggagcgtgcagccgtccgcgtgctcagcggcgccaacccccgggccggcctctacctgcagcagatgccctatccgtgctatgtggacgacgtgttcctgcgtgtgctgagccggtcgctgccgctcttcctgacgctggcctggatctactccgtgacactgacagtgaaggccgtggtgcgggagaaggagacgcggctgcgggacaccatgcgcgccatggggctcagccgcgcggtgctctggctaggctggttcctcagctgcctcgggcccttcctgctcagcgccgcactgctggttctggtgctcaagctgggagacatcctcccctacagccacccgggcgtggtcttcctgttcttggcagccttcgcggtggccacggtgacccagagcttcctgctcagcgccttcttctcccgcgccaacctggctgcggcctgcggcggcctggcctacttctccctctacctgccctacgtgctgtgtgtggcttggcgggaccggctgcccgcgggtggccgcgtggccgcgagcctgctgtcgcccgtggccttcggcttcggctgcgagagcctggctctgctggaggagcagggcgagggcgcgcagtggcacaacgtgggcacccggcctacggcagacgtcttcagcctggcccaggtctctggccttctgctgctggacgcggcgctctacggcctcgccacctggtacctggaagctgtgtgcccaggccagtacgggatccctgaaccatggaattttccttttcggaggagctactggtgcggacctcggccccccaagagtccagccccttgccccaccccgctggacccaaaggtgctggtagaagaggcaccgcccggcctgagtcctggcgtctccgttcgcagcctggagaagcgctttcctggaagcccgcagccagccctgcgggggctcagcctggacttctaccagggccacatcaccgccttcctgggccacaacggggccggcaagaccaccaccctgtccatcttgagtggcctcttcccacccagtggtggctctgccttcatcctgggccacgacgtccgctccagcatggccgccatccggccccacctgggcgtctgtcctcagtacaacgtgctgtttgacatgctgaccgtggacgagcacgtctggttctatgggcggctgaagggtctgagtgccgctgtagtgggccccgagcaggaccgtctgctgcaggatgtggggctggtctccaagcagagtgtgcagactcgccacctctctggtgggatgcaacggaagctgtccgtggccattgcctttgtgggcggctcccaagttgttatcctggacgagcctacggctggcgtggatcctgcttcccgccgcggtatttgggagctgctgctcaaataccgagaaggtcgcacgctgatcctctccacccaccacctggatgaggcagagctgctgggagaccgtgtggccgtggtggcaggtggccgcttgtgctgctgtggctccccactcttcctgcgccgtcacctgggctccggctactacctgacgctggtgaaggcccgcctgcccctgaccaccaatgagaaggctgacactgacatggagggcagtgtggacaccaggcaggaaaagaagaatggcagccagggcagcagagtcggcactcctcagctgctggccctggtacagcactgggtgcccggggcacggctggtggaggagctgccacacgagctggtgctggtgctgccctacacgggtgcccatgacggcagcttcgccacactcttccgagagctagacacgcggctggcggagctgaggctcactggctacgggatctccgacaccagcctcgaggagatcttcctgaaggtggtggaggagtgtgctgcggacacagatatggaggatggcagctgcgggcagcacctatgcacaggcattgctggcctagacgtaaccctacggctcaagatgccgccacaggagacagcgctggagaacggggaaccagctgggtcagccccagagactgaccagggctctgggccagacgccgtgggccgggtacagggctgggcactgacccgccagcagctccaggccctgcttctcaagcgctttctgcttgcccgccgcagccgccgcggcctgttcgcccagatcgtgctgcctgccctctttgtgggcctggccctcgtgttcagcctcatcgtgcctcctttcgggcactacccggctctgcggctcagtcccaccatgtacggtgctcaggtgtccttcttcagtgaggacgccccaggggaccctggacgtgcccggctgctcgaggcgctgctgcaggaggcaggactggaggagcccccagtgcagcatagctcccacaggttctcggcaccagaagttcctgctgaagtggccaaggtcttggccagtggcaactggaccccagagtctccatccccagcctgccagtgtagccggcccggtgcccggcgcctgctgcccgactgcccggctgcagctggtggtccccctccgccccaggcagtgaccggctctggggaagtggttcagaacctgacaggccggaacctgtctgacttcctggtcaagacctacccgcgcctggtgcgccagggcctgaagactaagaagtgggtgaatgaggtcagatacggaggcttctcgctggggggccgagacccaggcctgccctcgggccaagagttgggccgctcagtggaggagttgtgggcgctgctgagtcccctgcctggcggggccctcgaccgtgtcctgaaaaacctcacagcctgggctcacagcctggatgctcaggacagtctcaagatctggttcaacaacaaaggctggcactccatggtggcctttgtcaaccgagccagcaacgcaatcctccgtgctcacctgcccccaggcccggcccgccacgcccacagcatcaccacactcaaccaccccttgaacctcaccaaggagcagctgtctgagggtgcactgatggcctcctcggtggacgtcctcgtctccatctgtgtggtctttgccatgtcctttgtcccggccagcttcactcttgtcctcattgaggagcgagtcacccgagccaagcacctgcagctcatggggggcctgtcccccaccctctactggcttggcaactttctctgggacatgtgtaactacttggtgccagcatgcatcgtggtgctcatctttctggccttccagcagagggcatatgtggcccctgccaacctgcctgctctcctgctgttgctactactgtatggctggtcgatcacaccgctcatgtacccagcctccttcttcttctccgtgcccagcacagcctatgtggtgctcacctgcataaacctctttattggcatcaatggaagcatggccacctttgtgcttgagctcttctctgatcagaagctgcaggaggtgagccggatcttgaaacaggtcttccttatcttcccccacttctgcttgggccgggggctcattgacatggtgcggaaccaggccatggctgatgcctttgagcgcttgggagacaggcagttccagtcacccctgcgctgggaggtggtcggcaagaacctcttggccatggtgatacaggggcccctcttccttctcttcacactactgctgcagcaccgaagccaactcctgccacagcccagggtgaggtctctgccactcctgggagaggaggacgaggatgtagcccgtgaacgggagcgggtggtccaaggagccacccagggggatgtgttggtgctgaggaacttgaccaaggtataccgtgggcagaggatgccagctgttgaccgcttgtgcctggggattccccctggtgagtgttttgggctgctgggtgtgaatggagcagggaagacgtccacgtttcgcatggtgacgggggacacattggccagcaggggcgaggctgtgctggcaggccacagcgtggcccgggaacccagtgctgcgcacctcagcatgggatactgccctcaatccgatgccatctttgagctgctgacgggccgcgagcacctggagctgcttgcgcgcctgcgcggtgtcccggaggcccaggttgcccagaccgctggctcgggcctggcgcgtctgggactctcatggtacgcagaccggcctgcaggcacctacagcggagggaacaaacgcaagctggcgacggccctggcgctggttggggacccagccgtggtgtttctggacgagccgaccacaggcatggaccccagcgcgcggcgcttcctttggaacagccttttggccgtggtgcgggagggccgttcagtgatgctcacctcccatagcatggaggagtgtgaagcgctctgctcgcgcctggccatcatggtgaatgggcggttccgctgcctgggcagcccgcaacatctcaagggcagattcgcggcgggtcacacactgaccctgcgggtgcccgccgcaaggtcccagccggcagcggccttcgtggcggccgagttccctggggcggagctgcgcgaggcacatggaggccgcctgcgcttccagctgccgccgggagggcgctgcgccctggcgcgcgtctttggagagctggcggtgcacggcgcagagcacggcgtggaggacttttccgtgagccagacgatgctggaggaggtattcttgtacttctccaaggaccaggggaaggacgaggacaccgaagagcagaaggaggcaggagtgggagtggaccccgcgccaggcctgcagcaccccaaacgcgtcagccagttcctcgatgaccctagcactgccgagactgtgctctgagcctccctcccctgcggggccgcggggaggccctgggaatggcaagggcaaggtagagtgcctaggagccctggactcaggctggcagaggggctggtgccctggagaaaataaagagaaggctggagagaagccgtggtggtgaaa

SEQ ID NO: 110067 - DNA, 576 bp, Homo sapiens
  Payload ID: 1607
  Gene Symbol: ABCA7
  Gene Name: ATP-binding cassette, sub-family A (ABC1), member 7
  ENST ID: ENST00000524850
  CDS Start-End: 85-576
ttggcttaaggggcggcgcgctccctgcctgctgctgggcggagggaaggcggcaagagctgcggagcccctggaagtctcaccatggccttctggacacagctgatgctgctgctctggaagaatttcatgtatcgccggagacagccggtccagctcctggtcgaattgctgtggcctctcttcctcttcttcatcctggtggctgttcgccactcccacccgcccctggagcaccatgaatgccacttcccaaacaagccactgccatcggcgggcaccgtgccctggctccagggtctcatctgtaatgtgaacaacacctgctttccgcagctgacaccgggcgaggagcccgggcgcctgagcaacttcaacgactccctggtctcccggctgctagccgatgcccgcactgtgctgggaggggccagtgcccacaggacgctggctggcctagggaagctgatcgccacgctgagggctgcacgcagcacggcccagcctcaaccaaccaagcagtctccactggaaccacccatgctggatgtcgcggagctgctgacgtcactgctg

SEQ ID NO: 110068 - DNA, 1918 bp, Homo sapiens
  Payload ID: 1607
  Gene Symbol: ABCA7
  Gene Name: ATP-binding cassette, sub-family A (ABC1), member 7
  ENST ID: ENST00000525073
  CDS Start-End: 1-1774
ctccatctgtgtggtctttgccatgtcctttgtcccggccagcttcactcttgtcctcattgaggagcgagtcacccgagccaagcacctgcagctcatggggggcctgtcccccaccctctactggcttggcaactttctctgggacatgtgtaactacttggtgccagcatgcatcgtggtgctcatctttctggccttccagcagagggcatatgtggcccctgccaacctgcctgctctcctgctgttgctactactgtatggcacagcctatgtggtgctcacctgcataaacctctttattggcatcaatggaagcatggccacctttgtgcttgagctcttctctgatcagaagctgcaggaggtgagccggatcttgaaacaggtcttccttatcttcccccacttctgcttgggccgggggctcattgacatggtgcggaaccaggccatggctgatgcctttgagcgcttgggagacaggcagttccagtcacccctgcgctgggaggtggtcggcaagaacctcttggccatggtgatacaggggcccctcttccttctcttcacactactgctgcagcaccgaagccaactcctgccacagcccagggtgaggtctctgccactcctgggagaggaggacgaggatgtagcccgtgaacgggagcgggtggtccaaggagccacccagggggatgtgttggtgctgaggaacttgaccaaggtataccgtgggcagaggatgccagctgttgaccgcttgtgcctggggattccccctggtgagtgttttgggctgctgggtgtgaatggagcagggaagacgtccacgtttcgcatggtgacgggggacacattggccagcaggggcgaggctgtgctggcaggccacagcgtggcccgggaacccagtgctgcgcacctcagcatgggatactgccctcaatccgatgccatctttgagctgctgacgggccgcgagcacctggagctgcttgcgcgcctgcgcggtgtcccggaggcccaggttgcccagaccgctggctcgggcctggcgcgtctgggactctcatggtacgcagaccggcctgcaggcacctacagcggagggaacaaacgcaagctggcgacggccctggcgctggttggggacccagccgtggtgtttctggacgagccgaccacaggcatggaccccagcgcgcggcgcttcctttggaacagccttttggccgtggtgcgggagggccgttcagtgatgctcacctcccatagcatggaggagtgtgaagcgctctgctcgcgcctggccatcatggtgaatgggcggttccgctgcctgggcagcccgcaacatctcaagggcagattcgcggcgggtcacacactgaccctgcgggtgcccgccgcaaggtcccagccggcagcggccttcgtggcggccgagttccctggggcggagctgcgcgaggcacatggaggccgcctgcgcttccagctgccgccgggagggcgctgcgccctggcgcgcgtctttggagagctggcggtgcacggcgcagagcacggcgtggaggacttttccgtgagccagacgatgctggaggaggtattcttgtacttctccaaggaccaggggaaggacgaggacaccgaagagcagaaggaggcaggagtgggagtggaccccgcgccaggcctgcagcaccccaaacgcgtcagccagttcctcgatgaccctagcactgccgagactgtgctctgagcctccctcccctgcggggccgcggggaggccctgggaatggcaagggcaaggtagagtgcctaggagccctggactcaggctggcagaggggctggtgccctggagaaaataaagagaaggctggagagaagccgtggtggtg

SEQ ID NO: 110069 - DNA, 569 bp, Homo sapiens
  Payload ID: 1607
  Gene Symbol: ABCA7
  Gene Name: ATP-binding cassette, sub-family A (ABC1), member 7
  ENST ID: ENST00000531467
  CDS Start-End: 161-569
actgtttgcctcgctctaatcagagcttccaggaaccctgcgctgtgggataaaggaatgaggttcagaaaggggcagggagttgcccgcagccgcaccgcacgtcttcagcccgaccgttgtcctgacctctctgtcccgtcccctgcccagtctcaccatggccttctggacacagctgatgctgctgctctggaagaatttcatgtatcgccggagacagccgctcctggtcgaattgctgtggcctctcttcctcttcttcatcctggtggctgttcgccactcccacccgcccctggagcaccatgaatgccacttcccaaacaagccactgccatcggcgggcaccgtgccctggctccagggtctcatctgtaatgtgaacaacacctgctttccgcagctgacaccgggcgaggagcccgggcgcctgagcaacttcaacgactccctggtctcccggctgctagccgatgcccgcactgtgctgggaggggccagtgcccacaggacgctggctggcctagggaagctgatcgccacgctgagggctgcacgcagcacgg

SEQ ID NO: 110070 - DNA, 571 bp, Homo sapiens
  Payload ID: 1607
  Gene Symbol: ABCA7
  Gene Name: ATP-binding cassette, sub-family A (ABC1), member 7
  ENST ID: ENST00000530092
  CDS Start-End: 1-187
gccacaggagacagcgctggagaacggggaaccagctgggtcagccccagagactgaccagggctctgggccagacgccgtgggccgggtacagggctgggcactgacccgccagcagctccaggccctgcttctcaagcgctttctgcttgcccgccgcagccgccgcggcctgttcgcccagtgaggacgccccaggggaccctggacgtgcccggctgctcgaggcgctgctgcaggaggcaggactggaggagcccccagtgcagcatagctcccacaggttctcggcaccagaagttcctgctgaagtggccaaggtcttggccagtggcaactggaccccagagtctccatccccagcctgccagtgtagccggcccggtgcccggcgcctgctgcccgactgcccggctgcagctggtggtccccctccgccccaggcagtgaccggctctggggaagtggttcagaacctgacaggccggaacctgtctgacttcctggtcaagacctacccgcgcctggtgcgccagggcctgaagactaagaagtgggtgaatgaggtcag

SEQ ID NO: 110071 - DNA, 6211 bp, Homo sapiens
  Payload ID: 1607
  Gene Symbol: ABCA7
  Gene Name: ATP-binding cassette, sub-family A (ABC1), member 7
  Uniprot ID: Q8IZY2
  ENST ID: ENST00000435683
  CDS Start-End: 38-6064
tcagtttccctatttgtaaagtgggggctatgatagtatggtctgcctgggaactggccagagcgctggacccctagtgagtgttcaaaatcattgtcccccttgtggtctttctccccaggaatccctggggttggcactgggccaagcccaggagcccttgcacagcttgttggaggccgctgaggacctggcccaggagctcctggcgctgcgcagcctggtggagcttcgggcactgctgcagagaccccgagggaccagcggccccctggagttgctgtcagaggccctctgcagtgtcaggggacctagcagcacagtgggcccctccctcaactggtacgaggctagtgacctgatggagctggtggggcaggagccagaatccgccctgccagacagcagcctgagccccgcctgctcggagctgattggagccctggacagccacccgctgtcccgcctgctctggagacgcctgaagcctctgatcctcgggaagctactctttgcaccagatacaccttttacccggaagctcatggcccaggtgaaccggaccttcgaggagctcaccctgctgagggatgtccgggaggtgtgggagatgctgggaccccggatcttcaccttcatgaacgacagttccaatgtggccatgctgcagcggctcctgcagatgcaggatgaaggaagaaggcagcccagacctggaggccgggaccacatggaggccctgcgatcctttctggaccctgggagcggtggctacagctggcaggacgcacacgctgatgtggggcacctggtgggcacgctgggccgagtgacggagtgcctgtccttggacaagctggaggcggcaccctcagaggcagccctggtgtcgcgggccctgcaactgctcgcggaacatcgattctgggccggcgtcgtcttcttgggacctgaggactcttcagaccccacagagcacccaaccccagacctgggccccggccacgtgcgcatcaaaatccgcatggacattgacgtggtcacgaggaccaataagatcagggacaggttttgggaccctggcccagccgcggaccccctgaccgacctgcgctacgtgtggggcggcttcgtgtacctgcaagacctggtggagcgtgcagccgtccgcgtgctcagcggcgccaacccccgggccggcctctacctgcagcagatgccctatccgtgctatgtggacgacgtgttcctgcgtgtgctgagccggtcgctgccgctcttcctgacgctggcctggatctactccgtgacactgacagtgaaggccgtggtgcgggagaaggagacgcggctgcgggacaccatgcgcgccatggggctcagccgcgcggtgctctggctaggctggttcctcagctgcctcgggcccttcctgctcagcgccgcactgctggttctggtgctcaagctgggagacatcctcccctacagccacccgggcgtggtcttcctgttcttggcagccttcgcggtggccacggtgacccagagcttcctgctcagcgccttcttctcccgcgccaacctggctgcggcctgcggcggcctggcctacttctccctctacctgccctacgtgctgtgtgtggcttggcgggaccggctgcccgcgggtggccgcgtggccgcgagcctgctgtcgcccgtggccttcggcttcggctgcgagagcctggctctgctggaggagcagggcgagggcgcgcagtggcacaacgtgggcacccggcctacggcagacgtcttcagcctggcccaggtctctggccttctgctgctggacgcggcgctctacggcctcgccacctggtacctggaagctgtgtgcccaggccagtacgggatccctgaaccatggaattttccttttcggaggagctactggtgcggacctcggccccccaagagtccagccccttgccccaccccgctggacccaaaggtgctggtagaagaggcaccgcccggcctgagtcctggcgtctccgttcgcagcctggagaagcgctttcctggaagcccgcagccagccctgcgggggctcagcctggacttctaccagggccacatcaccgccttcctgggccacaacggggccggcaagaccaccaccctgtccatcttgagtggcctcttcccacccagtggtggctctgccttcatcctgggccacgacgtccgctccagcatggccgccatccggccccacctgggcgtctgtcctcagtacaacgtgctgtttgacatgctgaccgtggacgagcacgtctggttctatgggcggctgaagggtctgagtgccgctgtagtgggccccgagcaggaccgtctgctgcaggatgtggggctggtctccaagcagagtgtgcagactcgccacctctctggtgggatgcaacggaagctgtccgtggccattgcctttgtgggcggctcccaagttgttatcctggacgagcctacggctggcgtggatcctgcttcccgccgcggtatttgggagctgctgctcaaataccgagaaggtcgcacgctgatcctctccacccaccacctggatgaggcagagctgctgggagaccgtgtggccgtggtggcaggtggccgcttgtgctgctgtggctccccactcttcctgcgccgtcacctgggctccggctactacctgacgctggtgaaggcccgcctgcccctgaccaccaatgagaaggctgacactgacatggagggcagtgtggacaccaggcaggaaaagaagaatggcagccagggcagcagagtcggcactcctcagctgctggccctggtacagcactgggtgcccggggcacggctggtggaggagctgccacacgagctggtgctggtgctgccctacacgggtgcccatgacggcagcttcgccacactcttccgagagctagacacgcggctggcggagctgaggctcactggctacgggatctccgacaccagcctcgaggagatcttcctgaaggtggtggaggagtgtgctgcggacacagatatggaggatggcagctgcgggcagcacctatgcacaggcattgctggcctagacgtaaccctacggctcaagatgccgccacaggagacagcgctggagaacggggaaccagctgggtcagccccagagactgaccagggctctgggccagacgccgtgggccgggtacagggctgggcactgacccgccagcagctccaggccctgcttctcaagcgctttctgcttgcccgccgcagccgccgcggcctgttcgcccagatcgtgctgcctgccctctttgtgggcctggccctcgtgttcagcctcatcgtgcctcctttcgggcactacccggctctgcggctcagtcccaccatgtacggtgctcaggtgtccttcttcagtgaggacgccccaggggaccctggacgtgcccggctgctcgaggcgctgctgcaggaggcaggactggaggagcccccagtgcagcatagctcccacaggttctcggcaccagaagttcctgctgaagtggccaaggtcttggccagtggcaactggaccccagagtctccatccccagcctgccagtgtagccggcccggtgcccggcgcctgctgcccgactgcccggctgcagctggtggtccccctccgccccaggcagtgaccggctctggggaagtggttcagaacctgacaggccggaacctgtctgacttcctggtcaagacctacccgcgcctggtgcgccagggcctgaagactaagaagtgggtgaatgaggtcagatacggaggcttctcgctggggggccgagacccaggcctgccctcgggccaagagttgggccgctcagtggaggagttgtgggcgctgctgagtcccctgcctggcggggccctcgaccgtgtcctgaaaaacctcacagcctgggctcacagcctggatgctcaggacagtctcaagatctggttcaacaacaaaggctggcactccatggtggcctttgtcaaccgagccagcaacgcaatcctccgtgctcacctgcccccaggcccggcccgccacgcccacagcatcaccacactcaaccaccccttgaacctcaccaaggagcagctgtctgagggtgcactgatggcctcctcggtggacgtcctcgtctccatctgtgtggtctttgccatgtcctttgtcccggccagcttcactcttgtcctcattgaggagcgagtcacccgagccaagcacctgcagctcatggggggcctgtcccccaccctctactggcttggcaactttctctgggacatgtgtaactacttggtgccagcatgcatcgtggtgctcatctttctggccttccagcagagggcatatgtggcccctgccaacctgcctgctctcctgctgttgctactactgtatggctggtcgatcacaccgctcatgtacccagcctccttcttcttctccgtgcccagcacagcctatgtggtgctcacctgcataaacctctttattggcatcaatggaagcatggccacctttgtgcttgagctcttctctgatcagaagctgcaggaggtgagccggatcttgaaacaggtcttccttatcttcccccacttctgcttgggccgggggctcattgacatggtgcggaaccaggccatggctgatgcctttgagcgcttgggagacaggcagttccagtcacccctgcgctgggaggtggtcggcaagaacctcttggccatggtgatacaggggcccctcttccttctcttcacactactgctgcagcaccgaagccaactcctgccacagcccagggtgaggtctctgccactcctgggagaggaggacgaggatgtagcccgtgaacgggagcgggtggtccaaggagccacccagggggatgtgttggtgctgaggaacttgaccaaggtataccgtgggcagaggatgccagctgttgaccgcttgtgcctggggattccccctggtgagtgttttgggctgctgggtgtgaatggagcagggaagacgtccacgtttcgcatggtgacgggggacacattggccagcaggggcgaggctgtgctggcaggccacagcgtggcccgggaacccagtgctgcgcacctcagcatgggatactgccctcaatccgatgccatctttgagctgctgacgggccgcgagcacctggagctgcttgcgcgcctgcgcggtgtcccggaggcccaggttgcccagaccgctggctcgggcctggcgcgtctgggactctcatggtacgcagaccggcctgcaggcacctacagcggagggaacaaacgcaagctggcgacggccctggcgctggttggggacccagccgtggtgtttctggacgagccgaccacaggcatggaccccagcgcgcggcgcttcctttggaacagccttttggccgtggtgcgggagggccgttcagtgatgctcacctcccatagcatggaggagtgtgaagcgctctgctcgcgcctggccatcatggtgaatgggcggttccgctgcctgggcagcccgcaacatctcaagggcagattcgcggcgggtcacacactgaccctgcgggtgcccgccgcaaggtcccagccggcagcggccttcgtggcggccgagttccctggggcggagctgcgcgaggcacatggaggccgcctgcgcttccagctgccgccgggagggcgctgcgccctggcgcgcgtctttggagagctggcggtgcacggcgcagagcacggcgtggaggacttttccgtgagccagacgatgctggaggaggtattcttgtacttctccaaggaccaggggaaggacgaggacaccgaagagcagaaggaggcaggagtgggagtggaccccgcgccaggcctgcagcaccccaaacgcgtcagccagttcctcgatgaccctagcactgccgagactgtgctctgagcctccctcccctgcggggccgcggggaggccctgggaatggcaagggcaaggtagagtgcctaggagccctggactcaggctggcagaggggctggtgccctggagaaaataaagagaaggctggagagaagccgtggtggtgaaa

SEQ ID NO: 110072 - DNA, 343 bp, Homo sapiens
  Payload ID: 1607
  Gene Symbol: ABCA7
  Gene Name: ATP-binding cassette, sub-family A (ABC1), member 7
  ENST ID: ENST00000611490
  CDS Start-End: 234-343
gcgggcaagctcagcgcacttggcttaaggggcggcgcgctccctgcctgctgctgggcggagggaaggcggcaagagctgcggagcccctggaagagcttccaggaaccctgcgctgtgggataaaggaatgaggttcagaaaggggcagggagttgcccgcagccgcaccgcacgtcttcagcccgaccgttgtcctgacctctctgtcccgtcccctgcccagtctcaccatggccttctggacacagctgatgctgctgctctggaagaatttcatgtatcgccggagacagccggtccagctcctggtcgaattgctgtggcctctcttcctcttctt

SEQ ID NO: 110073 - DNA, 520 bp, Homo sapiens
  Payload ID: 1607
  Gene Symbol: ABCA7
  Gene Name: ATP-binding cassette, sub-family A (ABC1), member 7
  ENST ID: ENST00000529442
  CDS Start-End: 1-289
cctcgtctccatctgtgtggtctttgccatgtcctttgtcccggccagcttcactcttgtcctcattgaggagcgagtcacccgagccaagcacctgcagctcatggggggcctgtcccccaccctctactggcttggcaactttctctgggacatgtgtaactacttggtgccagcatgcatcgtggtgctcatctttctggccttccagcagagggcatatgtggcccctgccaacctgcctgctctcctgctgttgctactactgtatggaagctgcaggaggtgagccggatcttgaaacaggtcttccttatcttcccccacttctgcttgggccgggggctcattgacatggtgcggaaccaggccatggctgatgcctttgagcgcttgggagacaggcagttccagtcacccctgcgctgggaggtggtcggcaagaacctcttggccatggtgatacaggggcccctcttccttctcttcacactactgctgcagcaccgaagccaactcc

SEQ ID NO: 110074 - DNA, 876 bp, Homo sapiens
  Payload ID: 1607
  Gene Symbol: ABCA7
  Gene Name: ATP-binding cassette, sub-family A (ABC1), member 7
  ENST ID: ENST00000612569
  CDS Start-End: 1-843
cgggaacccagtgctgcgcacctcagcatgggatactgccctcaatccgatgccatctttgagctgctgacgggccgcgagcacctggagctgcttgcgcgcctgcgcggtgtcccggaggcccaggttgcccagaccgctggctcgggcctggcgcgtctgggactctcatggtacgcagaccggcctgcaggcacctacagcggagggaacaaacgcaagctggcgacggccctggcgctggttggggacccagccgtggtgtttctggacgagccgaccacaggcatggaccccagcgcgcggcgcttcctttggaacagccttttggccgtggtgcgggagggccgttcagtgatgctcacctcccatagcatggaggagtgtgaagcgctctgctcgcgcctggccatcatggtgaatgggcggttccgctgcctgggcagcccgcaacatctcaagggcagattcgcggcgggtcacacactgaccctgcgggtgcccgccgcaaggtcccagccggcagcggccttcgtggcggccgagttccctggggcggagctgcgcgaggcacatggaggccgcctgcgcttccagctgccgccgggagggcgctgcgccctggcgcgcgtctttggagagctggcggtgcacggcgcagagcacggcgtggaggacttttccgtgagccagacgatgctggaggaggaccaggggaaggacgaggacaccgaagagcagaaggaggcaggagtgggagtggaccccgcgccaggcctgcagcaccccaaacgcgtcagccagttcctcgatgaccctagcactgccgagactgtgctctgagcctccctcccctgcggggccgcggggaggccc

SEQ ID NO: 110075 - DNA, 5677 bp, Homo sapiens
  Payload ID: 1608
  Gene Symbol: ABCA8
  Gene Name: ATP-binding cassette, sub-family A (ABC1), member 8
  Uniprot ID: O94911
  ENST ID: ENST00000269080
  CDS Start-End: 139-4884
cagaagtcaaatagttaaagcaaattctagatacatggtagagaccaggagaaaatatgaataactttcttctaaacaaggagctcagtggataaaccatacctctagattccttgcttccattttcccagaaacaagatgaggaagagaaagatcagtgtgtgtcaacaaacttgggccttattatgcaagaactttcttaaaaaatggagaatgaaaagagagtccttaatggaatggctgaattcattgctcctactactttgtttgtatatatatcctcatagtcatcaagtaaatgatttttcttcactgcttaccatggacctgggacgggtagatacatttaatgaatccagattttctgttgtatacacacctgtcaccaacacgacccaacagataatgaataaagtagcctctactcccttcctggcaggtaaagaggtcttgggactgccagatgaggaaagtattaaagaattcacagcaaattatcctgaagaaatagtaagagtcacctttactaatacatactcatatcatttgaagttcttgctaggacatggaatgccagcaaagaaggagcacaaggaccatacagctcattgttatgaaacaaatgaagatgtttactgtgaagtttcagtattttggaaggaaggttttgtggctcttcaagctgccattaatgctgctattatagaaatcacaacaaatcactcagtgatggaggagctgatgtcagttactggaaaaaatatgaagatgcattccttcattggtcaatcaggagttataactgatttgtaccttttttcctgcattatttcattttcctcattcatttactatgcatctgttaatgtcacaagagagaggaaaaggatgaaggccttgatgacaatgatgggtcttcgggattcagcgttctggctctcctggggtttgctctatgctggtttcatcttcattatggcccttttcttggcacttgttataagatctacccagtttatcattttgtctggcttcatggtagtcttcagcctctttctcctgtatggattatctttggtagctttggctttcttaatgagcatcttggtaaagaaatctttcctcaccggcctggtcgtgttcctcctcactgtcttttgggggtgtctggggttcacatcactgtacagacaccttcctgcatccttggagtggattttaagcttgcttagtccctttgccttcatgcttggaatggcccagcttttacacttggactatgatttgaattctaatgcatttcctcatccatcggacggctcaaatctcattgtagcaacaaatttcatgttggcatttgacacttgcctctatctggcattggcgatttactttgaaaaaattttgccaaatgaatatggacatcgacgtccacctttgtttttcctgaagtcctcattttggtctcaaacacaaaagactgatcacgtggcccttgaagatgaaatggatgccgatccttcatttcatgactcttttgaacaagcgcctccagaattccaagggaaagaagccatcagaatcagaaatgttacaaaagaatataaaggaaagcctgataaaatagaagccttgaaagatctggtatttgacatttacgaaggccaaatcactgcaatacttggtcacagtggagctggaaagtcaacactgctaaacattcttagtgggttgtctgttcccaccaaaggttcagtcaccatctataacaataagctttcagaaatggctgacctagaaaatctcagcaagctgaccggagtttgtccacaatccaatgtgcaatttgacttcctcactgtaagagaaaacctcagactctttgctaaaataaaagggattctgccacaagaagtggataaagagattttcctgttggatgaaccaactgctggattggatcccttttcaagacaccaagtatggaaccttctgaaagaacgcaaaacagaccgcgtgatcctcttcagtacccagttcatggatgaggccgacatcctggcggacaggaaagtatttctctcccaagggaagctaaagtgcgcgggctcttctttgtttctaaagaagaaatgggggattggatatcacttaagcttgcagttaaatgaaatatgtgttgaggaaaacataacatcacttgttaaacagcacatccctgatgccaaattatcagccaaaagcgaaggaaaacttatttatacattacccttagaaagaacaaataaatttccagaactttacaaggatcttgatagctatcctgacctaggaattgagaattatggtgtttccatgacaactttgaatgaagtattcctgaagctagaaggaaaatctacaattaatgaatcggacattgctattttgggagaagtacaagcggaaaaagctgacgacactgaaaggcttgttgagatggaacaagtcctctcttcacttaacaagatgagaaagacaataggtggtgtggctctctggcgacagcaaatctgcgcaattgcaagggttcgcttgttaaagttaaagcatgaaagaaaagctcttttagcactgctattaattctaatggctggattttgccctcttcttgtggagtataccatggtgaaaatatatcaaaacagttacacctgggaactttctcctcatttgtatttccttgctcctggacaacaaccacatgaccctctcactcaactactgatcatcaataaaacaggggcaagcattgatgactttatacagtctgtggagcaccagaacatagctttagaagtggatgcatttggaactagaaatggcacagatgacccatcttataatggagccatcacagtgtgttgtaatgaaaagaattacagcttttcgttagcatgcaatgccaaaagattgaattgcttcccagttcttatggacattgttagtaatgggctacttggaatggttaaaccatcagtacatatccgaactgaaagaagtacatttttggagaatggacaggacaatccaatcggattcctggcatatatcatgttctggctggttttaacatcgagttgcccaccttacattgccatgagcagcatcgatgattataagaacagagctcggtcccagctacggatttccggactctccccttctgcttactggtttgggcaggcgctggtggatgtttccctgtacttcttggtcttcgtttttatatatttaatgagctacatttcaaacttcgaagacatgctacttacaataattcatattattcaaatcccatgtgctgttggttattccttttccctcatcttcatgacatacgtgatttccttcatctttcgcaaggggagaaaaaatagtggcatttggtcattttgtttctatgttgtcactgtattctctgtggctggatttgcgttcagtatcttcgaaagtgatattccatttatcttcacttttttaataccacctgccacaatgattggctgtttgttcttatcttctcatcttctcttttcttctctcttttctgaagaacgaatggatgtacagccatttctggtattcctaattcctttccttcattttatcatttttctttttactcttcgatgtctggaatggaagtttggaaagaaatcaatgagaaaggatcctttctttagaatttctccaagaagtagtgatgtgtgtcaaaatccagaagaaccagaaggagaggatgaagatgttcagatggaaagagtgagaacagcaaatgccttgaattctactaattttgatgagaagccagtcatcattgccagctgtctacgcaaggagtatgcagggaagaggaaaggctgtttttccaagaggaagaataagatagccacgagaaatgtctccttctgtgttagaaaaggtgaagttttaggattattaggacacaatggagctggtaaaagcacatccattaaggtgataactggagacacaaaaccaactgctggacaagtgctactgaaagggagcggtggaggggatgccctggagttcctggggtactgccctcaggagaacgcgctgtggcccaacctgacagtgaggcagcacctggaggtgtacgccgccgtgaaagggctgaggaaaggggatgctgaggttgccatcacacggttagtggatgcgctcaagctgcaggaccagctgaagtctcccgtgaagaccttgtcagagggaataaagagaaagctgtgctttgtcctgagcatactggggaacccgtcagtggtgcttctggatgagccgtcgaccgggatggaccccgaggggcagcagcaaatgtggcaggccatccgggccacctttagaaacacggaaaggggtgccctcctaaccacccactacatggcagaggctgaggccgtgtgtgaccgagtggccatcatggtatctgggaggttgagatgtatcggttccatccaacacctgaaaagcaaatttggcaaagattacctgctggagatgaaggtgaagaacctggcacaagtggagcccctccatgcagagatcctgaggcttttcccccaggctgctcggcaggaaaggtactcctctctgatggtttataagttgccagtggaagatgtgcaacctttagcccaagctttcttcaaattagagaaggttaaacagagctttgacctagaggagtacagcctctcacagtctaccctggagcaggttttcctggagctctccaaggagcaggagctgggtgattttgaggaggattttgatccctcagtgaagtggaagctcctcccccaggaagagccttaaaaccccaaattctgtgttcctgtttaaacccgtggttttttttaaatacatttatttttatagcagcaatgttctatttttagaaactatattataagtacagaaatggttctccgtgtggtgggaggaggaggttcgggtgctgggtaagtgccatgtcagtgtggacagaggcatttgactaagccaacctcctctcacagcctctgtatctctgcaggccatactggttccattgttctgtataatactgaataaataaatttacttttacatgatcgtataagtttctagataagataaacaaattttgtttaaatttttttaataaaaatcttaaaacactttttttctaacctagactgagaaattcatgtttacttttctaggtgtatgatactttgtaaagttgatactttcctaagaatttaacatgtcatatttttgaaatagatttaagtgtgcttcttattgctaaaaatactaaatgtcatgggtcatagtatctgatatcaatatcgttgataacatatccacaggtaacaccatgatgtaggcataaatggaaaacaaaaaccctactatttcaaatatattgtacttttttatttctgtaagccaactgtgtgccattttcactggacttttaaatctagactttagtgatgtctacattgtaaatgatcttttgtggatatttgtcacttggtttcagaaagttcacaaatgtagcaacagctcacatgactgagtaggtagaaaatgtgaaataaatctcatatatatagttttg

SEQ ID NO: 110076 - DNA, 5823 bp, Homo sapiens
  Payload ID: 1608
  Gene Symbol: ABCA8
  Gene Name: ATP-binding cassette, sub-family A (ABC1), member 8
  ENST ID: ENST00000430352
  CDS Start-End: 180-5030
ataacctccactctgaaagcagtcttcacagaaacttttcacagaagtcaaatagttaaagcaaattctagatacatggtagagaccaggagaaaatatgaataactttcttctaaacaaggagctcagtggataaaccatacctctagattccttgcttccattttcccagaaacaagatgaggaagagaaagatcagtgtgtgtcaacaaacttgggccttattatgcaagaactttcttaaaaaatggagaatgaaaagagagtccttaatggaatggctgaattcattgctcctactactttgtttgtatatatatcctcatagtcatcaagtaaatgatttttcttcactgcttaccatggacctgggacgggtagatacatttaatgaatccagattttctgttgtatacacacctgtcaccaacacgacccaacagataatgaataaagtagcctctactcccttcctggcaggtaaagaggtcttgggactgccagatgaggaaagtattaaagaattcacagcaaattatcctgaagaaatagtaagagtcacctttactaatacatactcatatcatttgaagttcttgctaggacatggaatgccagcaaagaaggagcacaaggaccatacagctcattgttatgaaacaaatgaagatgtttactgtgaagtttcagtattttggaaggaaggttttgtggctcttcaagctgccattaatgctgctattatagaaatcacaacaaatcactcagtgatggaggagctgatgtcagttactggaaaaaatatgaagatgcattccttcattggtcaatcaggagttataactgatttgtaccttttttcctgcattatttcattttcctcattcatttactatgcatctgttaatgtcacaagagagaggaaaaggatgaaggccttgatgacaatgatgggtcttcgggattcagcgttctggctctcctggggtttgctctatgctggtttcatcttcattatggcccttttcttggcacttgttataagatctacccagtttatcattttgtctggcttcatggtagtcttcagcctctttctcctgtatggattatctttggtagctttggctttcttaatgagcatcttggtaaagaaatctttcctcaccggcctggtcgtgttcctcctcactgtcttttgggggtgtctggggttcacatcactgtacagacaccttcctgcatccttggagtggattttaagcttgcttagtccctttgccttcatgcttggaatggcccagcttttacacttggactatgatttgaattctaatgcatttcctcatccatcggacggctcaaatctcattgtagcaacaaatttcatgttggcatttgacacttgcctctatctggcattggcgatttactttgaaaaaattttgccaaatgaatatggacatcgacgtccacctttgtttttcctgaagtcctcattttggtctcaaacacaaaagactgatcacgtggcccttgaagatgaaatggatgccgatccttcatttcatgactcttttgaacaagcgcctccagaattccaagggaaagaagccatcagaatcagaaatgttacaaaagaatataaaggaaagcctgataaaatagaagccttgaaagatctggtatttgacatttacgaaggccaaatcactgcaatacttggtcacagtggagctggaaagtcaacactgctaaacattcttagtgggttgtctgttcccaccaaaggttcagtcaccatctataacaataagctttcagaaatggctgacctagaaaatctcagcaagctgaccggagtttgtccacaatccaatgtgcaatttgacttcctcactgtaagagaaaacctcagactctttgctaaaataaaagggattctgccacaagaagtggataaagagatacaaagggttctgctggaattggaaatgaaaaatattcaggatgttcttgctcaaaacttaagtggtggacagaaaagaaagctaacctttgggattgccattttaggagatcctcagattttcctgttggatgaaccaactgctggattggatcccttttcaagacaccaagtatggaaccttctgaaagaacgcaaaacagaccgcgtgatcctcttcagtacccagttcatggatgaggccgacatcctggcggacaggaaagtatttctctcccaagggaagctaaagtgcgcgggctcttctttgtttctaaagaagaaatgggggattggatatcacttaagcttgcagttaaatgaaatatgtgttgaggaaaacataacatcacttgttaaacagcacatccctgatgccaaattatcagccaaaagcgaaggaaaacttatttatacattacccttagaaagaacaaataaatttccagaactttacaaggatcttgatagctatcctgacctaggaattgagaattatggtgtttccatgacaactttgaatgaagtattcctgaagctagaaggaaaatctacaattaatgaatcggacattgctattttgggagaagtacaagcggaaaaagctgacgacactgaaaggcttgttgagatggaacaagtcctctcttcacttaacaagatgagaaagacaataggtggtgtggctctctggcgacagcaaatctgcgcaattgcaagggttcgcttgttaaagttaaagcatgaaagaaaagctcttttagcactgctattaattctaatggctggattttgccctcttcttgtggagtataccatggtgaaaatatatcaaaacagttacacctgggaactttctcctcatttgtatttccttgctcctggacaacaaccacatgaccctctcactcaactactgatcatcaataaaacaggggcaagcattgatgactttatacagtctgtggagcaccagaacatagctttagaagtggatgcatttggaactagaaatggcacagatgacccatcttataatggagccatcacagtgtgttgtaatgaaaagaattacagcttttcgttagcatgcaatgccaaaagattgaattgcttcccagttcttatggacattgttagtaatgggctacttggaatggttaaaccatcagtacatatccgaactgaaagaagtacatttttggagaatggacaggacaatccaatcggattcctggcatatatcatgttctggctggttttaacatcgagttgcccaccttacattgccatgagcagcatcgatgattataagaacagagctcggtcccagctacggatttccggactctccccttctgcttactggtttgggcaggcgctggtggatgtttccctgtacttcttggtcttcgtttttatatatttaatgagctacatttcaaacttcgaagacatgctacttacaataattcatattattcaaatcccatgtgctgttggttattccttttccctcatcttcatgacatacgtgatttccttcatctttcgcaaggggagaaaaaatagtggcatttggtcattttgtttctatgttgtcactgtattctctgtggctggatttgcgttcagtatcttcgaaagtgatattccatttatcttcacttttttaataccacctgccacaatgattggctgtttgttcttatcttctcatcttctcttttcttctctcttttctgaagaacgaatggatgtacagccatttctggtattcctaattcctttccttcattttatcatttttctttttactcttcgatgtctggaatggaagtttggaaagaaatcaatgagaaaggatcctttctttagtagtgatgtgtgtcaaaatccagaagaaccagaaggagaggatgaagatgttcagatggaaagagtgagaacagcaaatgccttgaattctactaattttgatgagaagccagtcatcattgccagctgtctacgcaaggagtatgcagggaagaggaaaggctgtttttccaagaggaagaataagatagccacgagaaatgtctccttctgtgttagaaaaggtgaagttttaggattattaggacacaatggagctggtaaaagcacatccattaaggtgataactggagacacaaaaccaactgctggacaagtgctactgaaagggagcggtggaggggatgccctggagttcctggggtactgccctcaggagaacgcgctgtggcccaacctgacagtgaggcagcacctggaggtgtacgccgccgtgaaagggctgaggaaaggggatgctgaggttgccatcacacggttagtggatgcgctcaagctgcaggaccagctgaagtctcccgtgaagaccttgtcagagggaataaagagaaagctgtgctttgtcctgagcatactggggaacccgtcagtggtgcttctggatgagccgtcgaccgggatggaccccgaggggcagcagcaaatgtggcaggccatccgggccacctttagaaacacggaaaggggtgccctcctaaccacccactacatggcagaggctgaggccgtgtgtgaccgagtggccatcatggtatctgggaggttgagatgtatcggttccatccaacacctgaaaagcaaatttggcaaagattacctgctggagatgaaggtgaagaacctggcacaagtggagcccctccatgcagagatcctgaggcttttcccccaggctgctcggcaggaaaggtactcctctctgatggtttataagttgccagtggaagatgtgcaacctttagcccaagctttcttcaaattagagaaggttaaacagagctttgacctagaggagtacagcctctcacagtctaccctggagcaggttttcctggagctctccaaggagcaggagctgggtgattttgaggaggattttgatccctcagtgaagtggaagctcctcccccaggaagagccttaaaaccccaaattctgtgttcctgtttaaacccgtggttttttttaaatacatttatttttatagcagcaatgttctatttttagaaactatattataagtacagaaatggttctccgtgtggtgggaggaggaggttcgggtgctgggtaagtgccatgtcagtgtggacagaggcatttgactaagccaacctcctctcacagcctctgtatctctgcaggccatactggttccattgttctgtataatactgaataaataaatttacttttacatgatcgtataagtttctagataagataaacaaattttgtttaaatttttttaataaaaatcttaaaacactttttttctaacctagactgagaaattcatgtttacttttctaggtgtatgatactttgtaaagttgatactttcctaagaatttaacatgtcatatttttgaaatagatttaagtgtgcttcttattgctaaaaatactaaatgtcatgggtcatagtatctgatatcaatatcgttgataacatatccacaggtaacaccatgatgtaggcataaatggaaaacaaaaaccctactatttcaaatatattgtacttttttatttctgtaagccaactgtgtgccattttcactggacttttaaatctagactttagtgatgtctacattgtaaatgatcttttgtggatatttgtcacttggtttcagaaagttcacaaatgtagcaacagctcacatgactgagtaggtagaaaatgtgaaataaatctcatatatatagttttg

SEQ ID NO: 110077 - DNA, 509 bp, Homo sapiens
  Payload ID: 1608
  Gene Symbol: ABCA8
  Gene Name: ATP-binding cassette, sub-family A (ABC1), member 8
  ENST ID: ENST00000585531
  CDS Start-End: 164-509
agcgtcctctcccccgccgtggtgagagcctgtctctgctttgtatccgtgctgggtccttgttgcaaatctcagctgcaaattatctttgcttgggaatgggaactggaagcttcctgccccacctgcagtggtagcaggctgttgctttttaccagacaagatgaggaagagaaagatcagtgtgtgtcaacaaacttgggccttattatgcaagaactttcttaaaaaatggagaatgaaaagagagtccttaatggaatggctgaattcattgctcctactactttgtttgtatatatatcctcatagtcatcaagtaaatgatttttcttcactgcttaccatggacctgggacgggtagatacatttaatgaatccagattttctgttgtatacacacctgtcaccaacacgacccaacagataatgaataaagtagcctctactcccttcctggcaggtaaagaggtcttgggactgccagatgaggaaagtattaaagaat

SEQ ID NO: 110078 - DNA, 2106 bp, Homo sapiens
  Payload ID: 1608
  Gene Symbol: ABCA8
  Gene Name: ATP-binding cassette, sub-family A (ABC1), member 8
  ENST ID: ENST00000589533
  CDS Start-End: 1-2106
tcctgcatccttggagtggattttaagcttgcttagtccctttgccttcatgcttggaatggcccagcttttacacttggactatgatttgaattctaatgcatttcctcatccatcggacggctcaaatctcattgtagcaacaaatttcatgttggcatttgacacttgcctctatctggcattggcgatttactttgaaaaaattttgccaaatgaatatggacatcgacgtccacctttgtttttcctgaagtcctcattttggtctcaaacacaaaagactgatcacgtggcccttgaagatgaaatggatgccgatccttcatttcatgactcttttgaacaagcgcctccagaattccaagggaaagaagccatcagaatcagaaatgttacaaaagaatataaaggaaagcctgataaaatagaagccttgaaagatctggtatttgacatttacgaaggccaaatcactgcaatacttggtcacagtggagctggaaagtcaacactgctaaacattcttagtgggttgtctgttcccaccaaaggttcagtcaccatctataacaataagctttcagaaatggctgacctagaaaatctcagcaagctgaccggagtttgtccacaatccaatgtgcaatttgacttcctcactgtaagagaaaacctcagactctttgctaaaataaaagggattctgccacaagaagtggataaagagatacaaagggttctgctggaattggaaatgaaaaatattcaggatgttcttgctcaaaacttaagtggtggacagaaaagaaagctaacctttgggattgccattttaggagatcctcagattttcctgttggatgaaccaactgctggattggatcccttttcaagacaccaagtatggaaccttctgaaagaacgcaaaacagaccgcgtgatcctcttcagtacccagttcatggatgaggccgacatcctggcggacaggaaagtatttctctcccaagggaagctaaagtgcgcgggctcttctttgtttctaaagaagaaatgggggattggatatcacttaagcttgcagttaaatgaaatatgtgttgaggaaaacataacatcacttgttaaacagcacatccctgatgccaaattatcagccaaaagcgaaggaaaacttatttatacattacccttagaaagaacaaataaatttccagaactttacaaggatcttgatagctatcctgacctaggaattgagaattatggtgtttccatgacaactttgaatgaagtattcctgaagctagaaggaaaatctacaattaatgaatcggacattgctattttgggagaagtacaagcggaaaaagctgacgacactgaaaggcttgttgagatggaacaagtcctctcttcacttaacaagatgagaaagacaataggtggtgtggctctctggcgacagcaaatctgcgcaattgcaagggttcgcttgttaaagttaaagcatgaaagaaaagctcttttagcactgctattaattctaatggctggattttgccctcttcttgtggagtataccatggtgaaaatatatcaaaacagttacacctgggaactttctcctcatttgtatttccttgctcctggacaacaaccacatgaccctctcactcaactactgatcatcaataaaacaggggcaagcattgatgactttatacagtctgtggagcaccagaacatagctttagaagtggatgcatttggaactagaaatggcacagatgacccatcttataatggagccatcacagtgtgttgtaatgaaaagaattacagcttttcgttagcatgcaatgccaaaagattgaattgcttcccagttcttatggacattgttagtaatgggctacttggaatggttaaaccatcagtacatatccgaactgaaagaagtacatttttggaggtaaatatatataatcttacaattcctgactctcctctatcaggaatctcccagatcacccttttaagtgctggaatcttgtttttattgagtaaaccactgcataataaattaacatttggactcat

SEQ ID NO: 110079 - DNA, 5088 bp, Homo sapiens
  Payload ID: 1608
  Gene Symbol: ABCA8
  Gene Name: ATP-binding cassette, sub-family A (ABC1), member 8
  Uniprot ID: O94911
  ENST ID: ENST00000586539
  CDS Start-End: 190-5055
tccttgcttccattttcccagaagttttggtagcaggatgatgttggcctcataatgtgagttagagaggagtccctctttttcgactgtttggaattgtttcagaaggaatgctaccagctcctcttgtaccactggtagaattcagctgtgaatctgtctggtcctgggctttttttgattgacaagatgaggaagagaaagatcagtgtgtgtcaacaaacttgggccttattatgcaagaactttcttaaaaaatggagaatgaaaagagagtccttaatggaatggctgaattcattgctcctactactttgtttgtatatatatcctcatagtcatcaagtaaatgatttttcttcactgcttaccatggacctgggacgggtagatacatttaatgaatccagattttctgttgtatacacacctgtcaccaacacgacccaacagataatgaataaagtagcctctactcccttcctggcaggtaaagaggtcttgggactgccagatgaggaaagtattaaagaattcacagcaaattatcctgaagaaatagtaagagtcacctttactaatacatactcatatcatttgaagttcttgctaggacatggaatgccagcaaagaaggagcacaaggaccatacagctcattgttatgaaacaaatgaagatgtttactgtgaagtttcagtattttggaaggaaggttttgtggctcttcaagctgccattaatgctgctattatagaaatcacaacaaatcactcagtgatggaggagctgatgtcagttactggaaaaaatatgaagatgcattccttcattggtcaatcaggagttataactgatttgtaccttttttcctgcattatttcattttcctcattcatttactatgcatctgttaatgtcacaagagagaggaaaaggatgaaggccttgatgacaatgatgggtcttcgggattcagcgttctggctctcctggggtttgctctatgctggtttcatcttcattatggcccttttcttggcacttgttataagatctacccagtttatcattttgtctggcttcatggtagtcttcagcctctttctcctgtatggattatctttggtagctttggctttcttaatgagcatcttggtaaagaaatctttcctcaccggcctggtcgtgttcctcctcactgtcttttgggggtgtctggggttcacatcactgtacagacaccttcctgcatccttggagtggattttaagcttgcttagtccctttgccttcatgcttggaatggcccagcttttacacttggactatgatttgaattctaatgcatttcctcatccatcggacggctcaaatctcattgtagcaacaaatttcatgttggcatttgacacttgcctctatctggcattggcgatttactttgaaaaaattttgccaaatgaatatggacatcgacgtccacctttgtttttcctgaagtcctcattttggtctcaaacacaaaagactgatcacgtggcccttgaagatgaaatggatgccgatccttcatttcatgactcttttgaacaagcgcctccagaattccaagggaaagaagccatcagaatcagaaatgttacaaaagaatataaaggaaagcctgataaaatagaagccttgaaagatctggtatttgacatttacgaaggccaaatcactgcaatacttggtcacagtggagctggaaagtcaacactgctaaacattcttagtgggttgtctgttcccaccaaaggttcagtcaccatctataacaataagctttcagaaatggctgacctagaaaatctcagcaagctgaccggagtttgtccacaatccaatgtgcaatttgacttcctcactgtaagagaaaacctcagactctttgctaaaataaaagggattctgccacaagaagtggataaagagatacaaagggttctgctggaattggaaatgaaaaatattcaggatgttcttgctcaaaacttaagtggtggacagaaaagaaagctaacctttgggattgccattttaggagatcctcagattttcctgttggatgaaccaactgctggattggatcccttttcaagacaccaagtatggaaccttctgaaagaacgcaaaacagaccgcgtgatcctcttcagtacccagttcatggatgaggccgacatcctggcggacaggaaagtatttctctcccaagggaagctaaagtgcgcgggctcttctttgtttctaaagaagaaatgggggattggatatcacttaagcttgcagttaaatgaaatatgtgttgaggaaaacataacatcacttgttaaacagcacatccctgatgccaaattatcagccaaaagcgaaggaaaacttatttatacattacccttagaaagaacaaataaatttccagaactttacaaggatcttgatagctatcctgacctaggaattgagaattatggtgtttccatgacaactttgaatgaagtattcctgaagctagaaggaaaatctacaattaatgaatcggacattgctattttgggagaagtacaagcggaaaaagctgacgacactgaaaggcttgttgagatggaacaagtcctctcttcacttaacaagatgagaaagacaataggtggtgtggctctctggcgacagcaaatctgcgcaattgcaagggttcgcttgttaaagttaaagcatgaaagaaaagctcttttagcactgctattaattctaatggctggattttgccctcttcttgtggagtataccatggtgaaaatatatcaaaacagttacacctgggaactttctcctcatttgtatttccttgctcctggacaacaaccacatgaccctctcactcaactactgatcatcaataaaacaggggcaagcattgatgactttatacagtctgtggagcaccagaacatagctttagaagtggatgcatttggaactagaaatggcacagatgacccatcttataatggagccatcacagtgtgttgtaatgaaaagaattacagcttttcgttagcatgcaatgccaaaagattgaattgcttcccagttcttatggacattgttagtaatgggctacttggaatggttaaaccatcagtacatatccgaactgaaagaagtacatttttggagaatggacaggacaatccaatcggattcctggcatatatcatgttctggctggttttaacatcgagttgcccaccttacattgccatgagcagcatcgatgattataagaacagagctcggtcccagctacggatttccggactctccccttctgcttactggtttgggcaggcgctggtggatgtttccctgtacttcttggtcttcgtttttatatatttaatgagctacatttcaaacttcgaagacatgctacttacaataattcatattattcaaatcccatgtgctgttggttattccttttccctcatcttcatgacatacgtgatttccttcatctttcgcaaggggagaaaaaatagtggcatttggtcattttgtttctatgttgtcactgtattctctgtggctggatttgcgttcagtatcttcgaaagtgatattccatttatcttcacttttttaataccacctgccacaatgattggctgtttgttcttatcttctcatcttctcttttcttctctcttttctgaagaacgaatggatgtacagccatttctggtattcctaattcctttccttcattttatcatttttctttttactcttcgatgtctggaatggaagtttggaaagaaatcaatgagaaaggatcctttctttagaatttctccaagaagtagtgatgtgtgtcaaaatccagaagaaccagaaggagaggatgaagatgttcagatggaaagagtgagaacagcaaatgccttgaattctactaattttgatgagaagccagtcatcattgccagctgtctacgcaaggagtatgcagggaagaggaaaggctgtttttccaagaggaagaataagatagccacgagaaatgtctccttctgtgttagaaaaggtgaagttttaggattattaggacacaatggagctggtaaaagcacatccattaaggtgataactggagacacaaaaccaactgctggacaagtgctactgaaagggagcggtggaggggatgccctggagttcctggggtactgccctcaggagaacgcgctgtggcccaacctgacagtgaggcagcacctggaggtgtacgccgccgtgaaagggctgaggaaaggggatgctgaggttgccatcacacggttagtggatgcgctcaagctgcaggaccagctgaagtctcccgtgaagaccttgtcagagggaataaagagaaagctgtgctttgtcctgagcatactggggaacccgtcagtggtgcttctggatgagccgtcgaccgggatggaccccgaggggcagcagcaaatgtggcaggccatccgggccacctttagaaacacggaaaggggtgccctcctaaccacccactacatggcagaggctgaggccgtgtgtgaccgagtggccatcatggtatctgggaggttgagatgtatcggttccatccaacacctgaaaagcaaatttggcaaagattacctgctggagatgaaggtgaagaacctggcacaagtggagcccctccatgcagagatcctgaggcttttcccccaggctgctcggcaggaaaggtactcctctctgatggtttataagttgccagtggaagatgtgcaacctttagcccaagctttcttcaaattagagaaggttaaacagagctttgacctagaggagtacagcctctcacagtctaccctggagcaggttttcctggagctctccaaggagcaggagctgggtgattttgaggaggattttgatccctcagtgaagtggaagctcctcccccaggaagagccttaaaaccccaaattctgtgttcctgtttaaacccgt

SEQ ID NO: 110080 - DNA, 3264 bp, Homo sapiens
  Payload ID: 1608
  Gene Symbol: ABCA8
  Gene Name: ATP-binding cassette, sub-family A (ABC1), member 8
  ENST ID: ENST00000615593
  CDS Start-End: 1211-1681
actctgaaagcagtcttcacagaaacttttcacagaagtcaaatagttaaagcaaattctagatacatggtagagaccaggagaaaatatgaataactttcttctaaacaaggagctcagtggataaaccatacctctagattccttgcttccattttcccagaaacaagatgaggaagagaaagatcagtgtgtgtcaacaaacttgggccttattatgcaagaactttcttaaaaaatggagaatgaaaagagagtccttaatggaatggctgaattcattgctcctactactttgtttgtatatatatcctcatagtcatcaagtaaatgatttttcttcactgcttaccatggacctgggacgggtagatacatttaatgaatccagattttctgttgtatacacacctgtcaccaacacgacccaacagataatgaataaagtagcctctactcccttcctggcaggtaaagaggtcttgggactgccagatgaggaaagtattaaagaattcacagcaaattatcctgaagaaatagtaagagtcacctttactaatacatactcatatcatttgaagttcttgctaggacatggaatgccagcaaagaaggagcacaaggaccatacagctcattgttatgaaacaaatgaagatgtttactgtgaagtttcagtattttggaaggaaggttttgtggctcttcaagctgccattaatgctgctattatagaaatcacaacaaatcactcagtgatggaggagctgatgtcagttactggaaaaaatatgaagatgcattccttcattggtcaatcaggagttataactgatttgtaccttttttcctgcattatttcattttcctcattcatttactatgcatctgttaatgtcacaagagagaggaaaaggatgaaggccttgatgacaatgatgggtcttcgggattcagcgttctggctctcctggggtttgctctatgctggtttcatcttcattatggcccttttcttggcacttgttataagatctacccagtttatcattttgtctggcttcatggtagtcttcagcctctttctcctgtatggattatctttggtagctttggctttcttaatgagcatcttggtaaagaaatctttcctcaccggcctgcatccttggagtggattttaagcttgcttagtccctttgccttcatgcttggaatggcccagcttttacacttggactatgatttgaattctaatgcatttcctcatccatcggacggctcaaatctcattgtagcaacaaatttcatgttggcatttgacacttgcctctatctggcattggcgatttactttgaaaaaattttgccaaatgaatatggacatcgacgtccacctttgtttttcctgaagtcctcattttggtctcaaacacaaaagactgatcacgtggcccttgaagatgaaatggatgccgatccttcatttcatgactcttttgaacaagcgcctccagaattccaagggaaagaagccatcagaatcagaaatgttacaaaagaatataaaggaaagcctgataaaatagaagccttgaaagatctggtatttgacatttacgaaggccaaatcactgcaatattggtcacagtggagctggaaagtcaacactgctaaacattcttagtgggttgtctgttcccaccaaaggttcagtcaccatctataacaataagctttcagaaatggctgacctagaaaatctcagcaagctgaccggagtttgtccacaatccaatgtgcaatttgacttcctcactgtaagagaaaacctcagactctttgctaaaataaaagggattctgccacaagaagtggataaagagatacaaagggttctgctggaattggaaatgaaaaatattcaggatgttcttgctcaaaacttaagtggtggacagaaaagaaagctaacctttgggattgccattttaggagatcctcagattttcctgttggatgaaccaactgctggattggatcccttttcaagacaccaagtatggaaccttctgaaagaacgcaaaacagaccgcgtgatcctcttcagtacccagttcatggatgaggccgacatcctggcggacaggaaagtatttctctcccaagggaagctaaagtgcgcgggctcttctttgtttctaaagaagaaatgggggattggatatcacttaagcttgcagttaaatgaaatatgtgttgaggaaaacataacatcacttgttaaacagcacatccctgatgccaaattatcagccaaaagcgaaggaaaacttatttatacattacccttagaaagaacaaataaatttccagaactttacaaggatcttgatagctatcctgacctaggaattgagaattatggtgtttccatgacaactttgaatgaagtattcctgaagctagaaggaaaatctacaattaatgaatcggacattgctattttgggagaagtacaagcggaaaaagctgacgacactgaaaggcttgttgagatggaacaagtcctctcttcacttaacaagatgagaaagacaataggtggtgtggctctctggcgacagcaaatctgcgcaattgcaagggttcgcttgttaaagttaaagcatgaaagaaaagctcttttagcactgctattaattctaatggctggattttgccctcttcttgtggagtataccatggtgaaaatatatcaaaacagttacacctgggaactttctcctcatttgtatttccttgctcctggacaacaaccacatgaccctctcactcaactactgatcatcaataaaacaggggcaagcattgatgactttatacagtctgtggagcaccagaacatagctttagaagtggatgcatttggaactagaaatggcacagatgacccatcttataatggagccatcacagtgtgttgtaatgaaaagaattacagcttttcgttagcatgcaatgccaaaagattgaattgcttcccagttcttatggacattgttagtaatgggctacttggaatggttaaaccatcagtacatatccgaactgaaagaagtacatttttggaggtaaatatatataatcttacaattcctgactctcctctatcaggaatctcccagatcacccttttaagtgctggaatcttgtttttattgagtaaaccactgcataataaattaacatttggactc

SEQ ID NO: 110081 - DNA, 6514 bp, Homo sapiens
  Payload ID: 1609
  Gene Symbol: ABCA9
  Gene Name: ATP-binding cassette, sub-family A (ABC1), member 9
  Uniprot ID: Q8IUA7
  ENST ID: ENST00000340001
  CDS Start-End: 213-5087
agaagatattttggcaggctagctgaactgagaccagattctcctgggaaatttgtataaaacagaactattcacaatgaatgtgaaattaaaagcatgatgtagtagtgacccaaaaggaatgtgaattctcctccagaacatgcagagacccatggatgaactgtgtttctagatttttcctccagctttcctgagagaaacaggtcaaaatgagcaagagacgcatgagcgtgggtcagcaaacatgggctcttctctgcaagaactgtctcaaaaaatggagaatgaaaagacagaccttgttggaatggctcttttcatttcttctggtactgtttctgtacctatttttctccaatttacatcaagttcatgacactcctcaaatgtcttcaatggatctgggacgtgtagatagttttaatgatactaattatgttattgcatttgcacctgaatccaaaactacccaagagataatgaacaaagtggcttcagccccattcctaaaaggaagaacaatcatggggtggcctgatgaaaaaagcatggatgaattggatttgaactattcaatagacgcagtgagagtcatctttactgataccttctcctaccatttgaagttttcttggggacatagaatccccatgatgaaagagcacagagaccattcagctcactgtcaagcagtgaatgaaaaaatgaagtgtgaaggttcagagttctgggagaaaggctttgtagcttttcaagctgccattaatgctgctatcatagaaatcgcaacaaatcattcagtgatggaacagctgatgtcagttactggtgtacatatgaagatattaccttttgttgcccaaggaggagttgcaactgattttttcattttcttttgcattatttctttttctacatttatatactatgtatcagtcaatgttacacaagaaagacaatacattacgtcattgatgacaatgatgggactccgagagtcagcattctggctttcctggggtttgatgtatgctggcttcatccttatcatggccactttaatggctcttattgtaaaatctgcacaaattgtcgtcctgactggttttgtgatggtcttcaccctctttctcctctatggcctgtctttgataactttagctttcctgatgagtgtgttgataaagaaacctttccttacgggcttggttgtgtttctccttattgtcttttgggggatcctgggattcccagcattgtatacacgtcttcctgcatttttggaatggactttgtgtcttcttagcccctttgccttcactgttgggatggcccagcttatacatttggactatgatgtgaattctaatgcccacttggattcttcacaaaatccatacctcataatagctactcttttcatgttggtttttgacacccttctgtatttggtattgacattatattttgacaaaattttgcccgctgaatatggacatcgatgttctcccttgtttttcctgaaatcctgtttttggtttcaacacggaagggctaatcatgtggtccttgagaatgaaacagattctgatcctacacctaatgactgttttgaaccagtgtctccagaattctgtgggaaagaagccatcagaatcaaaaatcttaaaaaagaatatgcagggaagtgtgagagagtagaagctttgaaaggtgtggtgtttgacatatatgaaggccagatcactgccctccttggtcacagtggagctggaaaaactaccctgttaaacatacttagtgggttgtcagttccaacatcaggttcagtcactgtctataatcacacactttcaagaatggctgatatagaaaatatcagcaagttcactggattttgtccacaatccaatgtgcaatttggatttctcactgtgaaagaaaacctcaggctgtttgctaaaataaaagggattttgccacatgaagtggagaaagaggtacaacgagttgtacaggaattagaaatggaaaatattcaagacatccttgctcaaaacttaagtggtggacaaaataggaaactaacttttgggattgccattttaggagatcctcaagttttgctattggatgaaccgactgctggattggatcctctttcaaggcaccgaatatggaatctcctgaaagaggggaaatcagacagagtaattctcttcagcacccagtttatagatgaggctgacattctggcggacaggaaggtgttcatatccaatgggaagctgaagtgtgcaggctcttctctgttccttaagaagaaatggggcataggctaccatttaagtttgcatctgaatgaaaggtgtgatccagagagtataacatcactggttaagcagcacatctctgatgccaaattgacagcacaaagtgaagaaaaacttgtatatattttgcctttggaaaggacaaacaaatttccagaactttacagggatcttgatagatgttctaaccaaggcattgaggattatggtgtttccataacaactttgaatgaggtgtttctgaaattagaaggaaaatcaactattgatgaatcagatattggaatttggggacaattacaaactgatggggcaaaagatataggaagccttgttgagctggaacaagttttgtcttccttccacgaaacaaggaaaacaatcagtggcgtggcgctctggaggcagcaggtctgtgcaatagcaaaagttcgcttcctaaagttaaagaaagaaagaaaaagcctgtggactatattattgctttttggtattagctttatccctcaacttttggaacatctattctacgagtcatatcagaaaagttacccgtgggaactgtctccaaatacatacttcctctcaccaggacaacaaccacaggatcctctgacccatttactggtcatcaataagacagggtcaaccattgataactttttacattcactgaggcgacagaacatagctatagaagtggatgcctttggaactagaaatggcacagatgacccatcttacaatggtgctatcattgtgtcaggtgatgaaaaggatcacagattttcaatagcatgtaatacaaaacggctgaattgctttcctgtcctcctggatgtcattagcaatggactacttggaatttttaattcgtcagaacacattcagactgacagaagcacattttttgaagagcatatggattatgagtatgggtaccgaagtaacaccttcttctggataccgatggcagcctctttcactccatacattgcaatgagcagcattggtgactacaaaaaaaaagctcattcccagctacggatttcaggcctctacccttctgcatactggtttggccaagcactggtggatgtttccctgtactttttgatcctcctgctaatgcaaataatggattatatttttagcccagaggagattatatttataattcaaaacctgttaattcaaatcctgtgtagtattggctatgtctcatctcttgttttcttgacatatgtgatttcattcatttttcgcaatgggagaaaaaatagtggcatttggtcatttttcttcttaattgtggtcatcttctcgatagttgctactgatctaaatgaatatggatttctagggctattttttggcaccatgttaatacctcccttcacattgattggctctctattcattttttctgagatttctcctgattccatggattacttaggagcttcagaatctgaaattgtatacctggcactgctaataccttaccttcattttctcatttttcttttcattctgcgatgcctagaaatgaactgcaggaagaaactaatgagaaaggatcctgtgttcagaatttctccaagaagcaacgctatttttccaaacccagaagagcctgaaggagaggaggaagatatccagatggaaagaatgagaacagtgaatgctatggctgtgcgagactttgatgagacacccgtcatcattgccagctgtctacggaaggaatatgcaggcaaaaagaaaaattgcttttctaaaaggaagaaaaaaattgccacaagaaatgtctctttttgtgttaaaaaaggtgaagttataggactgttaggacacaatggagctggtaaaagtacaactattaagatgataactggagacacaaaaccaactgcaggacaggtgattttgaaagggagcggtggaggggaacccctgggcttcctggggtactgccctcaggagaatgcgctgtggcccaacctgacagtgaggcagcacctggaggtgtacgctgccgtgaaaggtctcaggaaaggggacgcaatgatcgccatcacacggttagtggatgcgctcaagctgcaggaccagctgaaggctcccgtgaagaccttgtcagagggaataaagcgaaagctgtgctttgtgctgagcatcctggggaacccgtcagtggtgcttctggatgagccgtcgaccgggatggaccccgaggggcagcagcaaatgtggcaggtgattcgggccacctttagaaacacggagaggggcgccctcctgaccacccactacatggcagaggctgaggcggtgtgtgaccgagtggccatcatggtgtcaggaaggctgagatgtattggttccatccaacacctgaaaagcaaatttggcaaagactacctgctggagatgaagctgaagaacctggcacaaatggagcccctccatgcagagatcctgaggcttttcccccaggctgctcagcaggaaaggttctcctccctgatggtctataagttgcctgttgaggatgtgcgacctttatcacaggctttcttcaaattagagatagttaaacagagtttcgacctggaggagtacagcctctcacagtctaccctggagcaggttttcctggagctctccaaggagcaggagctgggtgatcttgaagaggactttgatccctcggtgaagtggaaactcctcctgcaggaagagccttaaagctccaaataccctatatctttctttaatcctgtgactcttttaaagataatattttatagccttaatatgccttatatcagaggtggtacaaaatgcatttgaaactcatgcaataattatcctcagtagtatttcttacagtgagacaacaggcgatgtcagtgagggcgatcatagggcataagcctaagccataccatgcagcctttgtgccagcaaccaaatcccatgtttcctactgtgttaagtttaaaaatgcatttattatagaattgtctacatttctgaggatgtcatggagaatgcttaattttctttctctgaacttcaaaatattaaatattttcttatttatttttttgattaaagtataaattaagacaccctattgacttccgggtaaggggagtcaattgattacccagcagcacagtatttgctttttataattccctttttaaatacttgttcttaattcactggttttccttttctgtcatttttcagagtttagattgtgagtccatgttttgtctgttgtgcctataaaggaaatttgaaatctgtatcattctactataaagacacatgcacacgtatgtttattgcagcactgtttacaatagcaaagacttggaaccaaccaaaatacccacaaatgatagaccggataaagaaaacgtgacacatatacaccatggaatactatgcagccatagaaaaggatgagttcatattcttcacagggacatggatgaagctggaaaccatcatcctcagcaaactaacacaggaacagaaaaccaaacaccgcatgttctcactcataagtgggaattgaacaatgagaatacatggacacagggaggggaacaccacaccctggggcctgttggggggatgggggctaggggagggatagcattaggagaaatacctgatgtagatgatgggttgatgggtgcagcaaagtaccatggcacatgtatacctgtgtaacaaacctgcacattcagcacatgtatcccagaacttaaagtataataaaaataaataaataatttcagtaagaacctgatcaagttgaacatgtatatatatgttatacacaagtttgaaacatatttctgtttttatatgttttcttatgatgcaagggcatactcttatgcaaataattaaaacttcataggtcttaatttcccatatctctatatattattatgacctatccaactggtaaccctatgaacaccttaaaataaacttgtatactcttatttaggtgagtttttcttgttaatactattattattgctatctaattgaatacttgaaggaagttgtgtgaaagaccttggctttgattttagttcttatattcttctagtttttgaaaataaaacacttccatcaacccgtaa

SEQ ID NO: 110082 - DNA, 6116 bp, Homo sapiens
  Payload ID: 1609
  Gene Symbol: ABCA9
  Gene Name: ATP-binding cassette, sub-family A (ABC1), member 9
  ENST ID: ENST00000453985
  CDS Start-End: 73-4833
acatgcagagacccatggatgaactgtgtttctagatttttcctccagctttcctgagagaaacaggtcaaaatgagcaagagacgcatgagcgtgggtcagcaaacatgggctcttctctgcaagaactgtctcaaaaaatggagaatgaaaagacagaccttgttggaatggctcttttcatttcttctggtactgtttctgtacctatttttctccaatttacatcaagttcatgacactcctcaaatgtcttcaatggatctgggacgtgtagatagttttaatgatactaattatgttattgcatttgcacctgaatccaaaactacccaagagataatgaacaaagtggcttcagccccattcctaaaaggaagaacaatcatggggtggcctgatgaaaaaagcatggatgaattggatttgaactattcaatagacgcagtgagagtcatctttactgataccttctcctaccatttgaagttttcttggggacatagaatccccatgatgaaagagcacagagaccattcagctcactgtcaagcagtgaatgaaaaaatgaagtgtgaaggttcagagttctgggagaaaggctttgtagcttttcaagctgccattaatgctgctatcatagaaatcgcaacaaatcattcagtgatggaacagctgatgtcagttactggtgtacatatgaagatattaccttttgttgcccaaggaggagttgcaactgattttttcattttcttttgcattatttctttttctacatttatatactatgtatcagtcaatgttacacaagaaagacaatacattacgtcattgatgacaatgatgggactccgagagtcagcattctggctttcctggggtttgatgtatgctggcttcatccttatcatggccactttaatggctcttattgtaaaatctgcacaaattgtcgtcctgactggttttgtgatggtcttcaccctctttctcctctatggcctgtctttgataactttagctttcctgatgagtgtgttgataaagaaacctttccttacgggcttggttgtgtttctccttattgtcttttgggggatcctgggattcccagcattgtatacacgtcttcctgcatttttggaatggactttgtgtcttcttagcccctttgccttcactgttgggatggcccagcttatacatttggactatgatgtgaattctaatgcccacttggattcttcacaaaatccatacctcataatagctactcttttcatgttggtttttgacacccttctgtatttggtattgacattatattttgacaaaattttgcccgctgaatatggacatcgatgttctcccttgtttttcctgaaatcctgtttttggtttcaacacggaagggctaatcatgtggtccttgagaatgaaacagattctgatcctacacctaatgactgttttgaaccagtgtctccagaattctgtgggaaagaagccatcagaatcaaaaatcttaaaaaagaatatgcagggaagtgtgagagagtagaagctttgaaaggtgtggtgtttgacatatatgaaggccagatcactgccctccttggtcacagtggagctggaaaaactaccctgttaaacatacttagtgggttgtcagttccaacatcaggttcagtcactgtctataatcacacactttcaagaatggctgatatagaaaatatcagcaagttcactggattttgtccacaatccaatgtgcaatttggatttctcactgtgaaagaaaacctcaggctgtttgctaaaataaaagggattttgccacatgaagtggagaaagaggtacaacgagttgtacaggaattagaaatggaaaatattcaagacatccttgctcaaaacttaagtggtggacaaaataggaaactaacttttgggattgccattttaggagatcctcaagttttgctattggatgaaccgactgctggattggatcctctttcaaggcaccgaatatggaatctcctgaaagaggggaaatcagacagagtaattctcttcagcacccagtttatagatgaggctgacattctggcggacaggaaggtgttcatatccaatgggaagctgaagtgtgcaggctcttctctgttccttaagaagaaatggggcataggctaccatttaagtttgcatctgaatgaaaggtgtgatccagagagtataacatcactggttaagcagcacatctctgatgccaaattgacagcacaaagtgaagaaaaacttgtatatattttgcctttggaaaggacaaacaaatttccagaactttacagggatcttgatagatgttctaaccaaggcattgaggattatggtgtttccataacaactttgaatgaggtgtttctgaaattagaaggaaaatcaactattgatgaatcagatattggaatttggggacaattacaaactgatggggcaaaagatataggaagccttgttgagctggaacaagttttgtcttccttccacgaaacaaggaaaacaatcagtggcgtggcgctctggaggcagcaggtctgtgcaatagcaaaagttcgcttcctaaagttaaagaaagaaagaaaaagcctgtggactatattattgctttttggtattagctttatccctcaacttttggaacatctattctacgagtcatatcagaaaagttacccgtgggaactgtctccaaatacatacttcctctcaccaggacaacaaccacaggatcctctgacccatttactggtcatcaataagacagggtcaaccattgataactttttacattcactgaggcgacagaacatagctatagaagtggatgcctttggaactagaaatggcacagatgacccatcttacaatggtgctatcattgtgtcaggtgatgaaaaggatcacagattttcaatagcatgtaatacaaaacggctgaattgctttcctgtcctcctggatgtcattagcaatggactacttggaatttttaattcgtcagaacacattcagactgacagaagcacattttttgaagagcatatggattatgagtatgggtaccgaagtaacaccttcttctggataccgatggcagcctctttcactccatacattgcaatgagcagcattggtgactacaaaaaaaaagctcattcccagctacggatttcaggcctctacccttctgcatactggtttggccaagcactggtggatgtttccctgtactttttgatcctcctgctaatgcaaataatggattatatttttagcccagaggagattatatttataattcaaaacctgttaattcaagtggtcatcttctcgatagttgctactgatctaaatgaatatggatttctagggctattttttggcaccatgttaatacctcccttcacattgattggctctctattcattttttctgagatttctcctgattccatggattacttaggagcttcagaatctgaaattgtatacctggcactgctaataccttaccttcattttctcatttttcttttcattctgcgatgcctagaaatgaactgcaggaagaaactaatgagaaaggatcctgtgttcagaatttctccaagaagcaacgctatttttccaaacccagaagagcctgaaggagaggaggaagatatccagatggaaagaatgagaacagtgaatgctatggctgtgcgagactttgatgagacacccgtcatcattgccagctgtctacggaaggaatatgcaggcaaaaagaaaaattgcttttctaaaaggaagaaaaaaattgccacaagaaatgtctctttttgtgttaaaaaaggtgaagttataggactgttaggacacaatggagctggtaaaagtacaactattaagatgataactggagacacaaaaccaactgcaggacaggtgattttgaaagggagcggtggaggggaacccctgggcttcctggggtactgccctcaggagaatgcgctgtggcccaacctgacagtgaggcagcacctggaggtgtacgctgccgtgaaaggtctcaggaaaggggacgcaatgatcgccatcacacggttagtggatgcgctcaagctgcaggaccagctgaaggctcccgtgaagaccttgtcagagggaataaagcgaaagctgtgctttgtgctgagcatcctggggaacccgtcagtggtgcttctggatgagccgtcgaccgggatggaccccgaggggcagcagcaaatgtggcaggtgattcgggccacctttagaaacacggagaggggcgccctcctgaccacccactacatggcagaggctgaggcggtgtgtgaccgagtggccatcatggtgtcaggaaggctgagatgtattggttccatccaacacctgaaaagcaaatttggcaaagactacctgctggagatgaagctgaagaacctggcacaaatggagcccctccatgcagagatcctgaggcttttcccccaggctgctcagcaggaaaggttctcctccctgatggtctataagttgcctgttgaggatgtgcgacctttatcacaggctttcttcaaattagagatagttaaacagagtttcgacctggaggagtacagcctctcacagtctaccctggagcaggttttcctggagctctccaaggagcaggagctgggtgatcttgaagaggactttgatccctcggtgaagtggaaactcctcctgcaggaagagccttaaagctccaaataccctatatctttctttaatcctgtgactcttttaaagataatattttatagccttaatatgccttatatcagaggtggtacaaaatgcatttgaaactcatgcaataattatcctcagtagtatttcttacagtgagacaacaggcgatgtcagtgagggcgatcatagggcataagcctaagccataccatgcagcctttgtgccagcaaccaaatcccatgtttcctactgtgttaagtttaaaaatgcatttattatagaattgtctacatttctgaggatgtcatggagaatgcttaattttctttctctgaacttcaaaatattaaatattttcttatttatttttttgattaaagtataaattaagacaccctattgacttccgggtaaggggagtcaattgattacccagcagcacagtatttgctttttataattccctttttaaatacttgttcttaattcactggttttccttttctgtcatttttcagagtttagattgtgagtccatgttttgtctgttgtgcctataaaggaaatttgaaatctgtatcattctactataaagacacatgcacacgtatgtttattgcagcactgtttacaatagcaaagacttggaaccaaccaaaatacccacaaatgatagaccggataaagaaaacgtgacacatatacaccatggaatactatgcagccatagaaaaggatgagttcatattcttcacagggacatggatgaagctggaaaccatcatcctcagcaaactaacacaggaacagaaaaccaaacaccgcatgttctcactcataagtgggaattgaacaatgagaatacatggacacagggaggggaacaccacaccctggggcctgttggggggatgggggctaggggagggatagcattaggagaaatacctgatgtagatgatgggttgatgggtgcagcaaagtaccatggcacatgtatacctgtgtaacaaacctgcacattcagcacatgtatcccagaacttaaagtataataaaaataaataaataatttcagtaagaacctgatcaagttgaacatgtatatatatgttatacacaagtttgaaacatatttctgtttttatatgttttcttatgatgcaagggcatactcttatgcaaataattaaaacttcataggtcttaatttcccatatctctatatattattatgacctatccaactggtaaccctatgaacaccttaaaataaacttgtatactctta

SEQ ID NO: 110083 - DNA, 582 bp, Homo sapiens
  Payload ID: 1609
  Gene Symbol: ABCA9
  Gene Name: ATP-binding cassette, sub-family A (ABC1), member 9
  ENST ID: ENST00000585714
  CDS Start-End: 314-582
aaaggaatgtgaattctcctccagaacatgcagagacccatggatgaactgtgtttctagatttttcctccagctttcctgagactatatttttaagatgtcttcatgtggatgggtgtgtgccaatccagtgctcctgaatcctacatagtaatctttggactgtatccatcaaaatttgttttattaacaccatgccacaataatctacattataaagaacatccttgcactggtcccctcatgaccccatgtgagaatctccatgggctgcatatccaggagcagaactgattgatggaaacaggtcaaaatgagcaagagacgcatgagcgtgggtcagcaaacatgggctcttctctgcaagaactgtctcaaaaaatggagaatgaaaagacagaccttgttggaatggctcttttcatttcttctggtactgtttctgtacctatttttctccaatttacatcaagttcatgacactcctcaaatgtcttcaatggatctgggacgtgtagatagttttaatgatactaattatgttattgcatttgcacctgaatccaaaactacccaagagat

SEQ ID NO: 110084 - DNA, 1428 bp, Homo sapiens
  Payload ID: 1609
  Gene Symbol: ABCA9
  Gene Name: ATP-binding cassette, sub-family A (ABC1), member 9
  Uniprot ID: Q8IUA7
  ENST ID: ENST00000495634
  CDS Start-End: 55-858
atgaactgtgtttctagatttttcctccagctttcctgagagaaacaggtcaaaatgagcaagagacgcatgagcgtgggtcagcaaacatgggctcttctctgcaagaactgtctcaaaaaatggagaatgaaaagacagaccttgttggaatggctcttttcatttcttctggtactgtttctgtacctatttttctccaatttacatcaagttcatgacactcctcaaatgtcttcaatggatctgggacgtgtagatagttttaatgatactaattatgttattgcatttgcacctgaatccaaaactacccaagagataatgaacaaagtggcttcagccccattcctaaaaggaagaacaatcatggggtggcctgatgaaaaaagcatggatgaattggatttgaactattcaatagacgcagtgagagtcatctttactgataccttctcctaccatttgaagttttcttggggacatagaatccccatgatgaaagagcacagagaccattcagctcactgtcaagcagtgaatgaaaaaatgaagtgtgaaggttcagagttctgggagaaaggctttgtagcttttcaagctgccattaatgctgctatcatagaaatcgcaacaaatcattcagtgatggaacagctgatgtcagttactggtgtacatatgaagatattaccttttgttgcccaaggaggagttgcaactgattttttcattttcttttgcattatttctttttctacatttatatactatgtatcagtcaatgttacacaagaaagacaatacattacgtcattgatgacaatgatgggactccgagagtcagcattctggtaaatcatatgactccaatccattatacagcataaacaaacagaacaacttagctggttgactccttagaccaggggtccccaagccccaggccacagactgctactggtccatggccagttaggtaccaggccacatagcaggaggtgagtggcaggcaagtgagcaaagcttcatgtatatttacagccactccctattgctcacattaccacctgagctccacctcctgtcagaatagccacgttattagagtatcacagaagctcaaactctattgtgaactgtgtatgtgagagatctaggttgcgggctccttatgagtatccaatgcctgatgatctgtcactcaagagatctaggttgcgggctctttatgagtatccaatgcctgatgatctgtcactgtctcccatcacccccagatgggatctagttgcaggaaaacaagctcagggttcctactgattctacattatggtaagttgtataattatttcattatatattacaatgtaataataatagaaataaagtgcacaataaatgtaatccacatgcatcatcccaaaa

SEQ ID NO: 110085 - DNA, 4645 bp, Homo sapiens
  Payload ID: 1610
  Gene Symbol: ABCB1
  Gene Name: ATP-binding cassette, sub-family B (MDR/TAP), member 1
  Uniprot ID: P08183
  ENST ID: ENST00000265724
  CDS Start-End: 419-4261
tattcagatattctccagattcctaaagattagagatcatttctcattctcctaggagtactcacttcaggaagcaaccagataaaagagaggtgcaacggaagccagaacattcctcctggaaattcaacctgtttcgcagtttctcgaggaatcagcattcagtcaatccgggccgggagcagtcatctgtggtgaggctgattggctgggcaggaacagcgccggggcgtgggctgagcacagccgcttcgctctctttgccacaggaagcctgagctcattcgagtagcggctcttccaagctcaaagaagcagaggccgctgttcgtttcctttaggtctttccactaaagtcggagtatcttcttccaaaatttcacgtcttggtggccgttccaaggagcgcgaggtcggaatggatcttgaaggggaccgcaatggaggagcaaagaagaagaacttttttaaactgaacaataaaagtgaaaaagataagaaggaaaagaaaccaactgtcagtgtattttcaatgtttcgctattcaaattggcttgacaagttgtatatggtggtgggaactttggctgccatcatccatggggctggacttcctctcatgatgctggtgtttggagaaatgacagatatctttgcaaatgcaggaaatttagaagatctgatgtcaaacatcactaatagaagtgatatcaatgatacagggttcttcatgaatctggaggaagacatgaccaggtatgcctattattacagtggaattggtgctggggtgctggttgctgcttacattcaggtttcattttggtgcctggcagctggaagacaaatacacaaaattagaaaacagttttttcatgctataatgcgacaggagataggctggtttgatgtgcacgatgttggggagcttaacacccgacttacagatgatgtctccaagattaatgaaggaattggtgacaaaattggaatgttctttcagtcaatggcaacatttttcactgggtttatagtaggatttacacgtggttggaagctaacccttgtgattttggccatcagtcctgttcttggactgtcagctgctgtctgggcaaagatactatcttcatttactgataaagaactcttagcgtatgcaaaagctggagcagtagctgaagaggtcttggcagcaattagaactgtgattgcatttggaggacaaaagaaagaacttgaaaggtacaacaaaaatttagaagaagctaaaagaattgggataaagaaagctattacagccaatatttctataggtgctgctttcctgctgatctatgcatcttatgctctggccttctggtatgggaccaccttggtcctctcaggggaatattctattggacaagtactcactgtattcttttctgtattaattggggcttttagtgttggacaggcatctccaagcattgaagcatttgcaaatgcaagaggagcagcttatgaaatcttcaagataattgataataagccaagtattgacagctattcgaagagtgggcacaaaccagataatattaagggaaatttggaattcagaaatgttcacttcagttacccatctcgaaaagaagttaagatcttgaagggtctgaacctgaaggtgcagagtgggcagacggtggccctggttggaaacagtggctgtgggaagagcacaacagtccagctgatgcagaggctctatgaccccacagaggggatggtcagtgttgatggacaggatattaggaccataaatgtaaggtttctacgggaaatcattggtgtggtgagtcaggaacctgtattgtttgccaccacgatagctgaaaacattcgctatggccgtgaaaatgtcaccatggatgagattgagaaagctgtcaaggaagccaatgcctatgactttatcatgaaactgcctcataaatttgacaccctggttggagagagaggggcccagttgagtggtgggcagaagcagaggatcgccattgcacgtgccctggttcgcaaccccaagatcctcctgctggatgaggccacgtcagccttggacacagaaagcgaagcagtggttcaggtggctctggataaggccagaaaaggtcggaccaccattgtgatagctcatcgtttgtctacagttcgtaatgctgacgtcatcgctggtttcgatgatggagtcattgtggagaaaggaaatcatgatgaactcatgaaagagaaaggcatttacttcaaacttgtcacaatgcagacagcaggaaatgaagttgaattagaaaatgcagctgatgaatccaaaagtgaaattgatgccttggaaatgtcttcaaatgattcaagatccagtctaataagaaaaagatcaactcgtaggagtgtccgtggatcacaagcccaagacagaaagcttagtaccaaagaggctctggatgaaagtatacctccagtttccttttggaggattatgaagctaaatttaactgaatggccttattttgttgttggtgtattttgtgccattataaatggaggcctgcaaccagcatttgcaataatattttcaaagattataggggtttttacaagaattgatgatcctgaaacaaaacgacagaatagtaacttgttttcactattgtttctagcccttggaattatttcttttattacatttttccttcagggtttcacatttggcaaagctggagagatcctcaccaagcggctccgatacatggttttccgatccatgctcagacaggatgtgagttggtttgatgaccctaaaaacaccactggagcattgactaccaggctcgccaatgatgctgctcaagttaaaggggctataggttccaggcttgctgtaattacccagaatatagcaaatcttgggacaggaataattatatccttcatctatggttggcaactaacactgttactcttagcaattgtacccatcattgcaatagcaggagttgttgaaatgaaaatgttgtctggacaagcactgaaagataagaaagaactagaaggttctgggaagatcgctactgaagcaatagaaaacttccgaaccgttgtttctttgactcaggagcagaagtttgaacatatgtatgctcagagtttgcaggtaccatacagaaactctttgaggaaagcacacatctttggaattacattttccttcacccaggcaatgatgtatttttcctatgctggatgtttccggtttggagcctacttggtggcacataaactcatgagctttgaggatgttctgttagtattttcagctgttgtctttggtgccatggccgtggggcaagtcagttcatttgctcctgactatgccaaagccaaaatatcagcagcccacatcatcatgatcattgaaaaaacccctttgattgacagctacagcacggaaggcctaatgccgaacacattggaaggaaatgtcacatttggtgaagttgtattcaactatcccacccgaccggacatcccagtgcttcagggactgagcctggaggtgaagaagggccagacgctggctctggtgggcagcagtggctgtgggaagagcacagtggtccagctcctggagcggttctacgaccccttggcagggaaagtgctgcttgatggcaaagaaataaagcgactgaatgttcagtggctccgagcacacctgggcatcgtgtcccaggagcccatcctgtttgactgcagcattgctgagaacattgcctatggagacaacagccgggtggtgtcacaggaagagattgtgagggcagcaaaggaggccaacatacatgccttcatcgagtcactgcctaataaatatagcactaaagtaggagacaaaggaactcagctctctggtggccagaaacaacgcattgccatagctcgtgcccttgttagacagcctcatattttgcttttggatgaagccacgtcagctctggatacagaaagtgaaaaggttgtccaagaagccctggacaaagccagagaaggccgcacctgcattgtgattgctcaccgcctgtccaccatccagaatgcagacttaatagtggtgtttcagaatggcagagtcaaggagcatggcacgcatcagcagctgctggcacagaaaggcatctatttttcaatggtcagtgtccaggctggaacaaagcgccagtgaactctgactgtatgagatgttaaatactttttaatatttgtttagatatgacatttattcaaagttaaaagcaaacacttacagaattatgaagaggtatctgtttaacatttcctcagtcaagttcagagtcttcagagacttcgtaattaaaggaacagagtgagagacatcatcaagtggagagaaatcatagtttaaactgcattataaattttataacagaattaaagtagattttaaaagataaaatgtgtaattttgtttatattttcccatttggactgtaactgactgccttgctaaaagattatagaagtagcaaaaagtattgaaatgtttgcataaagtgtctataataaaactaaactttcatgtgactgg

SEQ ID NO: 110086 - DNA, 461 bp, Homo sapiens
  Payload ID: 1610
  Gene Symbol: ABCB1
  Gene Name: ATP-binding cassette, sub-family B (MDR/TAP), member 1
  ENST ID: ENST00000416177
  CDS Start-End: 318-461
tcattactctttacctgtgaagagtagaacatgaagaaatctactttattcagatattctccagattcctaaagattagagatcatttctcattctcctaggagtactcacttcaggaagcaaccagataaaagagaggtgcaacggaagccagaacattcctcctggaaattcaacctgtttcgcagtttctcgaggaatcagcattcagtcaatccgggccgggagcagtcatctgtggtctttccactaaagtcggagtatcttcttccaaaatttcacgtcttggtggccgttccaaggagcgcgaggtcggaatggatcttgaaggggaccgcaatggaggagcaaagaagaagaacttttttaaactgaacaataaaagtgaaaaagataagaaggaaaagaaaccaactgtcagtgtattttcaatgtttcgctattcaaattggcttgacaag

SEQ ID NO: 110087 - DNA, 4524 bp, Homo sapiens
  Payload ID: 1610
  Gene Symbol: ABCB1
  Gene Name: ATP-binding cassette, sub-family B (MDR/TAP), member 1
  Uniprot ID: P08183
  ENST ID: ENST00000543898
  CDS Start-End: 494-4144
aaacacttgtattaccattttaaaggctatcattactctttacctgtgaagagtagaacatgaagaaatctactttattcagatattctccagattcctaaagattagagatcatttctcattctcctaggagtactcacttcaggaagcaaccagataaaagagaggtgcaacggaagccagaacattcctcctggaaattcaacctgtttcgcagtttctcgaggaatcagcattcagtcaatccgggccgggagcagtcatctgtggtgaggctgattggctgggcaggaacagcgccggggcgtgggctgagcacagccgcttcgctctctttgccacaggaagcctgagctcattcgagtagcggctcttccaagctcaaagaagcagaggccgctgttcgtttcctttaggtctttccactaaagtcggagtatcttcttccaaaatttcacgtcttggtggccgttccaaggagcgcgaggtcggaatggatcttgaaggggaccgcaatggaggagcaaagaagaagaacttttttaaactgaacaataaaagtgaaaaagataagaaggaaaagaaaccaactgtcagtgtattttcaatgtttcgctattcaaattggcttgacaagttgtatatggtggtgggaactttggctgccatcatccatggggctggacttcctctcatgatgctggtgtttggagaaatgacagatatctttgcaaatgcaggaaatttagaagatctgatgtcaaacatcactaatagaagtgatatcaatgatacagggttcttcatgaatctggaggaagacatgaccagtgatgtctccaagattaatgaaggaattggtgacaaaattggaatgttctttcagtcaatggcaacatttttcactgggtttatagtaggatttacacgtggttggaagctaacccttgtgattttggccatcagtcctgttcttggactgtcagctgctgtctgggcaaagatactatcttcatttactgataaagaactcttagcgtatgcaaaagctggagcagtagctgaagaggtcttggcagcaattagaactgtgattgcatttggaggacaaaagaaagaacttgaaaggtacaacaaaaatttagaagaagctaaaagaattgggataaagaaagctattacagccaatatttctataggtgctgctttcctgctgatctatgcatcttatgctctggccttctggtatgggaccaccttggtcctctcaggggaatattctattggacaagtactcactgtattcttttctgtattaattggggcttttagtgttggacaggcatctccaagcattgaagcatttgcaaatgcaagaggagcagcttatgaaatcttcaagataattgataataagccaagtattgacagctattcgaagagtgggcacaaaccagataatattaagggaaatttggaattcagaaatgttcacttcagttacccatctcgaaaagaagttaagatcttgaagggtctgaacctgaaggtgcagagtgggcagacggtggccctggttggaaacagtggctgtgggaagagcacaacagtccagctgatgcagaggctctatgaccccacagaggggatggtcagtgttgatggacaggatattaggaccataaatgtaaggtttctacgggaaatcattggtgtggtgagtcaggaacctgtattgtttgccaccacgatagctgaaaacattcgctatggccgtgaaaatgtcaccatggatgagattgagaaagctgtcaaggaagccaatgcctatgactttatcatgaaactgcctcataaatttgacaccctggttggagagagaggggcccagttgagtggtgggcagaagcagaggatcgccattgcacgtgccctggttcgcaaccccaagatcctcctgctggatgaggccacgtcagccttggacacagaaagcgaagcagtggttcaggtggctctggataaggccagaaaaggtcggaccaccattgtgatagctcatcgtttgtctacagttcgtaatgctgacgtcatcgctggtttcgatgatggagtcattgtggagaaaggaaatcatgatgaactcatgaaagagaaaggcatttacttcaaacttgtcacaatgcagacagcaggaaatgaagttgaattagaaaatgcagctgatgaatccaaaagtgaaattgatgccttggaaatgtcttcaaatgattcaagatccagtctaataagaaaaagatcaactcgtaggagtgtccgtggatcacaagcccaagacagaaagcttagtaccaaagaggctctggatgaaagtatacctccagtttccttttggaggattatgaagctaaatttaactgaatggccttattttgttgttggtgtattttgtgccattataaatggaggcctgcaaccagcatttgcaataatattttcaaagattataggggtttttacaagaattgatgatcctgaaacaaaacgacagaatagtaacttgttttcactattgtttctagcccttggaattatttcttttattacatttttccttcagggtttcacatttggcaaagctggagagatcctcaccaagcggctccgatacatggttttccgatccatgctcagacaggatgtgagttggtttgatgaccctaaaaacaccactggagcattgactaccaggctcgccaatgatgctgctcaagttaaaggggctataggttccaggcttgctgtaattacccagaatatagcaaatcttgggacaggaataattatatccttcatctatggttggcaactaacactgttactcttagcaattgtacccatcattgcaatagcaggagttgttgaaatgaaaatgttgtctggacaagcactgaaagataagaaagaactagaaggttctgggaagatcgctactgaagcaatagaaaacttccgaaccgttgtttctttgactcaggagcagaagtttgaacatatgtatgctcagagtttgcaggtaccatacagaaactctttgaggaaagcacacatctttggaattacattttccttcacccaggcaatgatgtatttttcctatgctggatgtttccggtttggagcctacttggtggcacataaactcatgagctttgaggatgttctgttagtattttcagctgttgtctttggtgccatggccgtggggcaagtcagttcatttgctcctgactatgccaaagccaaaatatcagcagcccacatcatcatgatcattgaaaaaacccctttgattgacagctacagcacggaaggcctaatgccgaacacattggaaggaaatgtcacatttggtgaagttgtattcaactatcccacccgaccggacatcccagtgcttcagggactgagcctggaggtgaagaagggccagacgctggctctggtgggcagcagtggctgtgggaagagcacagtggtccagctcctggagcggttctacgaccccttggcagggaaagtgctgcttgatggcaaagaaataaagcgactgaatgttcagtggctccgagcacacctgggcatcgtgtcccaggagcccatcctgtttgactgcagcattgctgagaacattgcctatggagacaacagccgggtggtgtcacaggaagagattgtgagggcagcaaaggaggccaacatacatgccttcatcgagtcactgcctaataaatatagcactaaagtaggagacaaaggaactcagctctctggtggccagaaacaacgcattgccatagctcgtgcccttgttagacagcctcatattttgcttttggatgaagccacgtcagctctggatacagaaagtgaaaaggttgtccaagaagccctggacaaagccagagaaggccgcacctgcattgtgattgctcaccgcctgtccaccatccagaatgcagacttaatagtggtgtttcagaatggcagagtcaaggagcatggcacgcatcagcagctgctggcacagaaaggcatctatttttcaatggtcagtgtccaggctggaacaaagcgccagtgaactctgactgtatgagatgttaaatactttttaatatttgtttagatatgacatttattcaaagttaaaagcaaacacttacagaattatgaagaggtatctgtttaacatttcctcagtcaagttcagagtcttcagagacttcgtaattaaaggaacagagtgagagacatcatcaagtggagagaaatcatagtttaaactgcattataaattttataacagaattaaagtagattttaaaagataaaatgtgtaattttgtttatattttcccatttggactgtaactgactgccttgctaaaagattatagaagtagcaaaaagtattgaaatgtttgcataaagtgtctataataaaactaaactttcatgtga
